United States Patent 9,216,205 (MODIFIED POLYNUCLEOTIDES ENCODING GRANULYSIN) - sequence listing, part 12

SEQ ID NO: 19460 - DNA, 1713 bp, Artificial Sequence
  Description of Artificial Sequence: Synthetic coding sequence
atgtctgagcagagcatctgccaggcccgggctgctgtgatggtgtatgatgatgccaacaagaagtgggtgcctgctgggggcagcacaggcttcagccgggtgcacatctaccaccacactggaaacaacaccttccgggtggtgggcaggaagatccaggaccaccaggtggtgatcaactgtgccatccccaagggcctgaagtacaaccaggccacccagaccttccaccagtggagagatgcccggcaggtgtatggcctgaactttggcagcaaagaagatgccaacgtgtttgccagcgccatgatgcacgccctggaggtgctgaacagccaggagaccggccccaccctgccccggcagaacagccagctgcctgcccaggtgcagaatggccccagccaggaggagctggagatccagaggcggcagctgcaggagcagcagaggcagaaggagctggagcgggagcggctggagcgggagaggatggagcgggagcggctggagcgggagcggctggagcgggagcggctggagcgggagcggctggagcaggagcagctggagcgggagcggcaggagcgggagcggcaggagcggctggagcggcaggagcggctggagcggcaggagcggctggagcggcaggagcggctggaccgggagcggcaggagcggcaggagcgggagcggctggagcggctggagcgggagcggcaggagcgggagcggcaggagcagctggagcgggagcagctggagtgggagcgggagcggcgcatcagcagcgctgctgccccagcctctgtggagacccccctgaacagcgtgctgggggacagcagcgccagcgagcccggcctgcaggccgccagccagcctgctgagacccccagccagcagggcatcgtgctgggccccctggcccctcctcctcctccacccctgcccccaggccctgcccaggcctctgtggccctgcccccacctcctggccccccacctcctccacccctgcccagcactggacctcctcctcctcctcctcctccacccctgcccaaccaggtgcccccacctcctcctcctcctccagccccacccctgcctgccagcggcttcttcctggcctccatgtctgaggacaaccggcccctgaccggcctggccgccgccatcgccggggccaagctgaggaaggtgtccaggatggaggacaccagcttccccagcggcggcaatgccatcggcgtgaacagcgccagcagcaagacagacaccggcagaggaaatggccccctgcccctgggcggcagcggcctgatggaggagatgtctgccctgctggccaggagaagaagaattgctgagaagggcagcaccattgaaacagagcagaaggaggacaagggagaagattctgagcctgtgaccagcaaggccagcagcaccagcaccccagagcccaccaggaagccctgggagaggaccaacaccatgaatggcagcaagagccctgtgatcagccggcccaagagcacccccctgagccagcccagcgccaatggagtgcagacagagggcctggactatgaccggctgaagcaggacatcctggatgagatgaggaaggagctgaccaagctgaaggaggagctgattgatgccatccggcaggagctgagcaagagcaacacagcctag

SEQ ID NO: 19461 - DNA, 1776 bp, Artificial Sequence
  Description of Artificial Sequence: Synthetic coding sequence
atgtctgagcagagcatctgccaggcccgggctgctgtgatggtgtatgatgatgccaacaagaagtgggtgcctgctgggggcagcacaggcttcagccgggtgcacatctaccaccacactggaaacaacaccttccgggtggtgggcaggaagatccaggaccaccaggtggtgatcaactgtgccatccccaagggcctgaagtacaaccaggccacccagaccttccaccagtggagagatgcccggcaggtgtatggcctgaactttggcagcaaagaagatgccaacgtgtttgccagcgccatgatgcacgccctggaggtgctgaacagccaggagaccggccccaccctgccccggcagaacagccagctgcctgcccaggtgcagaatggccccagccaggaggagctggagatccagaggcggcagctgcaggagcagcagaggcagaaggagctggagcgggagcggctggagcgggagaggatggagcgggagcggctggagcgggagcggctggagcgggagcggctggagcgggagcggctggagcaggagcagctggagcgggagcggcaggagcgggagcggcaggagcggctggagcggcaggagcggctggagcggcaggagcggctggagcggcaggagcggctggaccgggagcggcaggagcggcaggagcgggagcggctggagcggctggagcgggagcggcaggagcgggagcggcaggagcagctggagcgggagcagctggagtgggagcgggagcggcgcatcagcagcgctgctgccccagcctctgtggagacccccctgaacagcgtgctgggggacagcagcgccagcgagcccggcctgcaggccgccagccagcctgctgagacccccagccagcagggcatcgtgctgggccccctggcccctcctcctcctccacccctgcccccaggccctgcccaggcctctgtggccctgcccccacctcctggccccccacctcctccacccctgcccagcactggacctcctcctcctcctcctcctccacccctgcccaaccaggtgcccccacctcctcctcctcctccagccccacccctgcctgccagcggcttcttcctggcctccatgtctgaggacaaccggcccctgaccggcctggccgccgccatcgccggggccaagctgaggaaggtgtccaggatggaggacaccagcttccccagcggcggcaatgccatcggcgtgaacagcgccagcagcaagacagacaccggcagaggaaatggccccctgcccctgggcggcagcggcctgatggaggagatgtctgccctgctggccaggagaagaagaattgctgagaagggcagcaccattgaaacagagcagaaggaggacaagggagaagattctgagcctgtgaccagcaaggccagcagcaccagcaccccagagcccaccaggaagccctgggagaggaccaacaccatgaatggcagcaagagccctgtgatcagcagaagagacagccccaggaagaaccagatcgtgtttgacaacagaagctatgacagcctgcaccggcccaagagcacccccctgagccagcccagcgccaacggggtgcagacagagggcctggactatgaccggctgaagcaggacatcctggatgagatgaggaaggagctgaccaagctgaaggaggagctgattgatgccatccggcaggagctgagcaagagcaacacagcctag

SEQ ID NO: 19462 - DNA, 1599 bp, Artificial Sequence
  Description of Artificial Sequence: Synthetic coding sequence
tctgagcagagcatctgccaggcccgggctgctgtgatggtgtatgatgatgccaacaagaagtgggtgcctgctgggggcagcacaggcttcagccgggtgcacatctaccaccacacaggcaacaacaccttccgggtggtgggcaggaagatccaggaccaccaggtggtgatcaactgtgccatccccaagggcctgaagtacaaccaggccacccagaccttccaccagtggagagatgcccggcaggtgtatggcctgaactttggcagcaaggaggatgccaacgtgtttgccagcgccatgatgcacgccctggaggtgctgaacagccaggagaccggccccaccctgccccggcagaacagccagctgcctgcccaggtgcagaatggccccagccaggaggagctggagatccagaggcggcagctgcaggagcagcagaggcagaaggagctggagcgggagcggctggagcgggagaggatggagcgggagcggctggagcgggagcggctggagcgggagcggctggagcgggagcggctggagcaggagcagctggagcgggagcggcaggagcgggagcggcaggagcggctggagcggcaggagcggctggagcggcaggagcggctggagcggcaggagcggctggaccgggagcggcaggagcggcaggagcgggagcggctggagcggctggagcgggagcggcaggagcgggagcggcaggagcagctggagcgggagcagctggagtgggagcgggagcggcgcatcagcagcgctggcatcgtgctgggccccctggcccctcctcctcctccacccctgcccccaggccctgcccaggcctctgtggccctgcccccacctcctggccccccacctcctccacccctgcccagcactggacctcctcctcctcctcctcctccacccctgcccaaccaggtgcccccacctcctcctcctcctccagccccacccctgcctgccagcggcttcttcctggcctccatgtctgaggacaaccggcccctgaccggcctggccgccgccatcgccggggccaagctgaggaaggtgtccaggatggaggacaccagcttccccagcggcggcaatgccatcggcgtgaacagcgccagcagcaagacagacaccggcagaggaaatggccccctgcccctgggcggcagcggcctgatggaggagatgtctgccctgctggccaggagaagaagaattgctgagaagggcagcaccattgaaacagagcagaaggaggacaagggagaagattctgagcctgtgaccagcaaggccagcagcaccagcaccccagagcccaccaggaagccctgggagaggaccaacaccatgaatggcagcaagagccctgtgatcagccggcccaagagcacccccctgagccagcccagcgccaatggagtgcagacagagggcctggactatgaccggctgaagcaggacatcctggatgagatgaggaaggagctgaccaagctgaaggaggagctgattgatgccatccggcaggagctgagcaagagcaacacagcctag

SEQ ID NO: 19463 - DNA, 1878 bp, Artificial Sequence
  Description of Artificial Sequence: Synthetic coding sequence
atggaccggggcaccctgcccctggccgtggccctgctgctggccagctgcagcctgagccccaccagcctggccgagaccgtgcactgtgacctgcagcctgtgggccctgagcggggggaggtgacctacaccaccagccaggtgtccaagggctgtgtggcccaggccccaaatgccatcctggaggtgcacgtgctcttcctggagttccccaccggccccagccagctggagctgaccctgcaggccagcaagcagaatggcacctggccccgggaggtgctgctggtgctgtctgtgaacagcagcgtcttcctgcacctgcaggccctgggcatccccctgcacctggcctacaacagcagcctggtgaccttccaggagcccccaggagtgaacaccacagagctgcccagcttccccaagacccagatcctggagtgggccgctgagcggggccccatcaccagcgctgctgagctgaatgacccccagagcatcctgctgcggctgggccaggcccagggcagcctgtccttctgcatgctggaggccagccaggacatgggccgcaccctggagtggaggcccaggaccccagccctggtgcggggctgccacctggagggcgtggccggccacaaggaggcccacatcctgcgggtgctgcccggccacagcgctggccccaggacagtgacagtgaaggtggagctgagctgtgcccctggggacctggatgctgtgctgatcctgcagggccccccctacgtgtcctggctgattgatgccaaccacaacatgcagatctggaccaccggggagtacagcttcaagatcttccctgagaagaacatccggggcttcaagctgcctgacaccccccagggcctgctgggggaggccaggatgctgaatgccagcatcgtggccagctttgtggagctgcccctggccagcatcgtgtccctgcacgccagcagctgtggcggccgcctgcagaccagccctgcccccatccagaccaccccacccaaggacacctgcagccctgagctgctgatgagcctcatccagaccaagtgtgctgatgatgccatgaccctggtgctgaagaaggagctggtggcccacctgaagtgcaccatcaccggcctgaccttctgggaccccagctgtgaggctgaagatagaggagacaagtttgtgctgcggagcgcctacagcagctgtggcatgcaggtgtctgcctccatgatcagcaatgaagctgtggtgaacatcctgagcagcagcagcccccagaggaagaaggtgcactgcctgaacatggacagcctgtccttccagctgggcctgtacctgagcccccacttcctgcaggccagcaacaccatcgagcccggccagcagagctttgtgcaggtgcgggtgagccccagcgtgtctgagttcctgctgcagctggacagctgccacctggacctgggccctgagggcggcaccgtggagctgatccagggccgggccgccaagggcaactgtgtgtccctgctgagccccagccctgagggggacccccgcttctccttcctgctgcacttctacacagtgcccatccccaagacaggcaccctgagctgcaccgtggccctgcggcccaagacaggcagccaggaccaggaggtgcacaggacagtgttcatgaggctgaacatcatcagcccagacctgagcggctgcaccagcaagggcctggtgctgcctgctgtgctgggcatcacctttggagccttcctgattggagccctgctgacagctgccctgtggtacatctacagccacacccgggagtaccccaggcctccccagtag

SEQ ID NO: 19464 - DNA, 1977 bp, Artificial Sequence
  Description of Artificial Sequence: Synthetic coding sequence
atggaccggggcaccctgcccctggccgtggccctgctgctggccagctgcagcctgagccccaccagcctggccgagaccgtgcactgtgacctgcagcctgtgggccctgagcggggggaggtgacctacaccaccagccaggtgtccaagggctgtgtggcccaggccccaaatgccatcctggaggtgcacgtgctcttcctggagttccccaccggccccagccagctggagctgaccctgcaggccagcaagcagaatggcacctggccccgggaggtgctgctggtgctgtctgtgaacagcagcgtcttcctgcacctgcaggccctgggcatccccctgcacctggcctacaacagcagcctggtgaccttccaggagcccccaggagtgaacaccacagagctgcccagcttccccaagacccagatcctggagtgggccgctgagcggggccccatcaccagcgctgctgagctgaatgacccccagagcatcctgctgcggctgggccaggcccagggcagcctgtccttctgcatgctggaggccagccaggacatgggccgcaccctggagtggaggcccaggaccccagccctggtgcggggctgccacctggagggcgtggccggccacaaggaggcccacatcctgcgggtgctgcccggccacagcgctggccccaggacagtgacagtgaaggtggagctgagctgtgcccctggggacctggatgctgtgctgatcctgcagggccccccctacgtgtcctggctgattgatgccaaccacaacatgcagatctggaccaccggggagtacagcttcaagatcttccctgagaagaacatccggggcttcaagctgcctgacaccccccagggcctgctgggggaggccaggatgctgaatgccagcatcgtggccagctttgtggagctgcccctggccagcatcgtgtccctgcacgccagcagctgtggcggccgcctgcagaccagccctgcccccatccagaccaccccacccaaggacacctgcagccctgagctgctgatgagcctcatccagaccaagtgtgctgatgatgccatgaccctggtgctgaagaaggagctggtggcccacctgaagtgcaccatcaccggcctgaccttctgggaccccagctgtgaggctgaagatagaggagacaagtttgtgctgcggagcgcctacagcagctgtggcatgcaggtgtctgcctccatgatcagcaatgaagctgtggtgaacatcctgagcagcagcagcccccagaggaagaaggtgcactgcctgaacatggacagcctgtccttccagctgggcctgtacctgagcccccacttcctgcaggccagcaacaccatcgagcccggccagcagagctttgtgcaggtgcgggtgagccccagcgtgtctgagttcctgctgcagctggacagctgccacctggacctgggccctgagggcggcaccgtggagctgatccagggccgggccgccaagggcaactgtgtgtccctgctgagccccagccctgagggggacccccgcttctccttcctgctgcacttctacacagtgcccatccccaagacaggcaccctgagctgcaccgtggccctgcggcccaagacaggcagccaggaccaggaggtgcacaggacagtgttcatgaggctgaacatcatcagcccagacctgagcggctgcaccagcaagggcctggtgctgcctgctgtgctgggcatcacctttggagccttcctgattggagccctgctgacagctgccctgtggtacatctacagccacaccaggagccccagcaagcgggagcctgtggtggccgtggccgccccagccagcagcgagagcagcagcaccaaccacagcatcggcagcacccagagcaccccctgcagcaccagctccatggcctag

SEQ ID NO: 19465 - DNA, 1977 bp, Artificial Sequence; identical to SEQ ID NO: 19464
  Description of Artificial Sequence: Synthetic coding sequence

SEQ ID NO: 19466 - DNA, 1431 bp, Artificial Sequence
  Description of Artificial Sequence: Synthetic coding sequence
atgctggaggccagccaggacatgggccgcaccctggagtggaggcccaggaccccagccctggtgcggggctgccacctggagggcgtggccggccacaaggaggcccacatcctgcgggtgctgcccggccacagcgctggccccaggacagtgacagtgaaggtggagctgagctgtgcccctggggacctggatgctgtgctgatcctgcagggccccccctacgtgtcctggctgattgatgccaaccacaacatgcagatctggaccaccggggagtacagcttcaagatcttccctgagaagaacatccggggcttcaagctgcctgacaccccccagggcctgctgggggaggccaggatgctgaatgccagcatcgtggccagctttgtggagctgcccctggccagcatcgtgtccctgcacgccagcagctgtggcggccgcctgcagaccagccctgcccccatccagaccaccccacccaaggacacctgcagccctgagctgctgatgagcctcatccagaccaagtgtgctgatgatgccatgaccctggtgctgaagaaggagctggtggcccacctgaagtgcaccatcaccggcctgaccttctgggaccccagctgtgaggctgaagatagaggagacaagtttgtgctgcggagcgcctacagcagctgtggcatgcaggtgtctgcctccatgatcagcaatgaagctgtggtgaacatcctgagcagcagcagcccccagaggaagaaggtgcactgcctgaacatggacagcctgtccttccagctgggcctgtacctgagcccccacttcctgcaggccagcaacaccatcgagcccggccagcagagctttgtgcaggtgcgggtgagccccagcgtgtctgagttcctgctgcagctggacagctgccacctggacctgggccctgagggcggcaccgtggagctgatccagggccgggccgccaagggcaactgtgtgtccctgctgagccccagccctgagggggacccccgcttctccttcctgctgcacttctacacagtgcccatccccaagacaggcaccctgagctgcaccgtggccctgcggcccaagacaggcagccaggaccaggaggtgcacaggacagtgttcatgaggctgaacatcatcagcccagacctgagcggctgcaccagcaagggcctggtgctgcctgctgtgctgggcatcacctttggagccttcctgattggagccctgctgacagctgccctgtggtacatctacagccacaccaggagccccagcaagcgggagcctgtggtggccgtggccgccccagccagcagcgagagcagcagcaccaaccacagcatcggcagcacccagagcaccccctgcagcaccagctccatggcctag

SEQ ID NO: 19467 - DNA, 639 bp, Artificial Sequence
  Description of Artificial Sequence: Synthetic coding sequence
atggactacctgctgatgatcttcagcctgctgtttgtggcctgccagggcgcccctgagacagctgtgctgggcgctgagctgtctgctgtgggagaaaatggaggagagaagcccacccccagccccccctggaggctgcggcgcagcaagcgctgcagctgcagcagcctgatggacaaggaatgtgtgtacttctgccacctggacatcatctgggtgaacaccccagagcacgtggtgccctacggcctgggcagccccaggagcaagagggccctggagaacctgctgcccaccaaggccacagaccgggagaaccgctgccagtgtgccagccagaaggacaagaagtgctggaacttctgccaggccggcaaggagctgcgggcagaggacatcatggagaaggactggaacaaccacaagaagggcaaggactgcagcaagctgggcaagaagtgcatctaccagcagctggtgcggggcaggaagatcagaagaagcagcgaggagcacctgcggcagaccaggtctgagaccatgagaaattctgtgaagagcagcttccatgaccccaagctgaagggcaagcccagccgggagcgctacgtgacccacaacagagcccactggtag

SEQ ID NO: 19468 - DNA, 1329 bp, Artificial Sequence
  Description of Artificial Sequence: Synthetic coding sequence
atgcagcccccacccagcctgtgtggccgggccctggtggccctggtgctggcctgtggcctgagccgcatctggggcgaggagcggggcttccccccagaccgggccacccccctgctgcagacagctgagatcatgaccccacccaccaagaccctgtggcccaagggcagcaatgccagcctggcccggagcctggccccagctgaggtgcccaagggggacagaacagctggcagcccccccaggaccatcagccccccaccctgccagggccccatcgagatcaaggagaccttcaagtacatcaacacagtggtgtcctgcctggtgtttgtgctgggcatcatcggcaacagcaccctgctgcgcatcatctacaagaacaagtgcatgagaaatggccccaacatcctgattgccagcctggccctgggggacctgctgcacatcgtgattgacatccccatcaacgtgtacaagctgctggccgaggactggccctttggagctgagatgtgcaagctggtgcccttcatccagaaggcctctgtgggcatcaccgtgctgagcctgtgtgccctgagcattgaccgctacagagctgtggcctcctggagccgcatcaagggcatcggcgtgcccaagtggacagctgtggagatcgtgctgatctgggtggtgtctgtggtgctggccgtgcctgaggccatcggctttgacatcatcaccatggactacaagggcagctacctgcgcatctgcctgctgcaccctgtgcagaagacagccttcatgcagttctacaagacagccaaggactggtggctgttctccttctacttctgcctgcccctggccatcacagccttcttctacaccctgatgacctgtgagatgctgaggaagaagagcggcatgcagatcgccctgaatgaccacctgaagcagaggcgggaggtggccaagacagtgttctgcctggtgctggtgtttgccctgtgctggctgcccctgcacctgagccgcatcctgaagctgaccctgtacaaccagaatgaccccaacagatgtgagctgctgtccttcctgctggtgctggactacatcggcatcaacatggccagcctgaacagctgcatcaaccccatcgccctgtacctggtgtccaagcgcttcaagaactgcttcaagagctgcctgtgctgctggtgccagagctttgaggagaagcagagcctggaggagaagcagagctgcctgaagttcaaggccaatgaccacggctatgacaacttccgcagcagcaacaagtacagcagcagctag

SEQ ID NO: 19469 - DNA, 1599 bp, Artificial Sequence
  Description of Artificial Sequence: Synthetic coding sequence
atgaacaagagcacctgcctgatggctgctgagacccccagcaagcgctggaggctgcactgcctggccttcagccagagatttgtgcgggccggccctgcctgcagcagccgggaggcctgcagcagcccccgggccggctggaacccagctggcttccggctgcccggccgctggagcccctttgtggccctgcacctggtgtgccagatccgggaggccctgaagctgcggagcggccacaggaccccatctggagctggcagctccatgcagcccccacccagcctgtgtggccgggccctggtggccctggtgctggcctgtggcctgagccgcatctggggcgaggagcggggcttccccccagaccgggccacccccctgctgcagacagctgagatcatgaccccacccaccaagaccctgtggcccaagggcagcaatgccagcctggcccggagcctggccccagctgaggtgcccaagggggacagaacagctggcagcccccccaggaccatcagccccccaccctgccagggccccatcgagatcaaggagaccttcaagtacatcaacacagtggtgtcctgcctggtgtttgtgctgggcatcatcggcaacagcaccctgctgcgcatcatctacaagaacaagtgcatgagaaatggccccaacatcctgattgccagcctggccctgggggacctgctgcacatcgtgattgacatccccatcaacgtgtacaagctgctggccgaggactggccctttggagctgagatgtgcaagctggtgcccttcatccagaaggcctctgtgggcatcaccgtgctgagcctgtgtgccctgagcattgaccgctacagagctgtggcctcctggagccgcatcaagggcatcggcgtgcccaagtggacagctgtggagatcgtgctgatctgggtggtgtctgtggtgctggccgtgcctgaggccatcggctttgacatcatcaccatggactacaagggcagctacctgcgcatctgcctgctgcaccctgtgcagaagacagccttcatgcagttctacaagacagccaaggactggtggctgttctccttctacttctgcctgcccctggccatcacagccttcttctacaccctgatgacctgtgagatgctgaggaagaagagcggcatgcagatcgccctgaatgaccacctgaagcagaggcgggaggtggccaagacagtgttctgcctggtgctggtgtttgccctgtgctggctgcccctgcacctgagccgcatcctgaagctgaccctgtacaaccagaatgaccccaacagatgtgagctgctgtccttcctgctggtgctggactacatcggcatcaacatggccagcctgaacagctgcatcaaccccatcgccctgtacctggtgtccaagcgcttcaagaactgcttcaagagctgcctgtgctgctggtgccagagctttgaggagaagcagagcctggaggagaagcagagctgcctgaagttcaaggccaatgaccacggctatgacaacttccgcagcagcaacaagtacagcagcagctag

SEQ ID NO: 19470 - DNA, 1311 bp, Artificial Sequence
  Description of Artificial Sequence: Synthetic coding sequence
atgcagcccccacccagcctgtgtggccgggccctggtggccctggtgctggcctgtggcctgagccgcatctggggcgaggagcggggcttccccccagaccgggccacccccctgctgcagacagctgagatcatgaccccacccaccaagaccctgtggcccaagggcagcaatgccagcctggcccggagcctggccccagctgaggtgcccaagggggacagaacagctggcagcccccccaggaccatcagccccccaccctgccagggccccatcgagatcaaggagaccttcaagtacatcaacacagtggtgtcctgcctggtgtttgtgctgggcatcatcggcaacagcaccctgctgcgcatcatctacaagaacaagtgcatgagaaatggccccaacatcctgattgccagcctggccctgggggacctgctgcacatcgtgattgacatccccatcaacgtgtacaagctgctggccgaggactggccctttggagctgagatgtgcaagctggtgcccttcatccagaaggcctctgtgggcatcaccgtgctgagcctgtgtgccctgagcattgaccgctacagagctgtggcctcctggagccgcatcaagggcatcggcgtgcccaagtggacagctgtggagatcgtgctgatctgggtggtgtctgtggtgctggccgtgcctgaggccatcggctttgacatcatcaccatggactacaagggcagctacctgcgcatctgcctgctgcaccctgtgcagaagacagccttcatgcagttctacaagacagccaaggactggtggctgttctccttctacttctgcctgcccctggccatcacagccttcttctacaccctgatgacctgtgagatgctgaggaagaagagcggcatgcagatcgccctgaatgaccacctgaagcagaggcgggaggtggccaagacagtgttctgcctggtgctggtgtttgccctgtgctggctgcccctgcacctgagccgcatcctgaagctgaccctgtacaaccagaatgaccccaacagatgtgagctgctgtccttcctgctggtgctggactacatcggcatcaacatggccagcctgaacagctgcatcaaccccatcgccctgtacctggtgtccaagcgcttcaagaactgcttcaaggccggcccccacgtgggcaacaagctggtgatgctgttctctgtgaacattgaatgtgatggcaccgtgaaccagaaccccaccatgtggccagagaggaagagcaacaacaactag

SEQ ID NO: 19471 - DNA, 2787 bp, Artificial Sequence
  Description of Artificial Sequence: Synthetic coding sequence
atggccctgcggcggctgggcgccgccctgctgctgctgcccctgctggccgctgtggaggagaccctgatggacagcaccacagccacagctgagctgggctggatggtgcaccccccatctggctgggaggaggtgtctggctatgatgagaacatgaacaccatccgcacctaccaggtgtgcaatgtgtttgagagcagccagaacaactggctgcggaccaagttcatcagaagaagaggagcccaccgcatccacgtggagatgaagttctctgtgcgggactgcagcagcatccccagcgtgcccggcagctgcaaggagaccttcaacctgtactactatgaggccgactttgacagcgccaccaagaccttccccaactggatggagaacccctgggtgaaggtggacaccatcgctgctgatgagagcttcagccaggtggacctgggcggccgggtgatgaagatcaacacagaggtgcgcagctttggacctgtgagccgcagcggcttctacctggccttccaggactatggaggctgcatgagcctgattgctgtgcgggtcttctacaggaagtgcccccgcatcatccagaatggagccatcttccaggagaccctgagcggggctgagagcaccagcctggtggccgcccggggcagctgcatcgccaatgctgaggaggtggatgtgcccatcaagctgtactgcaatggagatggagagtggctggtgcccatcggccgctgcatgtgcaaggccggctttgaggccgtggagaatggaacagtgtgccggggctgccccagcggcaccttcaaggccaaccagggagatgaggcctgcacccactgccccatcaacagcaggaccaccagcgagggcgccaccaactgtgtgtgcagaaatggctactacagagctgacctggaccccctggacatgccctgcaccaccatccccagcgccccccaggccgtcatcagctctgtgaatgagaccagcctgatgctggagtggaccccaccccgggacagcggcggccgggaggacctggtgtacaacatcatctgcaagagctgtggcagcggccgcggggcctgcacccgctgtggggacaacgtgcagtatgccccccggcagctgggcctgacagagccccgcatctacatcagtgacctgctggcccacacccagtacacctttgagatccaggccgtgaatggagtgacagaccagagccccttcagcccccagtttgcctctgtgaacatcaccaccaaccaggccgcccccagcgctgtgtccatcatgcaccaggtgtccaggacagtggacagcatcaccctgtcctggagccagcctgaccagcccaatggagtcatcctggactatgagctgcagtactatgagaaggagctgtctgagtacaatgccacagccatcaagagccccaccaacacagtgacagtgcagggcctgaaggccggggccatctacgtgttccaggtgcgggccaggacagtggccggctacggccgctacagcggcaagatgtacttccagaccatgacagaggtgaccccaggcatgaagatctacatcgaccccttcacctatgaggaccccaatgaggccgtgcgggagtttgccaaggagattgacatcagctgtgtgaagattgagcaggtgattggagctggggagtttggagaggtgtgcagcggccacctgaagctgcccgggaagcgggagatctttgtggccatcaagaccctgaagagcggctacacagagaagcagaggcgggacttcctgtctgaggccagcatcatgggccagtttgaccaccccaacgtcatccacctggagggcgtggtgaccaagagcacccctgtgatgatcatcacagagttcatggagaatggcagcctggacagcttcctgcggcagaatgatggccagttcaccgtcatccagctggtgggcatgctgcggggcattgctgctggcatgaagtacctggccgacatgaactacgtgcaccgggacctggccgccaggaacatcctggtgaacagcaacctggtgtgcaaggtgtctgactttggcctgagccgcttcctggaggatgacaccagtgaccccacctacaccagcgccctgggcggcaagatccccatccgctggacagcccctgaggccatccagtacaggaagttcaccagcgccagtgatgtgtggagctatggcatcgtgatgtgggaggtgatgtcctatggagagcggccctactgggacatgaccaaccaggacgtcatcaatgccatcgagcaggactaccgcctgcccccacccatggactgccccagcgccctgcaccagctgatgctggactgctggcagaaggacaggaaccaccggcccaagtttggccagatcgtgaacaccctggacaagatgatccggaaccccaacagcctgaaggccatggcccccctgagcagcggcatcaacctgcccctgctggacaggaccatcccagactacaccagcttcaacacagtggatgagtggctggaggccatcaagatgggccagtacaaggagagctttgccaatgccggcttcaccagctttgatgtggtgtcccagatgatgatggaggacatcctgcgggtgggcgtgaccctggccggccaccagaagaagatcctgaacagcatccaggtgatgagggcccagatgaaccagatccagagcgtggaggtgtag

SEQ ID NO: 19472 - DNA, 2841 bp, Artificial Sequence
  Description of Artificial Sequence: Synthetic coding sequence
atgtgggtgcctgtgctggccctgcctgtgtgcacctacgccgagaccctgatggacagcaccacagccacagctgagctgggctggatggtgcaccccccatctggctgggaggaggtgtctggctatgatgagaacatgaacaccatccgcacctaccaggtgtgcaatgtgtttgagagcagccagaacaactggctgcggaccaagttcatcagaagaagaggagcccaccgcatccacgtggagatgaagttctctgtgcgggactgcagcagcatccccagcgtgcccggcagctgcaaggagaccttcaacctgtactactatgaggccgactttgacagcgccaccaagaccttccccaactggatggagaacccctgggtgaaggtggacaccatcgctgctgatgagagcttcagccaggtggacctgggcggccgggtgatgaagatcaacacagaggtgcgcagctttggacctgtgagccgcagcggcttctacctggccttccaggactatggaggctgcatgagcctgattgctgtgcgggtcttctacaggaagtgcccccgcatcatccagaatggagccatcttccaggagaccctgagcggggctgagagcaccagcctggtggccgcccggggcagctgcatcgccaatgctgaggaggtggatgtgcccatcaagctgtactgcaatggagatggagagtggctggtgcccatcggccgctgcatgtgcaaggccggctttgaggccgtggagaatggaacagtgtgccggggctgccccagcggcaccttcaaggccaaccagggagatgaggcctgcacccactgccccatcaacagcaggaccaccagcgagggcgccaccaactgtgtgtgcagaaatggctactacagagctgacctggaccccctggacatgccctgcaccaccatccccagcgccccccaggccgtcatcagctctgtgaatgagaccagcctgatgctggagtggaccccaccccgggacagcggcggccgggaggacctggtgtacaacatcatctgcaagagctgtggcagcggccgcggggcctgcacccgctgtggggacaacgtgcagtatgccccccggcagctgggcctgacagagccccgcatctacatcagtgacctgctggcccacacccagtacacctttgagatccaggccgtgaatggagtgacagaccagagccccttcagcccccagtttgcctctgtgaacatcaccaccaaccaggccgcccccagcgctgtgtccatcatgcaccaggtgtccaggacagtggacagcatcaccctgtcctggagccagcctgaccagcccaatggagtcatcctggactatgagctgcagtactatgagaagcaggagctgtctgagtacaatgccacagccatcaagagccccaccaacacagtgacagtgcagggcctgaaggccggggccatctacgtgttccaggtgcgggccaggacagtggccggctacggccgctacagcggcaagatgtacttccagaccatgacagaggccgagtaccagaccagcatccaggagaagctgcccctcatcatcggcagcagcgctgctggcctggtgttcctgattgctgtggtggtgattgccatcgtgtgcaacagaagaggatttgaaagagctgacagcgagtacacagacaagctgcagcactacaccagcggccacatgaccccaggcatgaagatctacatcgaccccttcacctatgaggaccccaatgaagctgtgcgggagtttgccaaggagattgacatcagctgtgtgaagattgagcaggtgattggagctggggagtttggagaggtgtgcagcggccacctgaagctgcccgggaagcgggagatctttgtggccatcaagaccctgaagagcggctacacagagaagcagaggcgggacttcctgtctgaggccagcatcatgggccagtttgaccaccccaacgtcatccacctggagggcgtggtgaccaagagcacccctgtgatgatcatcacagagttcatggagaatggcagcctggacagcttcctgcggcagaatgatggccagttcaccgtcatccagctggtgggcatgctgcggggcattgctgctggcatgaagtacctggccgacatgaactacgtgcaccgggacctggccgccaggaacatcctggtgaacagcaacctggtgtgcaaggtgtctgactttggcctgagccgcttcctggaggatgacaccagtgaccccacctacaccagcgccctgggcggcaagatccccatccgctggacagcccctgaggccatccagtacaggaagttcaccagcgccagtgatgtgtggagctatggaattgtgatgtgggaggtgatgtcctatggagagcggccctactgggacatgaccaaccaggatgtgatcaatgccatcgagcaggactaccgcctgcccccacccatggactgccccagcgccctgcaccagctgatgctggactgctggcagaaggacaggaaccaccggcccaagtttggccagatcgtgaacaccctggacaagatgatccggaaccccaacagcctgaaggccatggcccccctgagcagcggcatcaacctgcccctgctggacaggaccatcccagactacaccagcttcaacacagtggatgagtggctggaggccatcaagatgggccagtacaaggagagctttgccaatgccggcttcaccagctttgatgtggtgtcccagatgatgatggagtag

SEQ ID NO: 19473 - DNA, 2961 bp, Artificial Sequence
  Description of Artificial Sequence: Synthetic coding sequence
atggccctgcggcggctgggcgccgccctgctgctgctgcccctgctggccgctgtggaggagaccctgatggacagcaccacagccacagctgagctgggctggatggtgcaccccccatctggctgggaggaggtgtctggctatgatgagaacatgaacaccatccgcacctaccaggtgtgcaatgtgtttgagagcagccagaacaactggctgcggaccaagttcatcagaagaagaggagcccaccgcatccacgtggagatgaagttctctgtgcgggactgcagcagcatccccagcgtgcccggcagctgcaaggagaccttcaacctgtactactatgaggccgactttgacagcgccaccaagaccttccccaactggatggagaacccctgggtgaaggtggacaccatcgctgctgatgagagcttcagccaggtggacctgggcggccgggtgatgaagatcaacacagaggtgcgcagctttggacctgtgagccgcagcggcttctacctggccttccaggactatggaggctgcatgagcctgattgctgtgcgggtcttctacaggaagtgcccccgcatcatccagaatggagccatcttccaggagaccctgagcggggctgagagcaccagcctggtggccgcccggggcagctgcatcgccaatgctgaggaggtggatgtgcccatcaagctgtactgcaatggagatggagagtggctggtgcccatcggccgctgcatgtgcaaggccggctttgaggccgtggagaatggaacagtgtgccggggctgccccagcggcaccttcaaggccaaccagggagatgaggcctgcacccactgccccatcaacagcaggaccaccagcgagggcgccaccaactgtgtgtgcagaaatggctactacagagctgacctggaccccctggacatgccctgcaccaccatccccagcgccccccaggccgtcatcagctctgtgaatgagaccagcctgatgctggagtggaccccaccccgggacagcggcggccgggaggacctggtgtacaacatcatctgcaagagctgtggcagcggccgcggggcctgcacccgctgtggggacaacgtgcagtatgccccccggcagctgggcctgacagagccccgcatctacatcagtgacctgctggcccacacccagtacacctttgagatccaggccgtgaatggagtgacagaccagagccccttcagcccccagtttgcctctgtgaacatcaccaccaaccaggccgcccccagcgctgtgtccatcatgcaccaggtgtccaggacagtggacagcatcaccctgtcctggagccagcctgaccagcccaatggagtcatcctggactatgagctgcagtactatgagaaggagctgtctgagtacaatgccacagccatcaagagccccaccaacacagtgacagtgcagggcctgaaggccggggccatctacgtgttccaggtgcgggccaggacagtggccggctacggccgctacagcggcaagatgtacttccagaccatgacagaagctgagtaccagaccagcatccaggagaagctgcccctcatcatcggcagcagcgctgctggcctggtgttcctgattgctgtggtggtgattgccatcgtgtgcaacagaagaggatttgaaagagctgacagcgagtacacagacaagctgcagcactacaccagcggccacatgaccccaggcatgaagatctacatcgaccccttcacctatgaggaccccaatgaggccgtgcgggagtttgccaaggagattgacatcagctgtgtgaagattgagcaggtgattggagctggggagtttggagaggtgtgcagcggccacctgaagctgcccgggaagcgggagatctttgtggccatcaagaccctgaagagcggctacacagagaagcagaggcgggacttcctgtctgaggccagcatcatgggccagtttgaccaccccaacgtcatccacctggagggcgtggtgaccaagagcacccctgtgatgatcatcacagagttcatggagaatggcagcctggacagcttcctgcggcagaatgatggccagttcaccgtcatccagctggtgggcatgctgcggggcattgctgctggcatgaagtacctggccgacatgaactacgtgcaccgggacctggccgccaggaacatcctggtgaacagcaacctggtgtgcaaggtgtctgactttggcctgagccgcttcctggaggatgacaccagtgaccccacctacaccagcgccctgggcggcaagatccccatccgctggacagcccctgaggccatccagtacaggaagttcaccagcgccagtgatgtgtggagctatggcatcgtgatgtgggaggtgatgtcctatggagagcggccctactgggacatgaccaaccaggacgtcatcaatgccatcgagcaggactaccgcctgcccccacccatggactgccccagcgccctgcaccagctgatgctggactgctggcagaaggacaggaaccaccggcccaagtttggccagatcgtgaacaccctggacaagatgatccggaaccccaacagcctgaaggccatggcccccctgagcagcggcatcaacctgcccctgctggacaggaccatcccagactacaccagcttcaacacagtggatgagtggctggaggccatcaagatgggccagtacaaggagagctttgccaatgccggcttcaccagctttgatgtggtgtcccagatgatgatggaggacatcctgcgggtgggcgtgaccctggccggccaccagaagaagatcctgaacagcatccaggtgatgagggcccagatgaaccagatccagagcgtggaggtgtag

SEQ ID NO: 19474 - DNA, 2964 bp, Artificial Sequence
  Description of Artificial Sequence: Synthetic coding sequence
atggccctgcggcggctgggcgccgccctgctgctgctgcccctgctggccgctgtggaggagaccctgatggacagcaccacagccacagctgagctgggctggatggtgcaccccccatctggctgggaggaggtgtctggctatgatgagaacatgaacaccatccgcacctaccaggtgtgcaatgtgtttgagagcagccagaacaactggctgcggaccaagttcatcagaagaagaggagcccaccgcatccacgtggagatgaagttctctgtgcgggactgcagcagcatccccagcgtgcccggcagctgcaaggagaccttcaacctgtactactatgaggccgactttgacagcgccaccaagaccttccccaactggatggagaacccctgggtgaaggtggacaccatcgctgctgatgagagcttcagccaggtggacctgggcggccgggtgatgaagatcaacacagaggtgcgcagctttggacctgtgagccgcagcggcttctacctggccttccaggactatggaggctgcatgagcctgattgctgtgcgggtcttctacaggaagtgcccccgcatcatccagaatggagccatcttccaggagaccctgagcggggctgagagcaccagcctggtggccgcccggggcagctgcatcgccaatgctgaggaggtggatgtgcccatcaagctgtactgcaatggagatggagagtggctggtgcccatcggccgctgcatgtgcaaggccggctttgaggccgtggagaatggaacagtgtgccggggctgccccagcggcaccttcaaggccaaccagggagatgaggcctgcacccactgccccatcaacagcaggaccaccagcgagggcgccaccaactgtgtgtgcagaaatggctactacagagctgacctggaccccctggacatgccctgcaccaccatccccagcgccccccaggccgtcatcagctctgtgaatgagaccagcctgatgctggagtggaccccaccccgggacagcggcggccgggaggacctggtgtacaacatcatctgcaagagctgtggcagcggccgcggggcctgcacccgctgtggggacaacgtgcagtatgccccccggcagctgggcctgacagagccccgcatctacatcagtgacctgctggcccacacccagtacacctttgagatccaggccgtgaatggagtgacagaccagagccccttcagcccccagtttgcctctgtgaacatcaccaccaaccaggccgcccccagcgctgtgtccatcatgcaccaggtgtccaggacagtggacagcatcaccctgtcctggagccagcctgaccagcccaatggagtcatcctggactatgagctgcagtactatgagaaggagctgtctgagtacaatgccacagccatcaagagccccaccaacacagtgacagtgcagggcctgaaggccggggccatctacgtgttccaggtgcgggccaggacagtggccggctacggccgctacagcggcaagatgtacttccagaccatgacagaagctgagtaccagaccagcatccaggagaagctgcccctcatcatcggcagcagcgctgctggcctggtgttcctgattgctgtggtggtgattgccatcgtgtgcaacagaagaagaggatttgaaagagctgacagcgagtacacagacaagctgcagcactacaccagcggccacatgaccccaggcatgaagatctacatcgaccccttcacctatgaggaccccaatgaagctgtgcgggagtttgccaaggagattgacatcagctgtgtgaagattgagcaggtgattggagctggggagtttggagaggtgtgcagcggccacctgaagctgcccgggaagcgggagatctttgtggccatcaagaccctgaagagcggctacacagagaagcagaggcgggacttcctgtctgaggccagcatcatgggccagtttgaccaccccaacgtcatccacctggagggcgtggtgaccaagagcacccctgtgatgatcatcacagagttcatggagaatggcagcctggacagcttcctgcggcagaatgatggccagttcaccgtcatccagctggtgggcatgctgcggggcattgctgctggcatgaagtacctggccgacatgaactacgtgcaccgggacctggccgccaggaacatcctggtgaacagcaacctggtgtgcaaggtgtctgactttggcctgagccgcttcctggaggatgacaccagtgaccccacctacaccagcgccctgggcggcaagatccccatccgctggacagcccctgaggccatccagtacaggaagttcaccagcgccagtgatgtgtggagctatggaattgtgatgtgggaggtgatgtcctatggagagcggccctactgggacatgaccaaccaggatgtgatcaatgccatcgagcaggactaccgcctgcccccacccatggactgccccagcgccctgcaccagctgatgctggactgctggcagaaggacaggaaccaccggcccaagtttggccagatcgtgaacaccctggacaagatgatccggaaccccaacagcctgaaggccatggcccccctgagcagcggcatcaacctgcccctgctggacaggaccatcccagactacaccagcttcaacacagtggatgagtggctggaggccatcaagatgggccagtacaaggagagctttgccaatgccggcttcaccagctttgatgtggtgtcccagatgatgatggaggacatcctgcgggtgggcgtgaccctggccggccaccagaagaagatcctgaacagcatccaggtgatgagggcccagatgaaccagatccagagcgtggaggtgtag

SEQ ID NO: 19475 - DNA, 3168 bp, Artificial Sequence
  Description of Artificial Sequence: Synthetic coding sequence
atggccctgcggcggctgggcgccgccctgctgctgctgcccctgctggccgctgtggaggagaccctgatggacagcaccacagccacagctgagctgggctggatggtgcaccccccatctggctgggaggaggtgtctggctatgatgagaacatgaacaccatccgcacctaccaggtgtgcaatgtgtttgagagcagccagaacaactggctgcggaccaagttcatcagaagaagaggagcccaccgcatccacgtggagatgaagttctctgtgcgggactgcagcagcatccccagcgtgcccggcagctgcaaggagaccttcaacctgtactactatgaggccgactttgacagcgccaccaagaccttccccaactggatggagaacccctgggtgaaggtggacaccatcgctgctgatgagagcttcagccaggtggacctgggcggccgggtgatgaagatcaacacagaggtgcgcagctttggacctgtgagccgcagcggcttctacctggccttccaggactatggaggctgcatgagcctgattgctgtgcgggtcttctacaggaagtgcccccgcatcatccagaatggagccatcttccaggagaccctgagcggggctgagagcaccagcctggtggccgcccggggcagctgcatcgccaatgctgaggaggtggatgtgcccatcaagctgtactgcaatggagatggagagtggctggtgcccatcggccgctgcatgtgcaaggccggctttgaggccgtggagaatggaacagtgtgccggggctgccccagcggcaccttcaaggccaaccagggagatgaggcctgcacccactgccccatcaacagcaggaccaccagcgagggcgccaccaactgtgtgtgcagaaatggctactacagagctgacctggaccccctggacatgccctgcaccaccatccccagcgccccccaggccgtcatcagctctgtgaatgagaccagcctgatgctggagtggaccccaccccgggacagcggcggccgggaggacctggtgtacaacatcatctgcaagagctgtggcagcggccgcggggcctgcacccgctgtggggacaacgtgcagtatgccccccggcagctgggcctgacagagccccgcatctacatcagtgacctgctggcccacacccagtacacctttgagatccaggccgtgaatggagtgacagaccagagccccttcagcccccagtttgcctctgtgaacatcaccaccaaccaggccgcccccagcgctgtgtccatcatgcaccaggtgtccaggacagtggacagcatcaccctgtcctggagccagcctgaccagcccaatggagtcatcctggactatgagctgcagtactatgagaaggagctgtctgagtacaatgccacagccatcaagagccccaccaacacagtgacagtgcagggcctgaaggccggggccatctacgtgttccaggtgcgggccaggacagtggccggctacggccgctacagcggcaagatgtacttccagaccatgacagaagctgagtaccagaccagcatccaggagaagctgcccctcatcatcggcagcagcgctgctggcctggtgttcctgattgctgtggtggtgattgccatcgtgtgcaacagaagaggatttgaaagagctgacagcgagtacacagacaagctgcagcactacaccagcggccacatgaccccaggcatgaagatctacatcgaccccttcacctatgaggaccccaatgaggccgtgcgggagtttgccaaggagattgacatcagctgtgtgaagattgagcaggtgattggagctggggagtttggagaggtgtgcagcggccacctgaagctgcccgggaagcgggagatctttgtggccatcaagaccctgaagagcggctacacagagaagcagaggcgggacttcctgtctgaggccagcatcatgggccagtttgaccaccccaacgtcatccacctggagggcgtggtgaccaagagcacccctgtgatgatcatcacagagttcatggagaatggcagcctggacagcttcctgcggcagaatgatggccagttcaccgtcatccagctggtgggcatgctgcggggcattgctgctggcatgaagtacctggccgacatgaactacgtgcaccgggacctggccgccaggaacatcctggtgaacagcaacctggtgtgcaaggtgtctgactttggcctgagccgcttcctggaggatgacaccagtgaccccacctacaccagcgccctgggcggcaagatccccatccgctggacagcccctgaggccatccagtacaggaagttcaccagcgccagtgatgtgtggagctatggcatcgtgatgtgggaggtgatgtcctatggagagcggccctactgggacatgaccaaccaggacgtcatcaatgccatcgagcaggactaccgcctgcccccacccatggactgccccagcgccctgcaccagctgatgctggactgctggcagaaggacaggaaccaccggcccaagtttggccagatcgtgaacaccctggacaagatgatccggaaccccaacagcctgaaggccatggcccccctgagcagcggcatcaacctgcccctgctggacaggaccatcccagactacaccagcttcaacacagtggatgagtggctggaggccatcaagatgggccagtacaaggagagctttgccaatgccggcttcaccagctttgatgtggtgtcccagatgatgatggaggacatcctgcgggtgggcgtgaccctggccggccaccagaagaagatcctgaacagcatccaggtgatgagggcccagatgaaccagatccagagcgtggagggccagcccctggcccggcggccccgggccaccggccgcaccaagcgctgccagcccagagatgtgaccaagaagacctgcaacagcaatgatggcaagaagaagggcatgggcaagaagaagacagatcctggccggggccgggagatccagggcatcttcttcaaggaggacagccacaaggagagcaatgactgcagctgtggcggctag

SEQ ID NO: 19476 - DNA, 1449 bp, Artificial Sequence
  Description of Artificial Sequence: Synthetic coding sequence
atggccctgcggcggctgggcgccgccctgctgctgctgcccctgctggccgctgtggaggagaccctgatggacagcaccacagccacagctgagctgggctggatggtgcaccccccatctggctgggaggaggtgtctggctatgatgagaacatgaacaccatccgcacctaccaggtgtgcaatgtgtttgagagcagccagaacaactggctgcggaccaagttcatcagaagaagaggagcccaccgcatccacgtggagatgaagttctctgtgcgggactgcagcagcatccccagcgtgcccggcagctgcaaggagaccttcaacctgtactactatgaggccgactttgacagcgccaccaagaccttccccaactggatggagaacccctgggtgaaggtggacaccatcgctgctgatgagagcttcagccaggtggacctgggcggccgggtgatgaagatcaacacagaggtgcgcagctttggacctgtgagccgcagcggcttctacctggccttccaggactatggaggctgcatgagcctgattgctgtgcgggtcttctacaggaagtgcccccgcatcatccagaatggagccatcttccaggagaccctgagcggggctgagagcaccagcctggtggccgcccggggcagctgcatcgccaatgctgaggaggtggatgtgcccatcaagctgtactgcaatggagatggagagtggctggtgcccatcggccgctgcatgtgcaaggccggctttgaggccgtggagaatggaacagtgtgccggggctgccccagcggcaccttcaaggccaaccagggagatgaggcctgcacccactgccccatcaacagcaggaccaccagcgagggcgccaccaactgtgtgtgcagaaatggctactacagagctgacctggaccccctggacatgccctgcaccaccatccccagcgccccccaggccgtcatcagctctgtgaatgagaccagcctgatgctggagtggaccccaccccgggacagcggcggccgggaggacctggtgtacaacatcatctgcaagagctgtggcagcggccgcggggcctgcacccgctgtggggacaacgtgcagtatgccccccggcagctgggcctgacagagccccgcatctacatcagtgacctgctggcccacacccagtacacctttgagatccaggccgtgaatggagtgacagaccagagccccttcagcccccagtttgcctctgtgaacatcaccaccaaccaggccgcccccagcgctgtgtccatcatgcaccaggtgtccaggacagtggacagcatcaccctgtcctggagccagcctgaccagcccaatggagtcatcctggactatgagctgcagtactatgagaagatgaagacccagaggagctag

SEQ ID NO: 19477 - DNA, 2964 bp, Artificial Sequence
  Description of Artificial Sequence: Synthetic coding sequence
atggagctgcgggtgctgctgtgctgggccagcctggccgccgccctggaggagaccctgctgaacaccaagctggagacagctgacctgaagtgggtgaccttcccccaggtggatggccagtgggaggagctgagcggcctggatgaggagcagcacagcgtgaggacctatgaggtgtgtgatgtgcagagggcccctggccaggcccactggctgaggacaggctgggtgcccaggagaggagctgtgcacgtgtatgccaccctgcgcttcaccatgctggagtgcctgagcctgcccagggctggccgcagctgcaaggagaccttcaccgtcttctactatgaaagtgatgctgacacagccacagccctgaccccagcctggatggagaacccctacatcaaggtggacacagtggccgctgagcacctgaccaggaagaggcctggagctgaggccaccgggaaggtgaatgtgaagaccctgcggctgggccccctgagcaaggccggcttctacctggccttccaggaccagggcgcctgcatggccctgctgagcctgcacctgttctacaagaagtgtgcccagctgactgtgaacctgacccgcttccctgagaccgtgccccgggagctggtggtgcctgtggccggcagctgtgtggtggatgctgtgcctgcccctggccccagccccagcctgtactgcagagaagatggccagtgggccgagcagcctgtgacaggctgcagctgtgcccctggctttgaagctgctgagggcaacaccaagtgccgggcctgtgcccagggcaccttcaagcccctgagcggggagggcagctgccagccctgcccagccaacagccacagcaacaccatcggcagcgctgtgtgccagtgccgggtgggctacttccgggccaggacagaccccaggggggccccctgcaccaccccaccttctgcccccaggtctgtggtgtcccggctgaatggcagcagcctgcacctggagtggagcgcccccctggagagcggcggccgggaggacctgacctacgccctgcgctgcagagaatgtagacctgggggcagctgtgccccctgtggcggggacctgacctttgatcctggcccccgggacctggtggagccctgggtggtggtgcggggcctgcggccagacttcacctacacctttgaggtgacagccctgaatggagtgagcagcctggccactggacctgtgccctttgagcctgtgaatgtgaccacagaccgggaggtgcccccagctgtgtctgacatccgggtgaccaggagcagccccagcagcctgagcctggcctgggccgtgccccgggcccccagcggggctgtgctggactatgaggtgaagtaccacgagaagggagctgagggccccagctctgtgcgcttcctgaagaccagtgaaaatagagctgagctgcggggcctgaagagaggagccagctacctggtgcaggtgcgggcccggtctgaggccggctacggccccttcggccaggagcaccacagccagacccagctggatgaaagtgagggctggagggagcagctggccctgattgctggaacagctgtggtgggcgtggtgctggtgctggtggtgattgtggtggccgtgctgtgcctgaggaagcagagcaatggccgggaggccgagtacagcgacaagcacggccagtacctgattggacatggcaccaaggtgtacatcgaccccttcacctatgaggaccccaatgaggccgtgcgggagtttgccaaggagattgatgtgtcctatgtgaagattgaggaggtgattggagctggggagtttggagaggtgtgccggggccgcctgaaggcccctgggaagaaggagagctgtgtggccatcaagaccctgaagggcggctacacagagcggcagaggcgggagttcctgtctgaggccagcatcatgggccagtttgagcaccccaacatcatccggctggagggcgtggtgaccaacagcatgcctgtgatgatcctgacagagttcatggagaatggagccctggacagcttcctgcggctgaatgatggccagttcaccgtcatccagctggtgggcatgctgcggggcatcgccagcggcatgagatacctggccgagatgtcctatgtgcaccgggacctggccgccaggaacatcctggtgaacagcaacctggtgtgcaaggtgtctgactttggcctgagccgcttcctggaggagaacagcagtgaccccacctacaccagcagcctgggcggcaagatccccatccgctggacagcccctgaggccatcgccttcaggaagttcaccagcgccagtgatgcctggagctatggcatcgtgatgtgggaggtgatgagctttggagagcggccctactgggacatgagcaaccaggacgtcatcaatgccatcgagcaggactaccgcctgcccccacctccagactgccccaccagcctgcaccagctgatgctggactgctggcagaaggacagaaatgcccggccccgcttcccccaggtggtgtctgccctggacaagatgatcagaaatcctgccagcctgaagatcgtggcccgggagaatggaggagccagccaccccctgctggaccagaggcagccccactacagcgcctttggatctgtgggggagtggctgcgggccatcaagatgggccgctatgaggagagctttgctgctgctggcttcggcagctttgagctggtgtcccagatctctgctgaggacctgctgcgcatcggcgtgaccctggccggccaccagaagaagatcctggcctctgtgcagcacatgaagagccaggccaagccaggcaccccaggcggcaccggcggccctgccccccagtactag

SEQ ID NO: 19478 - DNA, 2808 bp, Artificial Sequence
  Description of Artificial Sequence: Synthetic coding sequence
atggagctgcgggtgctgctgtgctgggccagcctggccgccgccctggaggagaccctgctgaacaccaagctggagacagctgacctgaagtgggtgaccttcccccaggtggatggccagtgggaggagctgagcggcctggatgaggagcagcacagcgtgaggacctatgaggtgtgtgatgtgcagagggcccctggccaggcccactggctgaggacaggctgggtgcccaggagaggagctgtgcacgtgtatgccaccctgcgcttcaccatgctggagtgcctgagcctgcccagggctggccgcagctgcaaggagaccttcaccgtcttctactatgaaagtgatgctgacacagccacagccctgaccccagcctggatggagaacccctacatcaaggtggacacagtggccgctgagcacctgaccaggaagaggcctggagctgaggccaccgggaaggtgaatgtgaagaccctgcggctgggccccctgagcaaggccggcttctacctggccttccaggaccagggcgcctgcatggccctgctgagcctgcacctgttctacaagaagtgtgcccagctgactgtgaacctgacccgcttccctgagaccgtgccccgggagctggtggtgcctgtggccggcagctgtgtggtggatgctgtgcctgcccctggccccagccccagcctgtactgcagagaagatggccagtgggccgagcagcctgtgacaggctgcagctgtgcccctggctttgaagctgctgagggcaacaccaagtgccgggcctgtgcccagggcaccttcaagcccctgagcggggagggcagctgccagccctgcccagccaacagccacagcaacaccatcggcagcgctgtgtgccagtgccgggtgggctacttccgggccaggacagaccccaggggggccccctgcaccaccccaccttctgcccccaggtctgtggtgtcccggctgaatggcagcagcctgcacctggagtggagcgcccccctggagagcggcggccgggaggacctgacctacgccctgcgctgcagagaatgtagacctgggggcagctgtgccccctgtggcggggacctgacctttgatcctggcccccgggacctggtggagccctgggtggtggtgcggggcctgcggccagacttcacctacacctttgaggtgacagccctgaatggagtgagcagcctggccactggacctgtgccctttgagcctgtgaatgtgaccacagaccgggaggtgcccccagctgtgtctgacatccgggtgaccaggagcagccccagcagcctgagcctggcctgggccgtgccccgggcccccagcggggctgtgctggactatgaggtgaagtaccacgagaagggagctgagggccccagctctgtgcgcttcctgaagaccagtgaaaatagagctgagctgcggggcctgaagagaggagccagctacctggtgcaggtgcgggcccggtctgaggccggctacggccccttcggccaggagcaccacagccagacccagctggatgaaagtgagggctggagggagcagctggccctgattgctggaacagctgtggtgggcgtggtgctggtgctggtggtgattgtggtggccgtgctgtgcctgaggaagcagagcaatggccgggaggccgagtacagcgacaagcacggccagtacctgattggacatggcaccaaggtgtacatcgaccccttcacctatgaggaccccaatgaggccgtgcgggagtttgccaaggagattgatgtgtcctatgtgaagattgaggaggtgattggagctggggagtttggagaggtgtgccggggccgcctgaaggcccctgggaagaaggagagctgtgtggccatcaagaccctgaagggcggctacacagagcggcagaggcgggagttcctgtctgaggccagcatcatgggccagtttgagcaccccaacatcatccggctggagggcgtggtgaccaacagcatgcctgtgatgatcctgacagagttcatggagaatggagccctggacagcttcctgcggctgaatgatggccagttcaccgtcatccagctggtgggcatgctgcggggcatcgccagcggcatgagatacctggccgagatgtcctatgtgcaccgggacctggccgccaggaacatcctggtgaacagcaacctggtgtgcaaggtgtctgactttggcctgagccgcttcctggaggagaacagcagtgaccccacctacaccagcagcctgggcggcaagatccccatccgctggacagcccctgaggccatcgccttcaggaagttcaccagcgccagtgatgcctggagctatggcatcgtgatgtgggaggtgatgagctttggagagcggccctactgggacatgagcaaccaggacgtcatcaatgccatcgagcaggactaccgcctgcccccacctccagactgccccaccagcctgcaccagctgatgctggactgctggcagaaggacagaaatgcccggccccgcttcccccaggtggtgtctgccctggacaagatgatcagaaatcctgccagcctgaagatcgtggcccgggagaatggaggagacctgctgcgcatcggcgtgaccctggccggccaccagaagaagatcctggcctctgtgcagcacatgaagagccaggccaagccaggcaccccaggcggcaccggcggccctgccccccagtactag

SEQ ID NO: 19479 - DNA, 552 bp, Artificial Sequence
  Description of Artificial Sequence: Synthetic coding sequence
atggagttcctgtgggcccccctgctgggcctgtgctgcagcctggccgctgctgacagacacacagtgttctggaacagcagcaaccccaagttcagaaatgaagactacaccatccacgtgcagctgaatgactatgtggacatcatctgcccccactatgaggaccacagcgtggctgatgctgccatggagcagtacatcctgtacctggtggagcacgaggagtaccagctgtgccagccccagagcaaggaccaggtgcgctggcagtgcaaccggcccagcgccaagcacggccctgagaagctgtctgagaagttccagcgcttcacccccttcaccctgggcaaggagttcaaggagggccacagctactactacatcagccacagcccccaggcccatgacaacccccaggagaagaggctggccgcagatgatcctgaggtgcgggtgctgcacagcatcggccacagcgctgcccccaggctcttccccctggcctggacagtgctgctgctgcccctgctgctgctgcagaccccctag

SEQ ID NO: 19480 - DNA, 618 bp, Artificial Sequence
  Description of Artificial Sequence: Synthetic coding sequence
atggagttcctgtgggcccccctgctgggcctgtgctgcagcctggccgctgctgacagacacacagtgttctggaacagcagcaaccccaagttcagaaatgaagactacaccatccacgtgcagctgaatgactatgtggacatcatctgcccccactatgaggaccacagcgtggctgatgctgccatggagcagtacatcctgtacctggtggagcacgaggagtaccagctgtgccagccccagagcaaggaccaggtgcgctggcagtgcaaccggcccagcgccaagcacggccctgagaagctgtctgagaagttccagcgcttcacccccttcaccctgggcaaggagttcaaggagggccacagctactactacatcagcaagcccatccaccagcatgaagatcgctgcctgcggctgaaggtgacagtgtctgggaagatcacccacagcccccaggcccatgacaacccccaggagaagaggctggccgcagatgatcctgaggtgcgggtgctgcacagcatcggccacagcgctgcccccaggctcttccccctggcctggacagtgctgctgctgcccctgctgctgctgcagaccccctag

SEQ ID NO: 19481 - DNA, 1002 bp, Artificial Sequence
  Description of Artificial Sequence: Synthetic coding sequence
atggctgtgcggcgggacagcgtgtggaagtactgctggggcgtgctgatggtgctgtgcaggacagccatcagcaagagcatcgtgctggagcccatctactggaacagcagcaacagcaagttcctgcccggccagggcctggtgctgtacccccagatcggggacaagctggacatcatctgccccaaggtggacagcaagacagtgggccagtatgagtactacaaggtgtacatggtggacaaggaccaggccgaccgctgcaccatcaagaaggagaacacccccctgctgaactgtgccaagccagaccaggacatcaagttcaccatcaagttccaggagttcagccccaacctgtggggcctggagttccagaagaacaaggactactacatcatcagcaccagcaatggcagcctggagggcctggacaaccaggagggcggcgtgtgccagacccgggccatgaagatcctgatgaaggtgggccaggatgccagcagcgctggcagcaccaggaacaaggaccccaccaggaggcctgagctggaggccggcaccaacggccgcagcagcaccaccagcccctttgtgaagcccaaccctggcagcagcacagatggcaacagcgctggccacagcggcaacaacatcctgggcagcgaggtggccctgtttgctggcatcgccagcggctgcatcatcttcatcgtcatcatcatcaccctggtggtgctgctgctgaagtacagaagaagacacaggaagcacagcccccagcacaccaccaccctgagcctgagcaccctggccacccccaagaggagcggcaacaacaacggcagcgagcccagcgacatcatcatccccctgaggacagctgacagcgtcttctgcccccactatgagaaggtgtctggggactatggccaccctgtgtacatcgtgcaggagatgccaccccagagccctgccaacatctactacaaggtgtag

SEQ ID NO: 19482 - DNA, 3624 bp, Artificial Sequence
  Description of Artificial Sequence: Synthetic coding sequence
atgctgctgaccctcatcatcctgctgcctgtggtgtccaagttctcctttgtgtccctgagcgccccccagcactggagctgcccagagggcaccctggccggaaatggaaacagcacctgtgtgggccctgcccccttcctgatcttcagccacggcaacagcatcttcagaattgacacagagggcaccaactatgagcagctggtggtggatgctggggtgtctgtcatcatggacttccactacaatgagaagaggatctactgggtggacctggagcggcagctgctgcagagggtcttcctgaatggcagccggcaggagcgggtgtgcaacatcgagaagaatgtgtctggcatggccatcaactggatcaatgaggaggtgatctggagcaaccagcaggagggcatcatcaccgtgacagacatgaagggcaacaacagccacatcctgctgagcgccctgaagtacccagccaacgtggccgtggaccctgtggagcgcttcatcttctggagcagcgaggtggccggcagcctgtacagagctgacctggatggagtgggcgtgaaggccctgctggagaccagcgagaagatcacagctgtgtccctggatgtgctggacaagaggctcttctggatccagtacaaccgggagggcagcaacagcctcatctgcagctgtgactatgatggcggctctgtgcacatcagcaagcaccccacccagcacaacctgtttgccatgagcctgtttggagaccgcatcttctacagcacctggaagatgaagaccatctggatcgccaacaagcacacaggcaaggacatggtgcgcatcaacctgcacagcagctttgtgcccctgggggagctgaaggtggtgcaccccctggcccagcccaaggcagaagatgacacctgggagcctgagcagaagctgtgcaagctgaggaagggcaactgcagcagcacagtgtgtggccaggacctgcagagccacctgtgcatgtgtgccgagggctacgccctgagccgggacaggaagtactgtgaagatgtgaatgaatgtgccttctggaaccacggctgcaccctgggctgcaagaacaccccaggcagctactactgcacctgccctgtgggctttgtgctgctgcctgatggcaagcgctgccaccagctggtgtcctgccccagaaatgtgtctgaatgttctcatgactgtgtgctgaccagcgagggccccctgtgcttctgcccagagggctctgtgctggagagagatggcaagacctgcagcggctgcagcagcccagacaatggaggctgcagccagctgtgtgtgcccctgagccctgtgtcctgggagtgtgactgcttccctggctatgacctgcagctggatgagaagagctgtgccgccagcggcccccagcccttcctgctgtttgccaacagccaggacatccgccacatgcactttgatggaacagattatggcaccctgctgagccagcagatgggcatggtgtatgccctggaccatgaccctgtggagaacaagatctactttgcccacacagccctgaagtggattgaaagagccaacatggatggcagccagcgggagcggctcatcgaggagggcgtggatgtgcctgagggcctggccgtggactggattggaagacgcttctactggacagaccggggcaagagcctgattggccgcagtgacctgaatggcaagaggagcaagatcatcaccaaggagaacatcagccagccccggggcattgctgtgcaccccatggccaagaggctcttctggacagacaccggcatcaaccccagaattgagagcagcagcctgcagggcctgggccgcctggtgattgccagcagtgacctgatctggcccagcggcatcaccatcgacttcctgacagacaagctgtactggtgtgatgccaagcagagcgtcatcgagatggccaacctggatggcagcaagagaagaaggctgacccagaatgatgtgggccacccctttgctgtggccgtgtttgaggactatgtgtggttcagtgactgggccatgcccagcgtgatgagggtgaacaagaggacaggcaaggacagagtgcggctgcagggctccatgctgaagcccagcagcctggtggtggtgcaccccctggccaagccaggagctgacccctgcctgtaccagaatggaggctgtgagcacatctgcaagaagaggctgggcacagcctggtgcagctgccgggagggcttcatgaaggccagtgatggcaagacctgcctggccctggatggccaccagctgctggccggcggggaggtggacctgaagaaccaggtgacccccctggacatcctgagcaagaccagggtgtctgaggacaacatcacagagagccagcacatgctggtggccgagatcatggtgtctgaccaggatgactgtgcccctgtgggctgcagcatgtatgcccgctgcatcagtgaaggagaagatgccacctgccagtgcctgaagggctttgctggagatggcaagctgtgcagcgacattgatgaatgtgagatgggcgtgcctgtgtgccccccagccagcagcaagtgcatcaacacagaaggaggctacgtgtgccgctgcagcgagggctaccagggagatggcatccactgcctggacattgatgagtgccagctgggggagcacagctgtggagaaaatgccagctgcaccaacacagagggcggctacacctgcatgtgtgccggccgcctgtctgagcccggcctcatctgcccagacagcaccccaccaccccacctgcgggaggatgaccaccactacagcgtgaggaacagcgacagtgaatgtcccctgagccatgatggctactgcctgcatgatggagtgtgcatgtacatcgaggccctggacaagtatgcctgcaactgtgtggtgggctacatcggggagcgctgccagtacagagacctgaagtggtgggagctgcggcatgctggccacggccagcagcagaaggtgattgtggtggccgtgtgtgtggtggtgctggtgatgctgctgctgctgagcctgtggggcgcccactactaccgcacccagaagctgctgagcaagaaccccaagaacccctatgaggagagcagcagagatgtgcgcagcagaagacctgctgacacagaagatggcatgagcagctgcccccagccctggtttgtggtgatcaaggagcaccaggacctgaagaatggaggccagcctgtggccggagaagatggccaggccgcagatggctccatgcagcccacctcctggaggcaggagccccagctgtgtggcatgggcacagagcagggctgctggatccctgtgtccagtgacaagggcagctgcccccaggtgatggagaggagcttccacatgcccagctatggcacccagaccctggagggcggcgtggagaagccccacagcctgctgagcgccaaccccctgtggcagcagagggccctggaccccccccaccagatggagctgacccagtag

SEQ ID NO: 19483 - DNA, 3501 bp, Artificial Sequence
  Description of Artificial Sequence: Synthetic coding sequence
atgctgctgaccctcatcatcctgctgcctgtggtgtccaagttctcctttgtgtccctgagcgccccccagcactggagctgcccagagggcaccctggccggaaatggaaacagcacctgtgtgggccctgcccccttcctgatcttcagccacggcaacagcatcttcagaattgacacagagggcaccaactatgagcagctggtggtggatgctggggtgtctgtcatcatggacttccactacaatgagaagaggatctactgggtggacctggagcggcagctgctgcagagggtcttcctgaatggcagccggcaggagcgggtgtgcaacatcgagaagaatgtgtctggcatggccatcaactggatcaatgaggaggtgatctggagcaaccagcaggagggcatcatcaccgtgacagacatgaagggcaacaacagccacatcctgctgagcgccctgaagtacccagccaacgtggccgtggaccctgtggagcgcttcatcttctggagcagcgaggtggccggcagcctgtacagagctgacctggatggagtgggcgtgaaggccctgctggagaccagcgagaagatcacagctgtgtccctggatgtgctggacaagaggctcttctggatccagtacaaccgggagggcagcaacagcctcatctgcagctgtgactatgatggcggctctgtgcacatcagcaagcaccccacccagcacaacctgtttgccatgagcctgtttggagaccgcatcttctacagcacctggaagatgaagaccatctggatcgccaacaagcacacaggcaaggacatggtgcgcatcaacctgcacagcagctttgtgcccctgggggagctgaaggtggtgcaccccctggcccagcccaaggcagaagatgacacctgggagcctgagcagaagctgtgcaagctgaggaagggcaactgcagcagcacagtgtgtggccaggacctgcagagccacctgtgcatgtgtgccgagggctacgccctgagccgggacaggaagtactgtgaagatgtgaatgaatgtgccttctggaaccacggctgcaccctgggctgcaagaacaccccaggcagctactactgcacctgccctgtgggctttgtgctgctgcctgatggcaagcgctgccaccagctggtgtcctgccccagaaatgtgtctgaatgttctcatgactgtgtgctgaccagcgagggccccctgtgcttctgcccagagggctctgtgctggagagagatggcaagacctgcagcggctgcagcagcccagacaatggaggctgcagccagctgtgtgtgcccctgagccctgtgtcctgggagtgtgactgcttccctggctatgacctgcagctggatgagaagagctgtgccgccagcggcccccagcccttcctgctgtttgccaacagccaggacatccgccacatgcactttgatggaacagattatggcaccctgctgagccagcagatgggcatggtgtatgccctggaccatgaccctgtggagaacaagatctactttgcccacacagccctgaagtggattgaaagagccaacatggatggcagccagcgggagcggctcatcgaggagggcgtggatgtgcctgagggcctggccgtggactggattggaagacgcttctactggacagaccggggcaagagcctgattggccgcagtgacctgaatggcaagaggagcaagatcatcaccaaggagaacatcagccagccccggggcattgctgtgcaccccatggccaagaggctcttctggacagacaccggcatcaaccccagaattgagagcagcagcctgcagggcctgggccgcctggtgattgccagcagtgacctgatctggcccagcggcatcaccatcgacttcctgacagacaagctgtactggtgtgatgccaagcagagcgtcatcgagatggccaacctggatggcagcaagagaagaaggctgacccagaatgatgtgggccacccctttgctgtggccgtgtttgaggactatgtgtggttcagtgactgggccatgcccagcgtgatgagggtgaacaagaggacaggcaaggacagagtgcggctgcagggctccatgctgaagcccagcagcctggtggtggtgcaccccctggccaagccaggagctgacccctgcctgtaccagaatggaggctgtgagcacatctgcaagaagaggctgggcacagcctggtgcagctgccgggagggcttcatgaaggccagtgatggcaagacctgcctggccctggatggccaccagctgctggccggcggggaggtggacctgaagaaccaggtgacccccctggacatcctgagcaagaccagggtgtctgaggacaacatcacagagagccagcacatgctggtggccgagatcatggtgtctgaccaggatgactgtgcccctgtgggctgcagcatgtatgcccgctgcatcagtgaaggagaagatgccacctgccagtgcctgaagggctttgctggagatggcaagctgtgcagcgacattgatgaatgtgagatgggcgtgcctgtgtgccccccagccagcagcaagtgcatcaacacagaaggaggctacgtgtgccgctgcagcgagggctaccagggagatggcatccactgcctggacagcaccccaccaccccacctgagagaagatgaccaccactacagcgtgaggaacagcgacagcgagtgccccctgagccatgatggctactgcctgcatgatggagtgtgcatgtacatcgaggccctggacaagtatgcctgcaactgtgtggtgggctacatcggggagcgctgccagtacagagacctgaagtggtgggagctgcggcatgctggccacggccagcagcagaaggtgattgtggtggccgtgtgtgtggtggtgctggtgatgctgctgctgctgagcctgtggggcgcccactactaccgcacccagaagctgctgagcaagaaccccaagaacccctatgaggagagcagcagagatgtgcgcagccggcggcctgctgacacagaagatggcatgagcagctgcccccagccctggtttgtggtgatcaaggagcaccaggacctgaagaatggaggccagcctgtggccggggaggatggccaggccgcagatggctccatgcagcccacctcctggaggcaggagccccagctgtgtggcatgggcacagagcagggctgctggatccctgtgtccagtgacaagggcagctgcccccaggtgatggagaggagcttccacatgcccagctatggcacccagaccctggagggcggcgtggagaagccccacagcctgctgagcgccaaccccctgtggcagcagagggccctggaccccccccaccagatggagctgacccagtag

SEQ ID NO: 19484 - DNA, 3498 bp, Artificial Sequence
  Description of Artificial Sequence: Synthetic coding sequence
atgctgctgaccctcatcatcctgctgcctgtggtgtccaagttctcctttgtgtccctgagcgccccccagcactggagctgcccagagggcaccctggccggaaatggaaacagcacctgtgtgggccctgcccccttcctgatcttcagccacggcaacagcatcttcagaattgacacagagggcaccaactatgagcagctggtggtggatgctggggtgtctgtcatcatggacttccactacaatgagaagaggatctactgggtggacctggagcggcagctgctgcagagggtcttcctgaatggcagccggcaggagcgggtgtgcaacatcgagaagaatgtgtctggcatggccatcaactggatcaatgaggaggtgatctggagcaaccagcaggagggcatcatcaccgtgacagacatgaagggcaacaacagccacatcctgctgagcgccctgaagtacccagccaacgtggccgtggaccctgtggagcgcttcatcttctggagcagcgaggtggccggcagcctgtacagagctgacctggatggagtgggcgtgaaggccctgctggagaccagcgagaagatcacagctgtgtccctggatgtgctggacaagaggctcttctggatccagtacaaccgggagggcagcaacagcctcatctgcagctgtgactatgatggcggctctgtgcacatcagcaagcaccccacccagcacaacctgtttgccatgagcctgtttggagaccgcatcttctacagcacctggaagatgaagaccatctggatcgccaacaagcacacaggcaaggacatggtgcgcatcaacctgcacagcagctttgtgcccctgggggagctgaaggtggtgcaccccctggcccagcccaaggcagaagatgacacctgggagccagatgtgaatgaatgtgccttctggaaccacggctgcaccctgggctgcaagaacaccccaggcagctactactgcacctgccctgtgggctttgtgctgctgcctgatggcaagcgctgccaccagctggtgtcctgccccagaaatgtgtctgaatgttctcatgactgtgtgctgaccagcgagggccccctgtgcttctgcccagagggctctgtgctggagagagatggcaagacctgcagcggctgcagcagcccagacaatggaggctgcagccagctgtgtgtgcccctgagccctgtgtcctgggagtgtgactgcttccctggctatgacctgcagctggatgagaagagctgtgccgccagcggcccccagcccttcctgctgtttgccaacagccaggacatccgccacatgcactttgatggaacagattatggcaccctgctgagccagcagatgggcatggtgtatgccctggaccatgaccctgtggagaacaagatctactttgcccacacagccctgaagtggattgaaagagccaacatggatggcagccagcgggagcggctcatcgaggagggcgtggatgtgcctgagggcctggccgtggactggattggaagacgcttctactggacagaccggggcaagagcctgattggccgcagtgacctgaatggcaagaggagcaagatcatcaccaaggagaacatcagccagccccggggcattgctgtgcaccccatggccaagaggctcttctggacagacaccggcatcaaccccagaattgagagcagcagcctgcagggcctgggccgcctggtgattgccagcagtgacctgatctggcccagcggcatcaccatcgacttcctgacagacaagctgtactggtgtgatgccaagcagagcgtcatcgagatggccaacctggatggcagcaagagaagaaggctgacccagaatgatgtgggccacccctttgctgtggccgtgtttgaggactatgtgtggttcagtgactgggccatgcccagcgtgatgagggtgaacaagaggacaggcaaggacagagtgcggctgcagggctccatgctgaagcccagcagcctggtggtggtgcaccccctggccaagccaggagctgacccctgcctgtaccagaatggaggctgtgagcacatctgcaagaagaggctgggcacagcctggtgcagctgccgggagggcttcatgaaggccagtgatggcaagacctgcctggccctggatggccaccagctgctggccggcggggaggtggacctgaagaaccaggtgacccccctggacatcctgagcaagaccagggtgtctgaggacaacatcacagagagccagcacatgctggtggccgagatcatggtgtctgaccaggatgactgtgcccctgtgggctgcagcatgtatgcccgctgcatcagtgaaggagaagatgccacctgccagtgcctgaagggctttgctggagatggcaagctgtgcagcgacattgatgaatgtgagatgggcgtgcctgtgtgccccccagccagcagcaagtgcatcaacacagaaggaggctacgtgtgccgctgcagcgagggctaccagggagatggcatccactgcctggacattgatgagtgccagctgggggagcacagctgtggagaaaatgccagctgcaccaacacagagggcggctacacctgcatgtgtgccggccgcctgtctgagcccggcctcatctgcccagacagcaccccaccaccccacctgcgggaggatgaccaccactacagcgtgaggaacagcgacagtgaatgtcccctgagccatgatggctactgcctgcatgatggagtgtgcatgtacatcgaggccctggacaagtatgcctgcaactgtgtggtgggctacatcggggagcgctgccagtacagagacctgaagtggtgggagctgcggcatgctggccacggccagcagcagaaggtgattgtggtggccgtgtgtgtggtggtgctggtgatgctgctgctgctgagcctgtggggcgcccactactaccgcacccagaagctgctgagcaagaaccccaagaacccctatgaggagagcagcagagatgtgcgcagcagaagacctgctgacacagaagatggcatgagcagctgcccccagccctggtttgtggtgatcaaggagcaccaggacctgaagaatggaggccagcctgtggccggagaagatggccaggccgcagatggctccatgcagcccacctcctggaggcaggagccccagctgtgtggcatgggcacagagcagggctgctggatccctgtgtccagtgacaagggcagctgcccccaggtgatggagaggagcttccacatgcccagctatggcacccagaccctggagggcggcgtggagaagccccacagcctgctgagcgccaaccccctgtggcagcagagggccctggaccccccccaccagatggagctgacccagtag

SEQ ID NO: 19485 - DNA, 3633 bp, Artificial Sequence
  Description of Artificial Sequence: Synthetic coding sequence
atgaggcccagcggcacagctggagctgccctgctggccctgctggccgccctgtgcccagccagccgggccctggaggagaagaaggtgtgccagggcaccagcaacaagctgacccagctgggcacctttgaggaccacttcctgagcctgcagaggatgttcaacaactgtgaggtggtgctgggcaacctggagatcacctacgtgcagaggaactatgacctgtccttcctgaagaccatccaggaggtggccggctacgtgctgattgccctgaacacagtggagcgcatccccctggagaacctgcagatcatccggggcaacatgtactatgagaacagctatgccctggccgtgctgagcaactatgatgccaacaagacaggcctgaaggagctgcccatgaggaacctgcaggagatcctgcatggagctgtgcgcttcagcaacaacccagccctgtgcaatgtggagagcatccagtggagggacatcgtgtccagtgacttcctgagcaacatgtccatggacttccagaaccacctgggcagctgccagaagtgtgaccccagctgccccaacggcagctgctggggcgctggggaggagaactgccagaagctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccagaaattatgtggtgacagaccacggcagctgtgtgcgggcctgtggggctgacagctatgagatggaggaggatggagtgaggaagtgcaagaagtgtgagggcccctgcaggaaggtgtgcaatggcatcggcatcggggagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcttcctgctgatccaggcctggccagagaacagaacagacctgcacgcctttgagaacctggagatcatccggggccgcaccaagcagcacggccagttcagcctggccgtggtgtccctgaacatcaccagcctgggcctgcggagcctgaaggagatcagtgatggagatgtgatcatcagcggcaacaagaacctgtgctacgccaacaccatcaactggaagaagctgtttggcaccagcggccagaagaccaagatcatcagcaacagaggagagaacagctgcaaggccaccggccaggtgtgccacgccctgtgcagccctgagggctgctggggccctgagccccgggactgtgtgtcctgcagaaatgtgtcccggggccgggagtgtgtggacaagtgcaacctgctggagggggagccccgggagtttgtggagaacagcgagtgcatccagtgccacccagaatgtctgccccaggccatgaacatcacctgcaccggccggggccctgacaactgcatccagtgtgcccactacattgatggcccccactgtgtgaagacctgcccagctggggtgatgggagagaacaacaccctggtgtggaagtatgcagatgctggccacgtgtgccacctgtgccaccccaactgcacctacggctgcaccggccctggcctggagggctgccccaccaacggccccaagatccccagcatcgccaccggcatggtgggcgccctgctgctgctgctggtggtggccctgggcatcggcctcttcatgagaagaagacacatcgtgaggaagaggaccctgcggcggctgctgcaggagcgggagctggtggagcccctgaccccatctggagaggcccccaaccaggccctgctgcgcatcctgaaggagacagagttcaagaagatcaaggtgctgggcagcggggcctttggaacagtgtacaagggcctgtggatccctgagggggagaaggtgaagatccctgtggccatcaaggagctgcgggaggccaccagccccaaggccaacaaggagatcctggatgaggcctacgtgatggcctctgtggacaacccccacgtgtgccgcctgctgggcatctgcctgaccagcacagtgcagctgatcacccagctgatgcccttcggctgcctgctggactatgtgcgggagcacaaggacaacatcggcagccagtacctgctgaactggtgtgtgcagatcgccaagggcatgaactacctggaggaccggcggctggtgcaccgggacctggccgccagaaatgtgctggtgaagaccccccagcacgtgaagatcacagactttggcctggccaagctgctgggcgctgaggagaaggagtaccacgccgagggcggcaaggtgcccatcaagtggatggccctggagagcatcctgcaccgcatctacacccaccagagtgatgtgtggagctatggagtgacagtgtgggagctgatgaccttcggcagcaagccctatgatggcatcccagccagcgagatcagcagcatcctggagaagggggagcggctgccccagccccccatctgcaccattgatgtgtacatgatcatggtgaagtgctggatgattgatgctgacagccggcccaagttccgggagctgatcatcgagttcagcaagatggcccgggacccccagcgctacctggtgatccagggagatgagaggatgcacctgcccagccccacagacagcaacttctaccgggccctgatggatgaggaggacatggatgatgtggtggatgctgatgagtacctgatcccccagcagggcttcttcagcagccccagcaccagcaggacccccctgctgagcagcctgagcgccaccagcaacaacagcacagtggcctgcatcgacagaaatggcctgcagagctgccccatcaaggaggacagcttcctgcagcgctacagcagtgaccccaccggggccctgacagaagattccattgatgacaccttcctgcctgtgcctgagtacatcaaccagagcgtgcccaagaggcctgctggctctgtgcagaaccctgtgtaccacaaccagcccctgaacccagcccccagccgggacccccactaccaggacccccacagcacagctgtgggcaaccctgagtacctgaacacagtgcagcccacctgtgtgaacagcacctttgacagccctgcccactgggcccagaagggcagccaccagatcagcctggacaacccagactaccagcaggacttcttccccaaggaggccaagcccaacggcatcttcaagggcagcacagcagaaaatgctgagtacctgcgggtggccccccagagcagcgagttcatcggggcctag

SEQ ID NO: 19486 - DNA, 1887 bp, Artificial Sequence
  Description of Artificial Sequence: Synthetic coding sequence
atgaggcccagcggcacagctggagctgccctgctggccctgctggccgccctgtgcccagccagccgggccctggaggagaagaaggtgtgccagggcaccagcaacaagctgacccagctgggcacctttgaggaccacttcctgagcctgcagaggatgttcaacaactgtgaggtggtgctgggcaacctggagatcacctacgtgcagaggaactatgacctgtccttcctgaagaccatccaggaggtggccggctacgtgctgattgccctgaacacagtggagcgcatccccctggagaacctgcagatcatccggggcaacatgtactatgagaacagctatgccctggccgtgctgagcaactatgatgccaacaagacaggcctgaaggagctgcccatgaggaacctgcaggagatcctgcatggagctgtgcgcttcagcaacaacccagccctgtgcaatgtggagagcatccagtggagggacatcgtgtccagtgacttcctgagcaacatgtccatggacttccagaaccacctgggcagctgccagaagtgtgaccccagctgccccaacggcagctgctggggcgctggggaggagaactgccagaagctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccagaaattatgtggtgacagaccacggcagctgtgtgcgggcctgtggggctgacagctatgagatggaggaggatggagtgaggaagtgcaagaagtgtgagggcccctgcaggaaggtgtgcaatggcatcggcatcggggagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcttcctgctgatccaggcctggccagagaacagaacagacctgcacgcctttgagaacctggagatcatccggggccgcaccaagcagcacggccagttcagcctggccgtggtgtccctgaacatcaccagcctgggcctgcggagcctgaaggagatcagtgatggagatgtgatcatcagcggcaacaagaacctgtgctacgccaacaccatcaactggaagaagctgtttggcaccagcggccagaagaccaagatcatcagcaacagaggagagaacagctgcaaggccaccggccaggtgtgccacgccctgtgcagccctgagggctgctggggccctgagccccgggactgtgtgtcctgcagaaatgtgtcccggggccgggagtgtgtggacaagtgcaacctgctggagggggagccccgggagtttgtggagaacagcgagtgcatccagtgccacccagaatgtctgccccaggccatgaacatcacctgcaccggccggggccctgacaactgcatccagtgtgcccactacattgatggcccccactgtgtgaagacctgcccagctggggtgatgggagagaacaacaccctggtgtggaagtatgcagatgctggccacgtgtgccacctgtgccaccccaactgcacctacggcagctag

SEQ ID NO: 19487 - DNA, 2118 bp, Artificial Sequence
  Description of Artificial Sequence: Synthetic coding sequence
atgaggcccagcggcacagctggagctgccctgctggccctgctggccgccctgtgcccagccagccgggccctggaggagaagaaggtgtgccagggcaccagcaacaagctgacccagctgggcacctttgaggaccacttcctgagcctgcagaggatgttcaacaactgtgaggtggtgctgggcaacctggagatcacctacgtgcagaggaactatgacctgtccttcctgaagaccatccaggaggtggccggctacgtgctgattgccctgaacacagtggagcgcatccccctggagaacctgcagatcatccggggcaacatgtactatgagaacagctatgccctggccgtgctgagcaactatgatgccaacaagacaggcctgaaggagctgcccatgaggaacctgcaggagatcctgcatggagctgtgcgcttcagcaacaacccagccctgtgcaatgtggagagcatccagtggagggacatcgtgtccagtgacttcctgagcaacatgtccatggacttccagaaccacctgggcagctgccagaagtgtgaccccagctgccccaacggcagctgctggggcgctggggaggagaactgccagaagctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccagaaattatgtggtgacagaccacggcagctgtgtgcgggcctgtggggctgacagctatgagatggaggaggatggagtgaggaagtgcaagaagtgtgagggcccctgcaggaaggtgtgcaatggcatcggcatcggggagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcttcctgctgatccaggcctggccagagaacagaacagacctgcacgcctttgagaacctggagatcatccggggccgcaccaagcagcacggccagttcagcctggccgtggtgtccctgaacatcaccagcctgggcctgcggagcctgaaggagatcagtgatggagatgtgatcatcagcggcaacaagaacctgtgctacgccaacaccatcaactggaagaagctgtttggcaccagcggccagaagaccaagatcatcagcaacagaggagagaacagctgcaaggccaccggccaggtgtgccacgccctgtgcagccctgagggctgctggggccctgagccccgggactgtgtgtcctgcagaaatgtgtcccggggccgggagtgtgtggacaagtgcaacctgctggagggggagccccgggagtttgtggagaacagcgagtgcatccagtgccacccagaatgtctgccccaggccatgaacatcacctgcaccggccggggccctgacaactgcatccagtgtgcccactacattgatggcccccactgtgtgaagacctgcccagctggggtgatgggagagaacaacaccctggtgtggaagtatgcagatgctggccacgtgtgccacctgtgccaccccaactgcacctacggccctggaaatgaaagcctgaaggccatgctgttctgcctcttcaagctgagcagctgcaaccagagcaatgatggctctgtgagccaccagagcggcagccctgctgcccaggagagctgcctgggctggatccccagcctgctgcccagcgagttccagctgggctggggcggctgcagccacctgcacgcctggcccagcgccagcgtcatcatcacagccagcagctgccactag

SEQ ID NO: 19488 - DNA, 3243 bp, Artificial Sequence
  Description of Artificial Sequence: Synthetic coding sequence
aacagaacagaaggagctgcccacgagaagttcaccggcaacccagcctggaggagagctgtgcagcagcagccctgccctgtggtggagagcatccagtggagggacatcgtgtccagtgacttcctgagcaacatgtccatggacttccagaaccacctgggcagctgccagaagtgtgaccccagctgccccaacggcagctgctggggcgctggggaggagaactgccagaagctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccagaaattatgtggtgacagaccacggcagctgtgtgcgggcctgtggggctgacagctatgagatggaggaggatggagtgaggaagtgcaagaagtgtgagggcccctgcaggaaggtgtgcaatggcatcggcatcggggagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcttcctgctgatccaggcctggccagagaacagaacagacctgcacgcctttgagaacctggagatcatccggggccgcaccaagcagcacggccagttcagcctggccgtggtgtccctgaacatcaccagcctgggcctgcggagcctgaaggagatcagtgatggagatgtgatcatcagcggcaacaagaacctgtgctacgccaacaccatcaactggaagaagctgtttggcaccagcggccagaagaccaagatcatcagcaacagaggagagaacagctgcaaggccaccggccaggtgtgccacgccctgtgcagccctgagggctgctggggccctgagccccgggactgtgtgtcctgcagaaatgtgtcccggggccgggagtgtgtggacaagtgcaacctgctggagggggagccccgggagtttgtggagaacagcgagtgcatccagtgccacccagaatgtctgccccaggccatgaacatcacctgcaccggccggggccctgacaactgcatccagtgtgcccactacattgatggcccccactgtgtgaagacctgcccagctggggtgatgggagagaacaacaccctggtgtggaagtatgcagatgctggccacgtgtgccacctgtgccaccccaactgcacctacggctgcaccggccctggcctggagggctgccccaccaacggccccaagatccccagcatcgccaccggcatggtgggcgccctgctgctgctgctggtggtggccctgggcatcggcctcttcatgagaagaagacacatcgtgaggaagaggaccctgcggcggctgctgcaggagcgggagctggtggagcccctgaccccatctggagaggcccccaaccaggccctgctgcgcatcctgaaggagacagagttcaagaagatcaaggtgctgggcagcggggcctttggaacagtgtacaagggcctgtggatccctgagggggagaaggtgaagatccctgtggccatcaaggagctgcgggaggccaccagccccaaggccaacaaggagatcctggatgaggcctacgtgatggcctctgtggacaacccccacgtgtgccgcctgctgggcatctgcctgaccagcacagtgcagctgatcacccagctgatgcccttcggctgcctgctggactatgtgcgggagcacaaggacaacatcggcagccagtacctgctgaactggtgtgtgcagatcgccaagggcatgaactacctggaggaccggcggctggtgcaccgggacctggccgccagaaatgtgctggtgaagaccccccagcacgtgaagatcacagactttggcctggccaagctgctgggcgctgaggagaaggagtaccacgccgagggcggcaaggtgcccatcaagtggatggccctggagagcatcctgcaccgcatctacacccaccagagtgatgtgtggagctatggagtgacagtgtgggagctgatgaccttcggcagcaagccctatgatggcatcccagccagcgagatcagcagcatcctggagaagggggagcggctgccccagccccccatctgcaccattgatgtgtacatgatcatggtgaagtgctggatgattgatgctgacagccggcccaagttccgggagctgatcatcgagttcagcaagatggcccgggacccccagcgctacctggtgatccagggagatgagaggatgcacctgcccagccccacagacagcaacttctaccgggccctgatggatgaggaggacatggatgatgtggtggatgctgatgagtacctgatcccccagcagggcttcttcagcagccccagcaccagcaggacccccctgctgagcagcctgagcgccaccagcaacaacagcacagtggcctgcatcgacagaaatggcctgcagagctgccccatcaaggaggacagcttcctgcagcgctacagcagtgaccccaccggggccctgacagaagattccattgatgacaccttcctgcctgtgcctgagtacatcaaccagagcgtgcccaagaggcctgctggctctgtgcagaaccctgtgtaccacaaccagcccctgaacccagcccccagccgggacccccactaccaggacccccacagcacagctgtgggcaaccctgagtacctgaacacagtgcagcccacctgtgtgaacagcacctttgacagccctgcccactgggcccagaagggcagccaccagatcagcctggacaacccagactaccagcaggacttcttccccaaggaggccaagcccaacggcatcttcaagggcagcacagcagaaaatgctgagtacctgcgggtggccccccagagcagcgagttcatcggggcctag

SEQ ID NO: 19489 - DNA, 1218 bp, Artificial Sequence
  Description of Artificial Sequence: Synthetic coding sequence
atgaggcccagcggcacagctggagctgccctgctggccctgctggccgccctgtgcccagccagccgggccctggaggagaagaaggtgtgccagggcaccagcaacaagctgacccagctgggcacctttgaggaccacttcctgagcctgcagaggatgttcaacaactgtgaggtggtgctgggcaacctggagatcacctacgtgcagaggaactatgacctgtccttcctgaagaccatccaggaggtggccggctacgtgctgattgccctgaacacagtggagcgcatccccctggagaacctgcagatcatccggggcaacatgtactatgagaacagctatgccctggccgtgctgagcaactatgatgccaacaagacaggcctgaaggagctgcccatgaggaacctgcaggagatcctgcatggagctgtgcgcttcagcaacaacccagccctgtgcaatgtggagagcatccagtggagggacatcgtgtccagtgacttcctgagcaacatgtccatggacttccagaaccacctgggcagctgccagaagtgtgaccccagctgccccaacggcagctgctggggcgctggggaggagaactgccagaagctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccagaaattatgtggtgacagaccacggcagctgtgtgcgggcctgtggggctgacagctatgagatggaggaggatggagtgaggaagtgcaagaagtgtgagggcccctgcaggaaggtgtgcaatggcatcggcatcggggagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcctgtcctag

SEQ ID NO: 19490 - DNA, 1974 bp, Artificial Sequence
  Description of Artificial Sequence: Synthetic coding sequence
atgaggcccagcggcacagctggagctgccctgctggccctgctggccgccctgtgcccagccagccgggccctggaggagaagaaggtgtgccagggcaccagcaacaagctgacccagctgggcacctttgaggaccacttcctgagcctgcagaggatgttcaacaactgtgaggtggtgctgggcaacctggagatcacctacgtgcagaggaactatgacctgtccttcctgaagaccatccaggaggtggccggctacgtgctgattgccctgaacacagtggagcgcatccccctggagaacctgcagatcatccggggcaacatgtactatgagaacagctatgccctggccgtgctgagcaactatgatgccaacaagacaggcctgaaggagctgcccatgaggaacctgcaggagatcctgcatggagctgtgcgcttcagcaacaacccagccctgtgcaatgtggagagcatccagtggagggacatcgtgtccagtgacttcctgagcaacatgtccatggacttccagaaccacctgggcagctgccagaagtgtgaccccagctgccccaacggcagctgctggggcgctggggaggagaactgccagaagctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccagaaattatgtggtgacagaccacggcagctgtgtgcgggcctgtggggctgacagctatgagatggaggaggatggagtgaggaagtgcaagaagtgtgagggcccctgcaggaaggtgtgcaatggcatcggcatcggggagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcttcctgctgatccaggcctggccagagaacagaacagacctgcacgcctttgagaacctggagatcatccggggccgcaccaagcagcacggccagttcagcctggccgtggtgtccctgaacatcaccagcctgggcctgcggagcctgaaggagatcagtgatggagatgtgatcatcagcggcaacaagaacctgtgctacgccaacaccatcaactggaagaagctgtttggcaccagcggccagaagaccaagatcatcagcaacagaggagagaacagctgcaaggccaccggccaggtgtgccacgccctgtgcagccctgagggctgctggggccctgagccccgggactgtgtgtcctgcagaaatgtgtcccggggccgggagtgtgtggacaagtgcaacctgctggagggggagccccgggagtttgtggagaacagcgagtgcatccagtgccacccagaatgtctgccccaggccatgaacatcacctgcaccggccggggccctgacaactgcatccagtgtgcccactacattgatggcccccactgtgtgaagacctgcccagctggggtgatgggagagaacaacaccctggtgtggaagtatgcagatgctggccacgtgtgccacctgtgccaccccaactgcacctacggctgcaccggccctggcctggagggctgccccaccaacggcagctacatcgtgagccacttccccaggagcttctacaagatgtctgtgcactag

SEQ ID NO: 19491 - DNA, 3474 bp, Artificial Sequence
  Description of Artificial Sequence: Synthetic coding sequence
atgttcaacaactgtgaggtggtgctgggcaacctggagatcacctacgtgcagagaaattatgacctgtccttcctgaagaccatccaggaggtggccggctacgtgctgattgccctgaacacagtggagcgcatccccctggagaacctgcagatcatccggggcaacatgtactatgaaaattcctatgccctggccgtgctgagcaactatgatgccaacaagacaggcctgaaggagctgcccatgaggaacctgcaggagatcctgcacggggctgtgcgcttcagcaacaacccagccctgtgcaatgtggagagcatccagtggagggacatcgtgtccagtgacttcctgagcaacatgtccatggacttccagaaccacctgggcagctgccagaagtgtgaccccagctgccccaacggcagctgctggggcgctggggaggagaactgccagaagctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccaggaactacgtggtgacagaccacggcagctgtgtgcgggcctgtggggctgacagctatgagatggaggaggatggagtgaggaagtgcaagaagtgtgagggcccctgcaggaaggtgtgcaatggaattggaattggagagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcttcctgctgatccaggcctggccagaaaatagaacagacctgcacgcctttgagaacctggagatcatccggggccgcaccaagcagcacggccagttcagcctggccgtggtgtccctgaacatcaccagcctgggcctgcggagcctgaaggagatcagtgatggagatgtgatcatcagcggcaacaagaacctgtgctacgccaacaccatcaactggaagaagctgtttggcaccagcggccagaagaccaagatcatcagcaacagaggagagaacagctgcaaggccaccggccaggtgtgccacgccctgtgcagccctgagggctgctggggccctgagccccgggactgtgtgtcctgcagaaatgtgtcccggggcagagaatgtgtggacaagtgcaacctgctggagggggagccccgggagtttgtggagaacagcgagtgcatccagtgccaccctgagtgcctgccccaggccatgaacatcacctgcaccggccggggccctgacaactgcatccagtgtgcccactacattgatggcccccactgtgtgaagacctgcccagctggggtgatgggagagaacaacaccctggtgtggaagtatgcagatgctggccacgtgtgccacctgtgccaccccaactgcacctacggctgcaccggccctggcctggagggctgccccaccaacggccccaagatccccagcatcgccaccggcatggtgggcgccctgctgctgctgctggtggtggccctgggcatcggcctcttcatgagaagaagacacatcgtgaggaagaggaccctgcggcggctgctgcaggagcgggagctggtggagcccctgacccccagcggggaggcccccaaccaggccctgctgcgcatcctgaaggagacagagttcaagaagatcaaggtgctgggcagcggggccttcggcaccgtgtacaagggcctgtggatccctgagggggagaaggtgaagatccctgtggccatcaaggagctgcgggaggccaccagccccaaggccaacaaggagatcctggatgaggcctacgtgatggcctctgtggacaacccccacgtgtgccgcctgctgggcatctgcctgaccagcacagtgcagctgatcacccagctgatgcccttcggctgcctgctggactatgtgcgggagcacaaggacaacatcggcagccagtacctgctgaactggtgtgtgcagatcgccaagggcatgaactacctggaggaccggcggctggtgcaccgggacctggccgccagaaatgtgctggtgaagaccccccagcacgtgaagatcacagactttggcctggccaagctgctgggcgctgaggagaaggagtaccacgccgagggcggcaaggtgcccatcaagtggatggccctggagagcatcctgcaccgcatctacacccaccagagtgatgtgtggagctatggagtgacagtgtgggagctgatgaccttcggcagcaagccctatgatggcatcccagccagcgagatcagcagcatcctggagaagggggagcggctgccccagccccccatctgcaccattgatgtgtacatgatcatggtgaagtgctggatgattgatgctgacagccggcccaagttccgggagctgatcatcgagttcagcaagatggcccgggacccccagcgctacctggtgatccagggagatgagaggatgcacctgcccagccccacagacagcaacttctaccgggccctgatggatgaggaggacatggatgatgtggtggatgctgatgagtacctgatcccccagcagggcttcttcagcagccccagcaccagcaggacccccctgctgagcagcctgagcgccaccagcaacaacagcacagtggcctgcatcgacagaaatggcctgcagagctgccccatcaaggaggacagcttcctgcagcgctacagcagtgaccccactggagccctgacagaggacagcattgatgacaccttcctgcctgtgcctgagtacatcaaccagagcgtgcccaagaggcctgctggctctgtgcagaaccctgtgtaccacaaccagcccctgaacccagcccccagccgggacccccactaccaggacccccacagcacagctgtgggcaaccctgagtacctgaacacagtgcagcccacctgtgtgaacagcacctttgacagccctgcccactgggcccagaagggcagccaccagatcagcctggacaacccagactaccagcaggacttcttccccaaggaggccaagcccaacggcatcttcaagggcagcacagcagaaaatgctgagtacctgcgggtggccccccagagcagcgagttcatcggggcctag

SEQ ID NO: 19492 - DNA, 3276 bp, Artificial Sequence
  Description of Artificial Sequence: Synthetic coding sequence
atgaggcccagcggcacagctggagctgccctgctggccctgctggccgccctgtgcccagccagccgggccctggaggagaagaaggtgtgccagggcaccagcaacaagctgacccagctgggcacctttgaggaccacttcctgagcctgcagaggatgttcaacaactgtgaggtggtgctgggcaacctggagatcacctacgtgcagaggaactatgacctgtccttcctgaagaccatccaggaggtggccggctacgtgctgattgccctgaacacagtggagcgcatccccctggagaacctgcagatcatccggggcaacatgtactatgagaacagctatgccctggccgtgctgagcaactatgatgccaacaagacaggcctgaaggagctgcccatgaggaacctgcagggccagaagtgtgaccccagctgccccaacggcagctgctggggcgctggggaggagaactgccagaagctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccaggaactacgtggtgacagaccacggcagctgtgtgcgggcctgtggggctgacagctatgagatggaggaggatggagtgaggaagtgcaagaagtgtgagggcccctgcaggaaggtgtgcaatggaattggaattggagagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcttcctgctgatccaggcctggccagaaaatagaacagacctgcacgcctttgagaacctggagatcatccggggccgcaccaagcagcacggccagttcagcctggccgtggtgtccctgaacatcaccagcctgggcctgcggagcctgaaggagatcagtgatggagatgtgatcatcagcggcaacaagaacctgtgctacgccaacaccatcaactggaagaagctgtttggcaccagcggccagaagaccaagatcatcagcaacagaggagagaacagctgcaaggccaccggccaggtgtgccacgccctgtgcagccctgagggctgctggggccctgagccccgggactgtgtgtcctgcagaaatgtgtcccggggcagagaatgtgtggacaagtgcaacctgctggagggggagccccgggagtttgtggagaacagcgagtgcatccagtgccaccctgagtgcctgccccaggccatgaacatcacctgcaccggccggggccctgacaactgcatccagtgtgcccactacattgatggcccccactgtgtgaagacctgcccagctggggtgatgggagagaacaacaccctggtgtggaagtatgcagatgctggccacgtgtgccacctgtgccaccccaactgcacctacggctgcaccggccctggcctggagggctgccccaccaacggccccaagatccccagcatcgccaccggcatggtgggcgccctgctgctgctgctggtggtggccctgggcatcggcctcttcatgagaagaagacacatcgtgaggaagaggaccctgcggcggctgctgcaggagcgggagctggtggagcccctgacccccagcggggaggcccccaaccaggccctgctgcgcatcctgaaggagacagagttcaagaagatcaaggtgctgggcagcggggccttcggcaccgtgtacaagggcctgtggatccctgagggggagaaggtgaagatccctgtggccatcaaggagctgcgggaggccaccagccccaaggccaacaaggagatcctggatgaggcctacgtgatggcctctgtggacaacccccacgtgtgccgcctgctgggcatctgcctgaccagcacagtgcagctgatcacccagctgatgcccttcggctgcctgctggactatgtgcgggagcacaaggacaacatcggcagccagtacctgctgaactggtgtgtgcagatcgccaagggcatgaactacctggaggaccggcggctggtgcaccgggacctggccgccagaaatgtgctggtgaagaccccccagcacgtgaagatcacagactttggcctggccaagctgctgggcgctgaggagaaggagtaccacgccgagggcggcaaggtgcccatcaagtggatggccctggagagcatcctgcaccgcatctacacccaccagagtgatgtgtggagctatggagtgacagtgtgggagctgatgaccttcggcagcaagccctatgatggcatcccagccagcgagatcagcagcatcctggagaagggggagcggctgccccagccccccatctgcaccattgatgtgtacatgatcatggtgaagtgctggatgattgatgctgacagccggcccaagttccgggagctgatcatcgagttcagcaagatggcccgggacccccagcgctacctggtgatccagggagatgagaggatgcacctgcccagccccacagacagcaacttctaccgggccctgatggatgaggaggacatggatgatgtggtggatgctgatgagtacctgatcccccagcagggcttcttcagcagccccagcaccagcaggacccccctgctgagcagcctgagcgccaccagcaacaacagcacagtggcctgcatcgacagaaatggcctgcagagctgccccatcaaggaggacagcttcctgcagcgctacagcagtgaccccactggagccctgacagaggacagcattgatgacaccttcctgcctgtgcctggagagtggctggtgtggaagcagagctgcagcagcaccagcagcacccacagcgctgctgccagcctgcagtgccccagccaggtgctgcccccagccagccctgagggggagaccgtggccgacctgcagacccagtag

SEQ ID NO: 19493 - DNA, 1395 bp, Artificial Sequence
  Description of Artificial Sequence: Synthetic coding sequence
atgagcagcctgaccaagatcatctgtgcccagcagtgcagcggccgctgccggggcaagagccccagcgactgctgccacaaccagtgtgccgccggctgcaccggcccccgggagagtgactgcctggtgtgcaggaagttcagagatgaggccacctgcaaggacacctgcccccccctgatgctgtacaaccccaccacctaccagatggatgtgaaccctgagggcaagtacagctttggagccacctgtgtgaagaagtgccccagaaattatgtggtgacagaccacggcagctgtgtgcgggcctgtggggctgacagctatgagatggaggaggatggagtgaggaagtgcaagaagtgtgagggcccctgcaggaaggtgtgcaatggcatcggcatcggggagttcaaggacagcctgagcatcaatgccaccaacatcaagcacttcaagaactgcaccagcatcagcggggacctgcacatcctgcctgtggccttccggggggacagcttcacccacaccccacccctggacccccaggagctggacatcctgaagacagtgaaggagatcaccggcttcctgctgatccaggcctggccagagaacagaacagacctgcacgcctttgagaacctggagatcatccggggccgcaccaagcagcacggccagttcagcctggccgtggtgtccctgaacatcaccagcctgggcctgcggagcctgaaggagatcagtgatggagatgtgatcatcagcggcaacaagaacctgtgctacgccaacaccatcaactggaagaagctgtttggcaccagcggccagaagaccaagatcatcagcaacagaggagagaacagctgcaaggccaccggccaggtgtgccacgccctgtgcagccctgagggctgctggggccctgagccccgggactgtgtgtcctgcagaaatgtgtcccggggccgggagtgtgtggacaagtgcaacctgctggagggggagccccgggagtttgtggagaacagcgagtgcatccagtgccacccagaatgtctgccccaggccatgaacatcacctgcaccggccggggccctgacaactgcatccagtgtgcccactacattgatggcccccactgtgtgaagacctgcccagctggggtgatgggagagaacaacaccctggtgtggaagtatgcagatgctggccacgtgtgccacctgtgccaccccaactgcacctacggctgcaccggccctggcctggagggctgccccaccaacggccccaagatccccagcatcgccaccggcatggtgggcgccctgctgctgctgctggtggtggccctgggcatcggcctcttcatgagaagatag

SEQ ID NO: 19494 - DNA, 843 bp, Artificial Sequence
  Description of Artificial Sequence: Synthetic coding sequence
atgcctgctgacatcatggagaagaacagcagcagccctgtggccgccaccccagcctctgtgaacaccaccccagacaagcccaagacagccagcgagcacaggaagagcagcaagcccatcatggagaagagaagaagagcccgcatcaatgaaagcctgagccagctgaagaccctcatcctggatgccctgaagaaggacagcagccgccacagcaagctggagaaggctgacatcctggagatgacagtgaagcacctgaggaacctgcagagggcccagatgacagctgccctgagcacagaccccagcgtgctgggcaagtaccgggccggcttcagcgagtgcatgaatgaggtgacccgcttcctgagcacctgtgagggcgtgaacacagaggtgaggacccggctgctgggccacctggccaactgcatgacccagatcaatgccatgacctacccaggccagccccacccagccctgcaggcccctcctcctcctcctcctggccctgggggcccccagcacgccccctttgcccctcctccacccctggtgcccatccctggaggagctgcccctcctcctgggggcgccccctgcaagctgggcagccaggccggggaggccgccaaggtgtttggaggcttccaggtggtgcctgccccagatggccagtttgccttcctgatccccaatggagcctttgcccacagcggccctgtgattcctgtgtacaccagcaacagcggcacctctgtgggccccaatgctgtgagccccagcagcggccccagcctgacagctgacagcatgtggaggccctggagaaattag

SEQ ID NO: 19495 - DNA, 57 bp, Artificial Sequence
  Description of Artificial Sequence: Synthetic coding sequence
atggctgaaaattctgtgctgaccagcaccactggaagaaccagcctggccgactag

SEQ ID NO: 19496 - DNA, 2745 bp, Artificial Sequence
  Description of Artificial Sequence: Synthetic coding sequence
atggctgaaaattctgtgctgaccagcaccactggaagaaccagcctggccgacagcagcatctttgacagcaaggtgacagagatcagcaaggagaacctgctgattggcagcaccagctatgtggaggaggagatgccccagatcgagaccagggtcatcctggtgcaggaggccggcaagcaggaggagctgatcaaggccctgaagaccatcaagatcatggaggtgcctgtgatcaagatcaaggagagctgccctgggaagagtgatgagaagctgatcaagagcgtcatcaacatggacatcaaggtgggctttgtgaagatggagagcgtggaggagtttgagggcctggacagccctgagtttgaaaatgtgtttgtggtgacagacttccaggacagcgtcttcaatgacctgtacaaggctgactgccgggtgattggcccccctgtggtgctgaactgcagccagaagggggagcccctgcccttcagctgccggcccctgtactgcacctccatgatgaacctggtgctgtgcttcaccggcttcaggaagaaggaggagctggtgcggctggtgaccctggtgcaccacatgggcggcgtcatcaggaaggacttcaacagcaaggtgacccacctggtggccaactgcacccagggcgagaagttccgggtggccgtgtccctgggcacccccatcatgaagccagagtggatctacaaggcctgggagaggagaaatgagcaggacttctatgctgctgtggatgacttcagaaatgagttcaaggtgccccccttccaggactgcatcctgtccttcctgggcttcagtgatgaggagaagaccaacatggaggagatgacagagatgcagggcggcaagtacctgcccctgggagatgagcgctgcacccacctggtggtggaggagaacatcgtgaaggacctgccctttgagcccagcaagaagctgtatgtggtgaagcaggagtggttctggggcagcatccagatggatgcccgggccggggagaccatgtacctgtatgagaaggccaacaccccagagctgaagaagtctgtgtccatgctgagcctgaacacccccaacagcaacaggaagagaagaaggctgaaggagaccctggcccagctgagccgggagacagatgtgagccccttcccccccaggaagaggcccagcgctgagcacagcctgagcatcggcagcctgctggacatcagcaacaccccagagagcagcatcaactatggagacacccccaagagctgcaccaagagcagcaagagcagcacccctgtgcccagcaagcagagcgcccgctggcaggtggccaaggagctgtaccagacagagagcaactacgtgaacatcctggccaccatcatccagctgttccaggtgcccctggaggaggagggccagagaggaggccccatcctggcccctgaggagatcaagaccatcttcggcagcatcccagacatctttgatgtgcacaccaagatcaaggatgacctggaggacctgattgtgaactgggatgagagcaagagcatcggggacatcttcctgaagtacagcaaggacctggtgaagacctaccccccatttgtgaacttctttgagatgagcaaggagaccatcatcaagtgtgagaagcagaagccccgcttccacgccttcctgaagatcaaccaggccaagccagaatgtggccggcagagcctggtggagctgctgatccggcctgtgcagaggctgcccagcgtggccctgctgctgaatgacctgaagaagcacacagcagatgaaaatccagacaagagcaccctggagaaggccatcggcagcctgaaggaggtgatgacccacatcaatgaagacaagaggaagacagaggcccagaagcagatctttgatgtggtgtatgaggtggatggctgcccagccaacctgctgagcagccacaggagcctggtgcagagggtggagaccatcagcctgggggagcacccctgtgacagaggagagcaggtgaccctcttcctgttcaatgactgcctggagatcgccaggaagaggcacaaggtgattggcaccttccgcagcccccacggccagacccggcccccagccagcctgaagcacatccacctgatgcccctgagccagatcaagaaggtgctggacatccgggagacagaggactgccacaatgcctttgccctgctggtgcggcccccaacagagcaggccaacgtgctgctgtccttccagatgaccagtgatgagctgcccaaggagaactggctgaagatgctgtgccgccacgtggccaacaccatctgcaaggcagatgctgaaaatctcatctacacagctgaccctgagagctttgaggtgaacaccaaggacatggacagcaccctgagccgggccagccgggccatcaagaagaccagcaagaaggtgacccgggccttctccttcagcaagacccccaagagggccctgcggcgggccctgatgaccagccacggctctgtggagggccgcagccccagcagcaatgacaagcacgtgatgagccggctgagcagcaccagcagcctggccggcatccccagccccagcctggtgtccctgcccagcttctttgaaagaagaagccacaccctgagccgcagcaccacccacctgatctag

SEQ ID NO: 19497 - DNA, 480 bp, Artificial Sequence
  Description of Artificial Sequence: Synthetic coding sequence
atggctgaaaattctgtgctgaccagcaccactggaagaaccagcctggccgacagcagcatctttgacagcaaggtgacagagatcagcaaggagaacctgctgattggcagcaccagctatgtggaggaggagatgccccagatcgagaccagggtcatcctggtgcaggaggccggcaagcaggaggagctgatcaaggccctgaaggacatcaaggtgggctttgtgaagatggagagcgtggaggagtttgagggcctggacagccctgagtttgaaaatgtgtttgtggtgacagacttccaggacagcgtcttcaatgacctgtacaaggctgactgcagggtcatcggcccccctgtggtgctgaactgcagccagaagggggagcccctgcccttcagctgccggcccctgtactgcacctccatgatgaacctggtgctgtgcttcaccggcttcaggaagaaggagtag

SEQ ID NO: 19498 - DNA, 2649 bp, Artificial Sequence
  Description of Artificial Sequence: Synthetic coding sequence
atggctgaaaattctgtgctgaccagcaccactggaagaaccagcctggccgacagcagcatctttgacagcaaggtgacagagatcagcaaggagaacctgctgattggcagcaccagctatgtggaggagatgccccagatcgagaccagggtcatcctggtgcaggaggccggcaagcaggaggagctgatcaaggccctgaaggacatcaaggtgggctttgtgaagatggagagcgtggaggagtttgagggcctggacagccctgagtttgaaaatgtgtttgtggtgacagacttccaggacagcgtcttcaatgacctgtacaaggctgactgccgggtgattggcccccctgtggtgctgaactgcagccagaagggggagcccctgcccttcagctgccggcccctgtactgcacctccatgatgaacctggtgctgtgcttcaccggcttcaggaagaaggaggagctggtgcggctggtgaccctggtgcaccacatgggcggcgtcatcaggaaggacttcaacagcaaggtgacccacctggtggccaactgcacccagggcgagaagttccgggtggccgtgtccctgggcacccccatcatgaagccagagtggatctacaaggcctgggagaggagaaatgagcaggacttctatgctgctgtggatgacttcagaaatgagttcaaggtgccccccttccaggactgcatcctgtccttcctgggcttcagtgatgaggagaagaccaacatggaggagatgacagagatgcagggcggcaagtacctgcccctgggagatgagcgctgcacccacctggtggtggaggagaacatcgtgaaggacctgccctttgagcccagcaagaagctgtatgtggtgaagcaggagtggttctggggcagcatccagatggatgcccgggccggggagaccatgtacctgtatgagaaggccaacaccccagagctgaagaagtctgtgtccatgctgagcctgaacacccccaacagcaacaggaagagaagaaggctgaaggagaccctggcccagctgagccgggagacagatgtgagccccttcccccccaggaagaggcccagcgctgagcacagcctgagcatcggcagcctgctggacatcagcaacaccccagagagcagcatcaactatggagacacccccaagagctgcaccaagagcagcaagagcagcacccctgtgcccagcaagcagagcgcccgctggcaggtggccaaggagctgtaccagacagagagcaactacgtgaacatcctggccaccatcatccagctgttccaggtgcccctggaggaggagggccagagaggaggccccatcctggcccctgaggagatcaagaccatcttcggcagcatcccagacatctttgatgtgcacaccaagatcaaggatgacctggaggacctgattgtgaactgggatgagagcaagagcatcggggacatcttcctgaagtacagcaaggacctggtgaagacctaccccccatttgtgaacttctttgagatgagcaaggagaccatcatcaagtgtgagaagcagaagccccgcttccacgccttcctgaagatcaaccaggccaagccagaatgtggccggcagagcctggtggagctgctgatccggcctgtgcagaggctgcccagcgtggccctgctgctgaatgacctgaagaagcacacagcagatgaaaatccagacaagagcaccctggagaaggccatcggcagcctgaaggaggtgatgacccacatcaatgaagacaagaggaagacagaggcccagaagcagatctttgatgtggtgtatgaggtggatggctgcccagccaacctgctgagcagccacaggagcctggtgcagagggtggagaccatcagcctgggggagcacccctgtgacagaggagagcaggtgaccctcttcctgttcaatgactgcctggagatcgccaggaagaggcacaaggtgattggcaccttccgcagcccccacggccagacccggcccccagccagcctgaagcacatccacctgatgcccctgagccagatcaagaaggtgctggacatccgggagacagaggactgccacaatgcctttgccctgctggtgcggcccccaacagagcaggccaacgtgctgctgtccttccagatgaccagtgatgagctgcccaaggagaactggctgaagatgctgtgccgccacgtggccaacaccatctgcaaggcagatgctgaaaatctcatctacacagctgaccctgagagctttgaggtgaacaccaaggacatggacagcaccctgagccgggccagccgggccatcaagaagaccagcaagaaggtgacccgggccttctccttcagcaagacccccaagagggccctgcggcgggccctgatgaccagccacggctctgtggagggccgcagccccagcagcaatgacaagcacgtgatgagccggctgagcagcaccagcagcctggccggcatccccagccccagcctggtgtccctgcccagcttctttgaaagaagaagccacaccctgagccgcagcaccacccacctgatctag

SEQ ID NO: 19499 - DNA, 321 bp, Artificial Sequence
  Description of Artificial Sequence: Synthetic coding sequence
atggctgaaaattctgtgctgaccagcaccactggaagaaccagcctggccgacagcagcatctttgacagcaaggtgacagagatcagcaaggagaacctgctgattggcagcaccagctatgtggaggaggagatgccccagatcgagaccagggtcatcctggtgcaggaggccggcaagcaggaggagctgatcaaggccctgaaggacatcaaggtgggctttgtgaagatggagagcgtggaggagtttgagggcctggacagccctgagtttgaaaatgtgtttgtggtgacagacttccaggacagcgtgtag

SEQ ID NO: 19500 - DNA, 2784 bp, Artificial Sequence
  Description of Artificial Sequence: Synthetic coding sequence
atggctgaaaattctgtgctgaccagcaccactggaagaaccagcctggccgacagcagcatctttgacagcaaggtgacagagatcagcaaggagaacctgctgattggcagcaccagctatgtggaggaggagatgccccagatcgagaccagggtcatcctggtgcaggaggccggcaagcaggaggagctgatcaaggccctgaaggacatcaaggtgggctttgtgaagatggagagcgtggaggagtttgagggcctggacagccctgagtttgaaaatgtgtttgtggtgacagacttccaggacagcgtcttcaatgacctgtacaaggctgactgcagggtcatcggcccccctgtggtgctgaactgcagccagaagggggagcccctgcccttcagctgccggcccctgtactgcacctccatgatgaacctggtgctgtgcttcaccggcttcaggaagaaggaggagctggtgcggctggtgaccctggtgcaccacatgggcggcgtcatcaggaaggacttcaacagcaaggtgacccacctggtggccaactgcacccagggcgagaagttccgggtggccgtgtccctgggcacccccatcatgaagccagagtggatctacaaggcctgggagaggagaaatgagcaggacttctacgccgctgtggatgacttcagaaatgagttcaaggtgccccccttccaggactgcatcctgtccttcctgggcttcagtgatgaggagaagaccaacatggaggagatgacagagatgcagggcggcaagtacctgcccctgggagatgagcgctgcacccacctggtggtggaggagaacatcgtgaaggacctgccctttgagcccagcaagaagctgtatgtggtgaagcaggagtggttctggggcagcatccagatggatgcccgggccggggagaccatgtacctgtatgagaaggccaacaccccagagctgaagaagtctgtgtccatgctgagcctgaacacccccaacagcaacaggaagagaagaaggctgaaggagaccctggcccagctgagccgggagacagatgtgagccccttcccccccaggaagaggccttctgctgagcacagcctgagcatcggcagcctgctggacatcagcaacaccccagagagcagcatcaactacggggacacccccaagagctgcaccaagagcagcaagagcagcacccctgtgcccagcaagcagagcgcccgctggcaggtggccaaggagctgtaccagacagagagcaactacgtgaacatcctggccaccatcatccagctgttccaggtgcccctggaggaggagggccagaggggcggccccatcctggcccctgaggagatcaagaccatcttcggcagcatcccagacatctttgatgtgcacaccaagatcaaggatgacctggaggacctgattgtgaactgggatgagagcaagagcattggagacatcttcctgaagtacagcaaggacctggtgaagacctaccccccatttgtgaacttctttgagatgagcaaggagaccatcatcaagtgtgagaagcagaagccccgcttccacgccttcctgaagatcaaccaggccaagccagaatgtggccggcagagcctggtggagctgctgatccggcctgtgcagaggctgcccagcgtggccctgctgctgaatgacctgaagaagcacacagcagatgagaacccagacaagagcaccctggagaaggccatcggcagcctgaaggaggtgatgacccacatcaatgaagacaagaggaagacagaggcccagaagcagatctttgatgtggtgtatgaggtggatggctgcccagccaacctgctgagcagccacaggagcctggtgcagagggtggagaccatcagcctgggggagcacccctgtgacagaggagagcaggtgaccctcttcctgttcaatgactgcctggagatcgccaggaagaggcacaaggtgattggcaccttccgcagcccccacggccagacccggcccccagccagcctgaagcacatccacctgatgcccctgagccagatcaagaaggtgctggacatccgggagacagaggactgccacaatgcctttgccctgctggtgcggcccccaacagagcaggccaacgtgctgctgtccttccagatgaccagtgatgagctgcccaaggagaactggctgaagatgctgtgcagacatgtggccaacaccatctgcaaggcagatgctgagaacctgatctacacagctgaccctgagagctttgaggtgaacaccaaggacatggacagcaccctgagccgggccagccgggccatcaagaagaccagcaagaaggtgacccgggccttctccttcagcaagacccccaagagggccctgcggcgggccctgatgaccagccacggctctgtggagggccgcagccccagcagcaatgacaagcacgtgatgagccggctgagcagcaccagcagcctggccatcacccacagcgtgtccaccagcaatgtgattggcttcaccaagcacgtgtatgtgcagaggctgaacagcactggaggccgcagccagtacagctggttccagagcgtgcgccacagcgccttccgggccagcttcagcgagatcctggagggcaacacagacttcagcaacttcaagaaggtgctgagcaagagcagcctgacctttgtgaagaactag

SEQ ID NO: 19501 - DNA, 2652 bp, Artificial Sequence
  Description of Artificial Sequence: Synthetic coding sequence
atggctgaaaattctgtgctgaccagcaccactggaagaaccagcctggccgacagcagcatctttgacagcaaggtgacagagatcagcaaggagaacctgctgattggcagcaccagctatgtggaggaggagatgccccagatcgagaccagggtcatcctggtgcaggaggccggcaagcaggaggagctgatcaaggccctgaaggacatcaaggtgggctttgtgaagatggagagcgtggaggagtttgagggcctggacagccctgagtttgaaaatgtgtttgtggtgacagacttccaggacagcgtcttcaatgacctgtacaaggctgactgcagggtcatcggcccccctgtggtgctgaactgcagccagaagggggagcccctgcccttcagctgccggcccctgtactgcacctccatgatgaacctggtgctgtgcttcaccggcttcaggaagaaggaggagctggtgcggctggtgaccctggtgcaccacatgggcggcgtcatcaggaaggacttcaacagcaaggtgacccacctggtggccaactgcacccagggcgagaagttccgggtggccgtgtccctgggcacccccatcatgaagccagagtggatctacaaggcctgggagaggagaaatgagcaggacttctacgccgctgtggatgacttcagaaatgagttcaaggtgccccccttccaggactgcatcctgtccttcctgggcttcagtgatgaggagaagaccaacatggaggagatgacagagatgcagggcggcaagtacctgcccctgggagatgagcgctgcacccacctggtggtggaggagaacatcgtgaaggacctgccctttgagcccagcaagaagctgtatgtggtgaagcaggagtggttctggggcagcatccagatggatgcccgggccggggagaccatgtacctgtatgagaaggccaacaccccagagctgaagaagtctgtgtccatgctgagcctgaacacccccaacagcaacaggaagagaagaaggctgaaggagaccctggcccagctgagccgggagacagatgtgagccccttcccccccaggaagaggccttctgctgagcacagcctgagcatcggcagcctgctggacatcagcaacaccccagagagcagcatcaactacggggacacccccaagagctgcaccaagagcagcaagagcagcacccctgtgcccagcaagcagagcgcccgctggcaggtggccaaggagctgtaccagacagagagcaactacgtgaacatcctggccaccatcatccagctgttccaggtgcccctggaggaggagggccagaggggcggccccatcctggcccctgaggagatcaagaccatcttcggcagcatcccagacatctttgatgtgcacaccaagatcaaggatgacctggaggacctgattgtgaactgggatgagagcaagagcattggagacatcttcctgaagtacagcaaggacctggtgaagacctaccccccatttgtgaacttctttgagatgagcaaggagaccatcatcaagtgtgagaagcagaagccccgcttccacgccttcctgaagatcaaccaggccaagccagaatgtggccggcagagcctggtggagctgctgatccggcctgtgcagaggctgcccagcgtggccctgctgctgaatgacctgaagaagcacacagcagatgagaacccagacaagagcaccctggagaaggccatcggcagcctgaaggaggtgatgacccacatcaatgaagacaagaggaagacagaggcccagaagcagatctttgatgtggtgtatgaggtggatggctgcccagccaacctgctgagcagccacaggagcctggtgcagagggtggagaccatcagcctgggggagcacccctgtgacagaggagagcaggtgaccctcttcctgttcaatgactgcctggagatcgccaggaagaggcacaaggtgattggcaccttccgcagcccccacggccagacccggcccccagccagcctgaagcacatccacctgatgcccctgagccagatcaagaaggtgctggacatccgggagacagaggactgccacaatgcctttgccctgctggtgcggcccccaacagagcaggccaacgtgctgctgtccttccagatgaccagtgatgagctgcccaaggagaactggctgaagatgctgtgcagacatgtggccaacaccatctgcaaggcagatgctgagaacctgatctacacagctgaccctgagagctttgaggtgaacaccaaggacatggacagcaccctgagccgggccagccgggccatcaagaagaccagcaagaaggtgacccgggccttctccttcagcaagacccccaagagggccctgcggcgggccctgatgaccagccacggctctgtggagggccgcagccccagcagcaatgacaagcacgtgatgagccggctgagcagcaccagcagcctggccggcatccccagccccagcctggtgtccctgcccagcttctttgagcggcgcagccacaccctgagccgcagcaccacccacctgatctag

SEQ ID NO: 19502 - DNA, 2745 bp, Artificial Sequence; identical to SEQ ID NO: 19496
  Description of Artificial Sequence: Synthetic coding sequence

SEQ ID NO: 19503 - DNA, 1389 bp, Artificial Sequence
  Description of Artificial Sequence: Synthetic coding sequence
atgagcattgctggggtggccgcccaggagatccgggtgcccctgaagacaggcttcctgcacaacggccgggccatgggcaacatgaggaagacctactggagcagccgctctgagttcaagaacaacttcctgaacatcgaccccatcaccatggcctacagcctgaacagcagcgcccaggagcggctcatccccctgggccacgccagcaagagcgcccccatgaatggccactgctttgctgaaaatggccccagccagaagagcagcctgccccccctgctgatccccccatctgagaacctgggcccccatgaggaggaccaggtggtgtgtggcttcaagaagctgactgtgaatggagtgtgtgccagcaccccacccctgacccccatcaagaacagccccagcctcttcccctgtgcccccctgtgtgagcggggcagccggcccctgccccccctgcccatcagcgaggccctgagcctggatgacacagactgtgaggtggagttcctgaccagcagtgacacagacttcctgctggaggacagcaccctgagtgacttcaagtatgatgtgcccggccgccgctccttccggggctgcggccagatcaactatgcctactttgacaccccagctgtgtctgctgctgacctgtcctatgtgtctgaccagaatggaggagtgcctgaccccaaccccccaccaccccagacccaccggcggctgcggcgcagccacagcggccctgctggcagcttcaacaagccagccatccgcatcagcaactgctgcatccaccgggccagccccaacagtgatgaggacaagccagaggtgcccccccgggtgcccatcccccccaggcctgtgaagccagactaccgccgctggagcgctgaggtgaccagcagcacctacagtgatgaagatcggccccccaaggtgcccccccgggagcccctgagccccagcaacagcaggacccccagccccaagagcctgcccagctacctgaatggagtgatgccacccacccagagctttgccccagaccccaagtatgtgagcagcaaggccctgcagaggcagaacagcgagggcagcgccagcaaggtgccctgcatcctgcccatcattgaaaatggcaagaaggtgagcagcacccactactacctgctgcctgagaggcctccctacctggacaagtatgagaagttcttccgggaggccgaggagaccaacggcggggcccagatccagcccctgcctgctgactgtggcatcagcagcgccacagagaagccagacagcaagaccaagatggacctgggcggccacgtgaagaggaagcacctgtcctatgtggtgagcccctag

SEQ ID NO: 19504 - DNA, 1713 bp, Artificial Sequence
  Description of Artificial Sequence: Synthetic coding sequence
atggccctgaagaagagcagccccagcctggacagcggggacagcgacagcgaggagctgcccacctttgccttcctgaagaaggagcccagcagcaccaagaggcggcagcctgagcgggaggagaagatcgtggtggtggacatcagtgactgtgaggccagctgccccccagcccctgagctgttcagcccccctgtgcctgagattgctgagaccgtgacccagacccagcctgtgcggctgctgagcagcgagagtgaagatgaggaggagttcatccccctggcccagaggctgacctgcaagttcctgacccacaagcagctgagccctgaggacagcagcagccctgtgaagtctgtgctggaccaccagaacaatgaaggagccagctgtgactggaagaagcccttccccaagatccctgaggtgcccctgcatgacaccccagagaggtctgctgctgacaacaaggacctgatcctggacccctgctgccagctgcctgcctacctgagcacctgccccggccagagcagcagcctggccgtgaccaagaccaacagcgacatcctgcccccccagaagaagaccaagcccagccagaaggtgcagggccggggcagccacggctgccggcagcagaggcaggcccggcagaaggagagcaccctgcggcggcaggagaggaagaatgctgccctggtgaccaggatgaaggcccagaggccagaagaatgtctgaagcacatcatcgtggtgctggaccctgtgctgctgcagatggagggcggcggccagctgctgggcgccctgcagaccatggagtgccgctgcgtcatcgaggcccaggccgtgccctgcagcgtgacctggaggagaagagctggccccagtgaagatcgggaggactgggtggaggagcccaccgtgctggtgctgctgcgggcagaggcctttgtgtccatgattgacaatggcaagcagggcagcctggacagcaccatgaagggcaaggagaccctgcagggctttgtgacagacatcacagccaagacagctgggaaggccctgagcctggtgattgtggaccaggagaagtgcttcagcgcccagaaccccccaagaagaggcaagcagggcgccaacaagcagaccaagaagcagcagcagaggcagcctgaggccagcatcggctccatggtgtcccgggtggatgctgaggaggccctggtggacctgcagctgcacacagaggcccaggcccagatcgtgcagagctggaaggagctggccgacttcacctgtgccttcaccaaggctgtggccgaggcccccttcaagaagctgagagatgagaccaccttctccttctgcctggagagtgactgggccggcggcgtgaaggtggacctggccggccggggcctggccctggtgtggaggcggcagatccagcagctgaacagagtgtccctggagatggccagcgctgtggtgaatgcctaccccagcccccagctgctggtgcaggcctaccagcagtgcttcagtgacaaggagcggcagaacctgctggccgacatccaggtgagaagaggagaaggagtgaccagcaccagcagaagaattggccctgagctgagccgccgcatctacctgcagatgaccaccctgcagccccacctgagcctggacagcgctgactag

SEQ ID NO: 19505 - DNA, 1752 bp, Artificial Sequence
  Description of Artificial Sequence: Synthetic coding sequence
atggccctgaagaagagcagccccagcctggacagcggggacagcgacagcgaggagctgcccacctttgccttcctgaagaaggagcccagcagcaccaagaggcggcagcctgagcgggaggagaagatcgtggtggtggacatcagtgactgtgaggccagctgccccccagcccctgagctgttcagcccccctgtgcctgagattgctgagaccgtgacccagacccagcctgtgcggctgctgagcagcgagagtgaagatgaggaggagttcatccccctggcccagaggctgacctgcaagttcctgacccacaagcagctgagccctgaggacagcagcagccctgtgaagtctgtgctggaccaccagaacaatgaaggagccagctgtgactggaagaagcccttccccaagatccctgaggtgcccctgcatgacaccccagagaggtctgctgctgacaacaaggacctgatcctggacccctgctgccagctgcctgcctacctgagcacctgccccggccagagcagcagcctggccgtgaccaagaccaacagcgacatcctgcccccccagaagaagaccaagcccagccagaaggtgcagggccggggcagccacggctgccggcagcagaggcaggcccggcagaaggagagcaccctgcggcggcaggagaggaagaatgctgccctggtgaccaggatgaaggcccagaggccagaagaatgtctgaagcacatcatcgtggtgctggaccctgtgctgctgcagatggagggcggcggccagctgctgggcgccctgcagaccatggagtgccgctgcgtcatcgaggcccaggccgtgccctgcagcgtgacctggaggagaagagctggccccagtgaagatcgggaggactgggtggaggagcccaccgtgctggtgctgctgcgggcagaggcctttgtgtccatgattgacaatggcaagcagggcagcctggacagcaccatgaagggcaaggagaccctgcagggctttgtgacagacatcacagccaagacagctgggaaggccctgagcctggtgattgtggaccaggagaagtgcttcagcctggagctgctcttctttgacttcctgccctgcaccagcgcccagaaccccccccggcggggcaagcagggcgccaacaagcagaccaagaagcagcagcagaggcagcctgaggccagcatcggctccatggtgtcccgggtggatgctgaggaggccctggtggacctgcagctgcacacagaggcccaggcccagatcgtgcagagctggaaggagctggccgacttcacctgtgccttcaccaaggctgtggccgaggcccccttcaagaagctgagagatgagaccaccttctccttctgcctggagagtgactgggccggcggcgtgaaggtggacctggccggccggggcctggccctggtgtggaggcggcagatccagcagctgaacagagtgtccctggagatggccagcgctgtggtgaatgcctaccccagcccccagctgctggtgcaggcctaccagcagtgcttcagtgacaaggagcggcagaacctgctggccgacatccaggtgcggcggggggagggcgtgaccagcaccagccgccgcatcggccctgagctgagccgccgcatctacctgcagatgaccaccctgcagccccacctgagcctggacagcgctgactag

SEQ ID NO: 19506 - DNA, 1752 bp, Artificial Sequence; identical to SEQ ID NO: 19505
  Description of Artificial Sequence: Synthetic coding sequence

SEQ ID NO: 19507 - DNA, 684 bp, Artificial Sequence
  Description of Artificial Sequence: Synthetic coding sequence
atggctgacctgctgggcagcatcctgagctccatggagaagccacccagcctgggggaccaggagaccaggaggaaggcccgggagcaggccgcccggctgaagaagctgcaggagcaggagaagcagcagaaggtggagttcaggaagaggatggagaaggaggtgtctgacttcatccaggacagcggccagatcaagaagaagttccagcccatgaacaagattgaaagaagcatcctgcatgatgtggtggaggtggccggcctgaccagcttctcctttggagaagatgatgactgccgctacgtgatgatcttcaagaaggagtttgcccccagtgatgaggagctggacagctaccgccgcggggaggagtgggacccccagaaggccgaggagaagaggaagctgaaggagctggcccagaggcaggaggaggaggccgcccagcagggccctgtggtggtgtccccagccagtgactacaaggacaagtacagccacctgattggaaaaggagctgccaaggatgctgcccacatgctgcaggccaacaagacctacggctgtgtgcctgtggccaacaagagggacaccaggagcattgaggaggccatgaatgagatccgggccaagaagaggctgcggcagagcggggaggagctgccccccaccagctag

SEQ ID NO: 19508 - DNA, 1788 bp, Artificial Sequence
  Description of Artificial Sequence: Synthetic coding sequence
atgaccatgaccctgcacaccaaggccagcggcatggccctgctgcaccagatccagggcaatgagctggagcccctgaaccggccccagctgaagatccccctggagcggcccctgggggaggtgtacctggacagcagcaagccagctgtgtacaactacccagagggcgccgcctatgagttcaatgctgctgctgctgccaatgcccaggtgtatggccagacaggcctgccctacggccctggcagcgaggccgccgccttcggcagcaatggcctgggcggcttcccccccctgaacagcgtgagccccagccccctgatgctgctgcaccccccaccccagctgagccccttcctgcagccccacggccagcaggtgccctactacctggagaatgagcccagcggctacacagtgcgggaggccggccccccagccttctaccggcccaacagcgacaacagacggcagggcggccgggagcggctggccagcaccaatgacaagggctccatggccatggagagcgccaaggagacccgctactgtgctgtgtgcaatgactatgccagcggctaccactatggagtgtggagctgtgagggctgcaaggccttcttcaagaggagcatccagggccacaatgactacatgtgcccagccaccaaccagtgcaccatcgacaagaacagaaggaagagctgccaggcctgccgcctgaggaagtgctatgaggtgggcatgatgaagggcggcatcaggaaggacagaagaggaggccgcatgctgaagcacaagaggcagagagatgatggagagggccgcggggaggtgggcagcgctggggacatgagagctgccaacctgtggcccagccccctgatgatcaagaggagcaagaagaacagcctggccctgagcctgacagctgaccagatggtgtctgccctgctggatgctgagccccccatcctgtacagtgaatatgaccccacccggcccttcagcgaggcctccatgatgggcctgctgaccaacctggccgaccgggagctggtgcacatgatcaactgggccaagagggtgcccggctttgtggacctgaccctgcatgaccaggtgcacctgctggagtgtgcctggctggagatcctgatgattggcctggtgtggaggtccatggagcaccctgggaagctgctgtttgcccccaacctgctgctggacaggaaccagggcaaatgtgtggagggcatggtggagatctttgacatgctgctggccaccagcagccgcttcaggatgatgaacctgcagggcgaggagtttgtgtgcctgaagagcatcatcctgctgaacagcggcgtgtacaccttcctgagcagcaccctgaagagcctggaggagaaggaccacatccaccgggtgctggacaagatcacagacaccctcatccacctgatggccaaggccggcctgaccctgcagcagcagcaccagaggctggcccagctgctgctgatcctgagccacatccgccacatgagcaacaagggcatggagcacctgtacagcatgaagtgcaagaatgtggtgcccctgtatgacctgctgctggagatgctggatgcccaccggctgcacgcccccaccagccggggcggggcctctgtggaggagacagaccagagccacctggccacagctggcagcaccagcagccacagcctgcagaagtactacatcactggagaggccgagggcttccctgccaccgtgtag

SEQ ID NO: 19509 - DNA, 549 bp, Artificial Sequence
  Description of Artificial Sequence: Synthetic coding sequence
atggagagcgccaaggagacccgctactgtgctgtgtgcaatgactatgccagcggctaccactacggcgtgtggagctgtgagggctgcaaggccttcttcaagaggagcatccagggccacaatgactacatgtgcccagccaccaaccagtgcaccatcgacaagaacagaaggaagagctgccaggcctgccgcctgaggaaatgttatgaggtgggcatgatgaagggcggcatcaggaaggaccggcggggcggccgcatgctgaagcacaagctgctgctgatcctgagccacatccgccacatgagcaacaagggcatggagcacctgtacagcatgaagtgcaagaatgtggtgcccctgtatgacctgctgctggagatgctggatgcccaccggctgcacgcccccaccagcagaggaggagcctctgtggaggagacagaccagagccacctggccacagctggcagcaccagcagccacagcctgcagaagtactacatcaccggggaggccgagggcttccctgccaccgtgtag

SEQ ID NO: 19510 - DNA, 255 bp, Artificial Sequence
  Description of Artificial Sequence: Synthetic coding sequence
atgaccatgaccctgcacaccaaggccagcggcatggccctgctgcaccagatccagggcaatgagctggagcccctgaaccggccccagctgaagatccccctggagcggcccctgggggaggtgtacctggacagcagcaagccagctgtgtacaactacccagagggcgccgcctatgagttcaatgctgctgctgctgccaatgcccaggtgtatggccagacaggcctgccctacggccctggcagctag

SEQ ID NO: 19511 - DNA, 1005 bp, Artificial Sequence
  Description of Artificial Sequence: Synthetic coding sequence
atgaccatgaccctgcacaccaaggccagcggcatggccctgctgcaccagatccagggcaatgagctggagcccctgaaccggccccagctgaagatccccctggagcggcccctgggggaggtgtacctggacagcagcaagccagctgtgtacaactacccagagggcgccgcctatgagttcaatgctgctgctgctgccaatgcccaggtgtatggccagacaggcctgccctacggccctggcagcgaggccgccgccttcggcagcaatggcctgggcggcttcccccccctgaacagcgtgagccccagccccctgatgctgctgcaccccccaccccagctgagccccttcctgcagccccacggccagcaggtgccctactacctggagaatgagcccagcggctacacagtgcgggaggccggccccccagccttctacagaaaccagggcaaatgtgtggagggcatggtggagatctttgacatgctgctggccaccagcagccgcttcaggatgatgaacctgcagggcgaggagtttgtgtgcctgaagagcatcatcctgctgaacagcggcgtgtacaccttcctgagcagcaccctgaagagcctggaggagaaggaccacatccaccgggtgctggacaagatcacagacaccctcatccacctgatggccaaggccggcctgaccctgcagcagcagcaccagaggctggcccagctgctgctgatcctgagccacatccgccacatgagcaacaagggcatggagcacctgtacagcatgaagtgcaagaatgtggtgcccctgtatgacctgctgctggagatgctggatgcccaccggctgcacgcccccaccagcagaggaggagcctctgtggaggagacagaccagagccacctggccacagctggcagcaccagcagccacagcctgcagaagtactacatcaccggggaggccgagggcttccctgccaccgtgtag

SEQ ID NO: 19512 - DNA, 324 bp, Artificial Sequence
  Description of Artificial Sequence: Synthetic coding sequence
cacaatgactacatgtgcccagccaccaaccagtgcaccatcgacaagaacagaaggaagagctgccaggcctgccgcctgaggaaatgttatgaggtgggcatgatgaagggcggctttgtggacctgaccctgcatgaccaggtgcacctgctggagtgtgcctggctggagatcctgatgattggcctggtgtggaggtccatggagcaccctgggaagctgctgtttgcccccaacctgctgctggacaggaaccagggcaaatgtgtggagggcatggtggagatctttgacatgctgctggccaccagcagcaggtag

SEQ ID NO: 19513 - DNA, 1167 bp, Artificial Sequence
  Description of Artificial Sequence: Synthetic coding sequence
tgactgaagatcatcagctgccagcccagcgacaagcctgtgcccccaggagaaaatgcccctgagtggagggctggccagcccggcagcgcccccaggagccactgcggccgctctgctgctggccctggccaccggcggcccctgtgtgacttcaatggagagggccccaacagcgacaacagacggcagggcggccgggagcggctggccagcaccaatgacaagggctccatggccatggagagcgccaaggagacccgctactgtgctgtgtgcaatgactatgccagcggctaccactacggcgtgtggagctgtgagggctgcaaggccttcttcaagaggagcatccagggccacaatgactacatgtgcccagccaccaaccagtgcaccatcgacaagaacagaaggaagagctgccaggcctgccgcctgaggaaatgttatgaggtgggcatgatgaagggcggcatcaggaaggaccggcggggcggccgcatgctgaagcacaagaggcagagagatgatggagagggccgcggggaggtgggcagcgctggggacatgagagctgccaacctgtggcccagccccctgatgatcaagaggagcaagaagaacagcctggccctgagcctgacagctgaccagatggtgtctgccctgctggatgctgagccccccatcctgtacagtgaatatgaccccacccggcccttcagcgaggcctccatgatgggcctgctgaccaacctggccgaccgggagctggtgcacatgatcaactgggccaagagggtgcccggctttgtggacctgaccctgcatgaccaggtgcacctgctggagtgtgcctggctggagatcctgatgattggcctggtgtggaggtccatggagcaccctgggaagctgctgtttgcccccaacctgctgctggacaggaaccagggcaaatgtgtggagggcatggtggagatctttgacatgctgctggccaccagcagccgcttcaggatgatgaacctgcagggcgaggagtttgtgtgcctgaagagcatcatcctgctgaacagcggcatcagccacgtggaggccaagaagaggatcctgaacctgcaccccaagatcttcggcaacaagtggttcccccgggtgtag

SEQ ID NO: 19514 - DNA, 813 bp, Artificial Sequence
  Description of Artificial Sequence: Synthetic coding sequence
atgtgcccagccaccaaccagtgcaccatcgacaagaacagaaggaagagctgccaggcctgccgcctgaggaaatgttatgaggtgggcatgatgaagggcggcatcaggaaggaccggcggggcggccgcatgctgaagcacaagaggcagagagatgatggagagggccgcggggaggtgggcagcgctggggacatgagagctgccaacctgtggcccagccccctgatgatcaagaggagcaagaagaacagcctggccctgagcctgacagctgaccagatggtgtctgccctgctggatgctgagccccccatcctgtacagtgaatatgaccccacccggcccttcagcgaggcctccatgatgggcctgctgaccaacctggccgaccgggagctggtgcacatgatcaactgggccaagagggtgcccggctttgtggacctgaccctgcatgaccaggtgcacctgctggagtgtgcctggctggagatcctgatgattggcctggtgtggaggtccatggagcaccctgggaagctgctgtttgcccccaacctgctgctggacagcaacaagggcatggagcacctgtacagcatgaagtgcaagaatgtggtgcccctgtatgacctgctgctggagatgctggatgcccaccggctgcacgcccccaccagcagaggaggagcctctgtggaggagacagaccagagccacctggccacagctggcagcaccagcagccacagcctgcagaagtactacatcaccggggaggccgagggcttccctgccaccgtgtag

SEQ ID NO: 19515 - DNA, 1572 bp, Artificial Sequence
  Description of Artificial Sequence: Synthetic coding sequence
atgaccatgaccctgcacaccaaggccagcggcatggccctgctgcaccagatccagggcaatgagctggagcccccacccctgaacagcgtgagccccagccccctgatgctgctgcaccccccaccccagctgagccccttcctgcagccccacggccagcaggtgccctactacctggagaatgagcccagcggctacacagtgcgggaggccggccccccagccttctaccggcccaacagcgacaacagacggcagggcggccgggagcggctggccagcaccaatgacaagggctccatggccatggagagcgccaaggagacccgctactgtgctgtgtgcaatgactatgccagcggctaccactatggagtgtggagctgtgagggctgcaaggccttcttcaagaggagcatccagggccacaatgactacatgtgcccagccaccaaccagtgcaccatcgacaagaacagaaggaagagctgccaggcctgccgcctgaggaagtgctatgaggtgggcatgatgaagggcggcatcaggaaggacagaagaggaggccgcatgctgaagcacaagaggcagagagatgatggagagggccgcggggaggtgggcagcgctggggacatgagagctgccaacctgtggcccagccccctgatgatcaagaggagcaagaagaacagcctggccctgagcctgacagctgaccagatggtgtctgccctgctggatgctgagccccccatcctgtacagtgaatatgaccccacccggcccttcagcgaggcctccatgatgggcctgctgaccaacctggccgaccgggagctggtgcacatgatcaactgggccaagagggtgcccggctttgtggacctgaccctgcatgaccaggtgcacctgctggagtgtgcctggctggagatcctgatgattggcctggtgtggaggtccatggagcaccctgggaagctgctgtttgcccccaacctgctgctggacaggaaccagggcaaatgtgtggagggcatggtggagatctttgacatgctgctggccaccagcagccgcttcaggatgatgaacctgcagggcgaggagtttgtgtgcctgaagagcatcatcctgctgaacagcggcgtgtacaccttcctgagcagcaccctgaagagcctggaggagaaggaccacatccaccgggtgctggacaagatcacagacaccctcatccacctgatggccaaggccggcctgaccctgcagcagcagcaccagaggctggcccagctgctgctgatcctgagccacatccgccacatgagcaacaagggcatggagcacctgtacagcatgaagtgcaagaatgtggtgcccctgtatgacctgctgctggagatgctggatgcccaccggctgcacgcccccaccagccggggcggggcctctgtggaggagacagaccagagccacctggccacagctggcagcaccagcagccacagcctgcagaagtactacatcactggagaggccgagggcttccctgccaccgtgtag

SEQ ID NO: 19516 - DNA, 1788 bp, Artificial Sequence; identical to SEQ ID NO: 19508
  Description of Artificial Sequence: Synthetic coding sequence

SEQ ID NO: 19517 - DNA, 1788 bp, Artificial Sequence; identical to SEQ ID NO: 19508
  Description of Artificial Sequence: Synthetic coding sequence

SEQ ID NO: 19518 - DNA, 348 bp, Artificial Sequence
  Description of Artificial Sequence: Synthetic coding sequence
atgaccatgaccctgcacaccaaggccagcggcatggccctgctgcaccagatccagggcaatgagctggagcccctgaaccggccccagctgaagatccccctggagcggcccctgggggaggtgtacctggacagcagcaagccagctgtgtacaactacccagagggcgccgcctatgagttcaatgctgctgctgctgccaatgcccaggtgtatggccagacaggcctgccctacggccctggcagcgaggccgccgccttcggcagcaatggcctgggcggcttcccccccctgaacagcgtgagccccagccccctgatgctgctgcaccccccaccctag

SEQ ID NO: 19519 - DNA, 1452 bp, Artificial Sequence
  Description of Artificial Sequence: Synthetic coding sequence
atgaccatgaccctgcacaccaaggccagcggcatggccctgctgcaccagatccagggcaatgagctggagcccctgaaccggccccagctgaagatccccctggagcggcccctgggggaggtgtacctggacagcagcaagccagctgtgtacaactacccagagggcgccgcctatgagttcaatgctgctgctgctgccaatgcccaggtgtatggccagacaggcctgccctacggccctggcagcgaggccgccgccttcggcagcaatggcctgggcggcttcccccccctgaacagcgtgagccccagccccctgatgctgctgcaccccccaccccagctgagccccttcctgcagccccacggccagcaggtgccctactacctggagaatgagcccagcggctacacagtgcgggaggccggccccccagccttctaccggcccaacagcgacaacagacggcagggcggccgggagcggctggccagcaccaatgacaagggctccatggccatggagagcgccaaggagacccgctactgtgctgtgtgcaatgactatgccagcggctaccactatggagtgtggagctgtgagggctgcaaggccttcttcaagaggagcatccagggccacaatgactacatgtgcccagccaccaaccagtgcaccatcgacaagaacagaaggaagagctgccaggcctgccgcctgaggaagtgctatgaggtgggcatgatgaagggcggctttgtggacctgaccctgcatgaccaggtgcacctgctggagtgtgcctggctggagatcctgatgattggcctggtgtggaggtccatggagcaccctgggaagctgctgtttgcccccaacctgctgctggacaggaaccagggcaaatgtgtggagggcatggtggagatctttgacatgctgctggccaccagcagccgcttcaggatgatgaacctgcagggcgaggagtttgtgtgcctgaagagcatcatcctgctgaacagcggcgtgtacaccttcctgagcagcaccctgaagagcctggaggagaaggaccacatccaccgggtgctggacaagatcacagacaccctcatccacctgatggccaaggccggcctgaccctgcagcagcagcaccagaggctggcccagctgctgctgatcctgagccacatccgccacatgagcaacaagggcatggagcacctgtacagcatgaagtgcaagaatgtggtgcccctgtatgacctgctgctggagatgctggatgcccaccggctgcacgcccccaccagccggggcggggcctctgtggaggagacagaccagagccacctggccacagctggcagcaccagcagccacagcctgcagaagtactacatcactggagaggccgagggcttccctgccaccgtgtag

SEQ ID NO: 19520 - DNA, 933 bp, Artificial Sequence
  Description of Artificial Sequence: Synthetic coding sequence
atggccatggagagcgccaaggagacccgctactgtgctgtgtgcaatgactatgccagcggctaccactacggcgtgtggagctgtgagggctgcaaggccttcttcaagaggagcatccagggccacaatgactacatgtgcccagccaccaaccagtgcaccatcgacaagaacagaaggaagagctgccaggcctgccgcctgaggaaatgttatgaggtgggcatgatgaagggcggcatcaggaaggaccggcggggcggccgcatgctgaagcacaagaggcagagagatgatggagagggccgcggggaggtgggcagcgctggggacatgagagctgccaacctgtggcccagccccctgatgatcaagaggagcaagaagaacagcctggccctgagcctgacagctgaccagatggtgtctgccctgctggatgctgagccccccatcctgtacagtgaatatgaccccacccggcccttcagcgaggcctccatgatgggcctgctgaccaacctggccgaccgggagctggtgcacatgatcaactgggccaagagggtgcccggctttgtggacctgaccctgcatgaccaggtgcacctgctggagtgtgcctggctggagatcctgatgattggcctggtgtggaggtccatggagcaccctgggaagctgctgtttgcccccaacctgctgctggacaggaaccagggcaaatgtgtggagggcatggtggagatctttgacatgctgctggccaccagcagccgcttcaggatgatgaacctgcagggcgaggagtttgtgtgcctgaagagcatcatcctgctgaacagcggcatcagccacgtggaggccaagaagaggatcctgaacctgcaccccaagatcttcggcaacaagtggttcccccgggtgtag

SEQ ID NO: 19521 - DNA, 1320 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctatgtggacagccaccacgagtacccagccatgaccttctacagccctgctgtgatgaactacagcatccccagcaatgtgaccaacctggagggcggccctggccggcagaccaccagccccaacgtgctgtggcccaccccaggccacctgagccccctggtggtgcaccggcagctgagccacctgtatgcagagccccagaagagcccctggtgtgaggcccggagcctggagcacaccctgcctgtgaaccgggagaccctgaagaggaaggtgtctggcaacagatgtgccagccctgtgacaggccctggcagcaagagagatgcccacttctgtgctgtgtgcagcgactatgccagcggctaccactatggagtgtggagctgtgagggctgcaaggccttcttcaagaggagcatccagggccacaatgactacatctgcccagccaccaaccagtgcaccatcgacaagaacagaaggaagagctgccaggcctgccgcctgaggaagtgctatgaggtgggcatggtgaagtgtggcagccggcgggagcgctgtggctaccgcctggtgcggcggcagaggtctgcagatgagcagctgcactgtgccggcaaggccaagaggtctgggggccacgccccccgggtgcgggagctgctgctggatgccctgagccctgagcagctggtgctgaccctgctggaggccgagccccctcatgtgctgatcagccggcccagcgcccccttcacagaggcctccatgatgatgagcctgaccaagctggccgacaaggagctggtgcacatgatctcctgggccaagaagatccctggcatgtaccccctggtgacagccacccaggatgctgacagcagcaggaagctggcccacctgctgaatgctgtgacagatgccctggtgtgggtgattgccaagagcggcatcagcagccagcagcagagcatgaggctggccaacctgctgatgctgctgagccacgtgagacatgccagcaacaagggcatggagcacctgctgaacatgaagtgcaagaatgtggtgcctgtgtatgacctgctgctggagatgctgaatgcccacgtgctgcggggctgcaagagcagcatcactggaagtgagtgcagccctgctgaggacagcaagagcaaggagggcagccagaacccccagagccagtag

SEQ ID NO: 19522 - DNA, 1593 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctatgtggacagccaccacgagtacccagccatgaccttctacagccctgctgtgatgaactacagcatccccagcaatgtgaccaacctggagggcggccctggccggcagaccaccagccccaacgtgctgtggcccaccccaggccacctgagccccctggtggtgcaccggcagctgagccacctgtatgcagagccccagaagagcccctggtgtgaggcccggagcctggagcacaccctgcctgtgaaccgggagaccctgaagaggaaggtgtctggcaacagatgtgccagccctgtgacaggccctggcagcaagagagatgcccacttctgtgctgtgtgcagcgactatgccagcggctaccactatggagtgtggagctgtgagggctgcaaggccttcttcaagaggagcatccagggccacaatgactacatctgcccagccaccaaccagtgcaccatcgacaagaacagaaggaagagctgccaggcctgccgcctgaggaagtgctatgaggtgggcatggtgaagtgtggcagccggcgggagcgctgtggctaccgcctggtgcggcggcagaggtctgcagatgagcagctgcactgtgccggcaaggccaagaggtctgggggccacgccccccgggtgcgggagctgctgctggatgccctgagccctgagcagctggtgctgaccctgctggaggccgagccccctcatgtgctgatcagccggcccagcgcccccttcacagaggcctccatgatgatgagcctgaccaagctggccgacaaggagctggtgcacatgatctcctgggccaagaagatccctggctttgtggagctgagcctgtttgaccaggtgcggctgctggagagctgctggatggaggtgctgatgatgggcctgatgtggaggagcattgaccaccctgggaagctgatctttgccccagacctggtgctggacagagatgagggcaaatgtgtggagggcatcctggagatctttgacatgctgctggccaccaccagccgcttccgggagctgaagctgcagcacaaggagtacctgtgtgtgaaggccatgatcctgctgaacagctccatgtaccccctggtgacagccacccaggatgctgacagcagcaggaagctggcccacctgctgaatgctgtgacagatgccctggtgtgggtgattgccaagagcggcatcagcagccagcagcagagcatgaggctggccaacctgctgatgctgctgagccacgtgagacatgccagcaacaagggcatggagcacctgctgaacatgaagtgcaagaatgtggtgcctgtgtatgacctgctgctggagatgctgaatgcccacgtgctgcggggctgcaagagcagcatcaccggctctgaatgttctccagctgaggacagcaagagcaaggagggcagccagaacccccagagccagtag

SEQ ID NO: 19523 - DNA, 1488 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctatgtggacagccaccacgagtacccagccatgaccttctacagccctgctgtgatgaactacagcatccccagcaatgtgaccaacctggagggcggccctggccggcagaccaccagccccaacgtgctgtggcccaccccaggccacctgagccccctggtggtgcaccggcagctgagccacctgtatgcagagccccagaagagcccctggtgtgaggcccggagcctggagcacaccctgcctgtgaaccgggagaccctgaagaggaaggtgtctggcaacagatgtgccagccctgtgacaggccctggcagcaagagagatgcccacttctgtgctgtgtgcagcgactatgccagcggctaccactatggagtgtggagctgtgagggctgcaaggccttcttcaagaggagcatccagggccacaatgactacatctgcccagccaccaaccagtgcaccatcgacaagaacagaaggaagagctgccaggcctgccgcctgaggaagtgctatgaggtgggcatggtgaagtgtggcagccggcgggagcgctgtggctaccgcctggtgcggcggcagaggtctgcagatgagcagctgcactgtgccggcaaggccaagaggtctgggggccacgccccccgggtgcgggagctgctgctggatgccctgagccctgagcagctggtgctgaccctgctggaggccgagccccctcatgtgctgatcagccggcccagcgcccccttcacagaggcctccatgatgatgagcctgaccaagctggccgacaaggagctggtgcacatgatctcctgggccaagaagatccctggctttgtggagctgagcctgtttgaccaggtgcggctgctggagagctgctggatggaggtgctgatgatgggcctgatgtggaggagcattgaccaccctgggaagctgatctttgccccagacctggtgctggacagagatgagggcaaatgtgtggagggcatcctggagatctttgacatgctgctggccaccaccagccgcttccgggagctgaagctgcagcacaaggagtacctgtgtgtgaaggccatgatcctgctgaacagctccatgtaccccctggtgacagccacccaggatgctgacagcagcaggaagctggcccacctgctgaatgctgtgacagatgccctggtgtgggtgattgccaagagcggcatcagcagccagcagcagagcatgaggctggccaacctgctgatgctgctgagccacgtgagacatgcccgggcagagaaggccagccagaccctgaccagctttggcatgaagatggagaccctgctgcctgaggccaccatggagcagtag

SEQ ID NO: 19524 - DNA, 1446 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctatgtggacagccaccacgagtacccagccatgaccttctacagccctgctgtgatgaactacagcatccccagcaatgtgaccaacctggagggcggccctggccggcagaccaccagccccaacgtgctgtggcccaccccaggccacctgagccccctggtggtgcaccggcagctgagccacctgtatgcagagccccagaagagcccctggtgtgaggcccggagcctggagcacaccctgcctgtgaaccgggagaccctgaagaggaaggtgtctggcaacagatgtgccagccctgtgacaggccctggcagcaagagagatgcccacttctgtgctgtgtgcagcgactatgccagcggctaccactatggagtgtggagctgtgagggctgcaaggccttcttcaagaggagcatccagggccacaatgactacatctgcccagccaccaaccagtgcaccatcgacaagaacagaaggaagagctgccaggcctgccgcctgaggaagtgctatgaggtgggcatggtgaagtgtggcagccggcgggagcgctgtggctaccgcctggtgcggcggcagaggtctgcagatgagcagctgcactgtgccggcaaggccaagaggtctgggggccacgccccccgggtgcgggagctgctgctggatgccctgagccctgagcagctggtgctgaccctgctggaggccgagccccctcatgtgctgatcagccggcccagcgcccccttcacagaggcctccatgatgatgagcctgaccaagctggccgacaaggagctggtgcacatgatctcctgggccaagaagatccctggctttgtggagctgagcctgtttgaccaggtgcggctgctggagagctgctggatggaggtgctgatgatgggcctgatgtggaggagcattgaccaccctgggaagctgatctttgccccagacctggtgctggacagagatgagggcaaatgtgtggagggcatcctggagatctttgacatgctgctggccaccaccagccgcttccgggagctgaagctgcagcacaaggagtacctgtgtgtgaaggccatgatcctgctgaacagctccatgtaccccctggtgacagccacccaggatgctgacagcagcaggaagctggcccacctgctgaatgctgtgacagatgccctggtgtgggtgattgccaagagcggcatcagcagccagcagcagagcatgaggctggccaacctgctgatgctgctgagccacgtgagacatgcccgctggggcgagaagcagttcatccacctgaagctgtcctag

SEQ ID NO: 19525 - DNA, 1488 bp, Artificial Sequence; identical to SEQ ID NO: 19523
  Description of Artificial Sequence: Synthetic coding sequence

SEQ ID NO: 19526 - DNA, 1542 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctatgtggacagccaccacgagtacccagccatgaccttctacagccctgctgtgatgaactacagcatccccagcaatgtgaccaacctggagggcggccctggccggcagaccaccagccccaacgtgctgtggcccaccccaggccacctgagccccctggtggtgcaccggcagctgagccacctgtatgcagagccccagaagagcccctggtgtgaggcccggagcctggagcacaccctgcctgtgaaccgggagaccctgaagaggaaggtgtctggcaacagatgtgccagccctgtgacaggccctggcagcaagagagatgcccacttctgtgctgtgtgcagcgactatgccagcggctaccactatggagtgtggagctgtgagggctgcaaggccttcttcaagaggagcatccagggccacaatgactacatctgcccagccaccaaccagtgcaccatcgacaagaacagaaggaagagctgccaggcctgccgcctgaggaagtgctatgaggtgggcatggtgaagtgtggcagccggcgggagcgctgtggctaccgcctggtgcggcggcagaggtctgcagatgagcagctgcactgtgccggcaaggccaagaggtctgggggccacgccccccgggtgcgggagctgctgctggatgccctgagccctgagcagctggtgctgaccctgctggaggccgagccccctcatgtgctgatcagccggcccagcgcccccttcacagaggcctccatgatgatgagcctgaccaagctggccgacaaggagctggtgcacatgatctcctgggccaagaagatccctggctttgtggagctgagcctgtttgaccaggtgcggctgctggagagctgctggatggaggtgctgatgatgggcctgatgtggaggagcattgaccaccctgggaagctgatctttgccccagacctggtgctggacagagatgagggcaaatgtgtggagggcatcctggagatctttgacatgctgctggccaccaccagccgcttccgggagctgaagctgcagcacaaggagtacctgtgtgtgaaggccatgatcctgctgaacagctccatgtaccccctggtgacagccacccaggatgctgacagcagcaggaagctggcccacctgctgaatgctgtgacagatgccctggtgtgggtgattgccaagagcggcatcagcagccagcagcagagcatgaggctggccaacctgctgatgctgctgagccacgtgagacatgccagcagcctgagcctgtcctggaggctcttcatgctgcgggaggccagctgccacggcgtgcggcagacccctgggggcgcccacgtgtctgtgagccgcagccgcagctttgaggcctgccagcagccccgggagtag

SEQ ID NO: 19527 - DNA, 1488 bp, Artificial Sequence; identical to SEQ ID NO: 19523
  Description of Artificial Sequence: Synthetic coding sequence

SEQ ID NO: 19528 - DNA, 1419 bp, Artificial Sequence
  Description of Artificial Sequence: Synthetic coding sequence
atggacatcaagaacagccccagcagcctgaacagccccagcagctacaactgcagccagagcatcctgcccctggagcacggcagcatctacatccccagcagctatgtggacagccaccacgagtacccagccatgaccttctacagccctgctgtgatgaactacagcatccccagcaatgtgaccaacctggagggcggccctggccggcagaccaccagccccaacgtgctgtggcccaccccaggccacctgagccccctggtggtgcaccggcagctgagccacctgtatgcagagccccagaagagcccctggtgtgaggcccggagcctggagcacaccctgcctgtgaaccgggagaccctgaagaggaaggtgtctggcaacagatgtgccagccctgtgacaggccctggcagcaagagagatgcccacttctgtgctgtgtgcagcgactatgccagcggctaccactatggagtgtggagctgtgagggctgcaaggccttcttcaagaggagcatccagggccacaatgactacatctgcccagccaccaaccagtgcaccatcgacaagaacagaaggaagagctgccaggcctgccgcctgaggaagtgctatgaggtgggcatggtgaagtgtggcagccggcgggagcgctgtggctaccgcctggtgcggcggcagaggtctgcagatgagcagctgcactgtgccggcaaggccaagaggtctgggggccacgccccccgggtgcgggagctgctgctggatgccctgagccctgagcagctggtgctgaccctgctggaggccgagccccctcatgtgctgatcagccggcccagcgcccccttcacagaggcctccatgatgatgagcctgaccaagctggccgacaaggagctggtgcacatgatctcctgggccaagaagatccctggctttgtggagctgagcctgtttgaccaggtgcggctgctggagagctgctggatggaggtgctgatgatgggcctgatgtggaggagcattgaccaccctgggaagctgatctttgccccagacctggtgctggacagagatgagggcaaatgtgtggagggcatcctggagatctttgacatgctgctggccaccaccagccgcttccgggagctgaagctgcagcacaaggagtacctgtgtgtgaaggccatgatcctgctgaacagctccatgtaccccctggtgacagccacccaggatgctgacagcagcaggaagctggcccacctgctgaatgctgtgacagatgccctggtgtgggtgattgccaagagcggcatcagcagccagcagcagagcatgaggctggccaacctgctgatgctgctgagccacgtgagacatgcccgctatgccccctag

SEQ ID NO: 19529 - DNA, 1446 bp, Artificial Sequence; identical to SEQ ID NO: 19524
  Description of Artificial Sequence: Synthetic coding sequence

SEQ ID NO: 19530 - DNA, 1380 bp, Artificial Sequence
  Description of Artificial Sequence: Synthetic coding sequence
atggatggcttctatgaccagcaggtgccctacatggtgaccaacagccagaggggcaggaactgcaatgagaagcccaccaacgtgaggaagaggaagttcatcaacagagacctggcccatgattctgaggagctgttccaggacctgagccagctgcaggagacctggctggccgaggtggccttccacggcctgcccctgaagatcaagaaggagccccacagcccctgcagcgagatcagcagcgcctgcagccaggagcagcccttcaagttctcctatggagagaagtgcctgtacaacgtgtctgcctatgaccagaagccccaggtgggcatgaggcccagcaacccccccacccccagcagcacccctgtgagccccctgcaccacgccagccccaacagcacccacacccccaagccagaccgggccttccctgcccacctgccccccagccagagcatcccagacagcagctaccccatggaccaccgcttccggcggcagctgtctgagccctgcaacagcttcccccccctgcccaccatgccccgggagggccggcccatgtaccagaggcagatgtctgagcccaacatccccttccccccccagggcttcaagcaggagtaccatgaccctgtgtatgagcacaacaccatggtgggcagcgctgccagccagagcttccccccacccctgatgatcaagcaggagccccgggactttgcctatgattctgaggtgcccagctgccacagcatctacatgaggcaggagggcttcctggcccaccccagcaggacagagggctgcatgtttgagaagggcccccggcagttctatgatgacacctgtgtggtgcctgagaagtttgatggagacatcaagcaggagcccggcatgtaccgggagggccccacctaccagaggcggggcagcctgcagctgtggcagttcctggtggccctgctggatgaccccagcaacagccacttcatcgcctggacaggccggggcatggagttcaagctgattgagcctgaggaggtggcccggcgctggggcatccagaagaacagacctgccatgaactatgacaagctgagccgcagcctgcgctactactatgagaagggcatcatgcagaaggtggccggggagcgctacgtgtacaagtttgtgtgtgaccctgaggccctcttctccatggccttcccagacaaccagaggcccctgctgaagacagacatggagcggcacatcaatgaagaagatactgtgcccctgagccactttgatgagagcatggcctacatgcctgagggcggctgctgcaacccccacccctacaatgaaggctacgtgtactag

SEQ ID NO: 19531 - DNA, 1380 bp, Artificial Sequence; identical to SEQ ID NO: 19530
  Description of Artificial Sequence: Synthetic coding sequence

SEQ ID NO: 19532 - DNA, 1125 bp, Artificial Sequence
  Description of Artificial Sequence: Synthetic coding sequence
atgctgcaggacctgagcgccagcgtcttcttccccccctgcagccagcacaggaccctggcccaggtgcctgacaatgatgagcagtttgtgcctgactaccaggccgagagcctggccttccacggcctgcccctgaagatcaagaaggagccccacagcccctgcagcgagatcagcagcgcctgcagccaggagcagcccttcaagttctcctatggagagaagtgcctgtacaacgtgcgcttccggcggcagctgtctgagccctgcaacagcttcccccccctgcccaccatgccccgggagggccggcccatgtaccagaggcagatgtctgagcccaacatccccttccccccccagggcttcaagcaggagtaccatgaccctgtgtatgagcacaacaccatggtgggcagcgctgccagccagagcttccccccacccctgatgatcaagcaggagccccgggactttgcctatgacagcgaggtgcccagctgccacagcatctacatgaggcaggagggcttcctggcccaccccagcaggacagagggctgcatgtttgagaagggcccccggcagttctatgatgacacctgtgtggtgcctgagaagtttgatggagacatcaagcaggagcccggcatgtaccgggagggccccacctaccagaggcggggcagcctgcagctgtggcagttcctggtggccctgctggatgaccccagcaacagccacttcatcgcctggacaggccggggcatggagttcaagctgattgagcctgaggaggtggcccggcgctggggcatccagaagaacagacctgccatgaactatgacaagctgagccgcagcctgcgctactactatgagaagggcatcatgcagaaggtggccggggagagatatgtgtacaagtttgtgtgtgaccctgaggccctcttctccatggccttcccagacaaccagaggcccctgctgaagacagacatggagcggcacatcaatgaggaggacacagtgcccctgagccactttgatgagagcatggcctacatgcctgagggcggctgctgcaacccccacccctacaatgaaggctacgtgtactag

SEQ ID NO: 19533 - DNA, 1380 bp, Artificial Sequence; identical to SEQ ID NO: 19530
  Description of Artificial Sequence: Synthetic coding sequence

SEQ ID NO: 19534 - DNA, 1434 bp, Artificial Sequence
  Description of Artificial Sequence: Synthetic coding sequence
atggatggcttctatgaccagcaggtgccctacatggtgaccaacagccagaggggcaggaactgcaatgagaagcccaccaacgtgaggaagaggaagttcatcaacagagacctggcccatgattctgaggagctgttccaggacctgagccagctgcaggagacctggctggccgaggcccaggtgcctgacaatgatgagcagtttgtgcctgactaccaggccgagagcctggccttccacggcctgcccctgaagatcaagaaggagccccacagcccctgcagcgagatcagcagcgcctgcagccaggagcagcccttcaagttctcctatggagagaagtgcctgtacaacgtgtctgcctatgaccagaagccccaggtgggcatgaggcccagcaacccccccacccccagcagcacccctgtgagccccctgcaccacgccagccccaacagcacccacacccccaagccagaccgggccttccctgcccacctgccccccagccagagcatcccagacagcagctaccccatggaccaccgcttccggcggcagctgtctgagccctgcaacagcttcccccccctgcccaccatgccccgggagggccggcccatgtaccagaggcagatgtctgagcccaacatccccttccccccccagggcttcaagcaggagtaccatgaccctgtgtatgagcacaacaccatggtgggcagcgctgccagccagagcttccccccacccctgatgatcaagcaggagccccgggactttgcctatgattctgaggtgcccagctgccacagcatctacatgaggcaggagggcttcctggcccaccccagcaggacagagggctgcatgtttgagaagggcccccggcagttctatgatgacacctgtgtggtgcctgagaagtttgatggagacatcaagcaggagcccggcatgtaccgggagggccccacctaccagaggcggggcagcctgcagctgtggcagttcctggtggccctgctggatgaccccagcaacagccacttcatcgcctggacaggccggggcatggagttcaagctgattgagcctgaggaggtggcccggcgctggggcatccagaagaacagacctgccatgaactatgacaagctgagccgcagcctgcgctactactatgagaagggcatcatgcagaaggtggccggggagcgctacgtgtacaagtttgtgtgtgaccctgaggccctcttctccatggccttcccagacaaccagaggcccctgctgaagacagacatggagcggcacatcaatgaagaagatactgtgcccctgagccactttgatgagagcatggcctacatgcctgagggcggctgctgcaacccccacccctacaatgaaggctacgtgtactag

SEQ ID NO: 19535 - DNA, 1260 bp, Artificial Sequence
  Description of Artificial Sequence: Synthetic coding sequence
atgctgcaggacctgagcgccagcgtcttcttccccccctgcagccagcacaggaccctggtggccttccacggcctgcccctgaagatcaagaaggagccccacagcccctgcagcgagatcagcagcgcctgcagccaggagcagcccttcaagttctcctatggagagaagtgcctgtacaacgtgtctgcctatgaccagaagccccaggtgggcatgaggcccagcaacccccccacccccagcagcacccctgtgagccccctgcaccacgccagccccaacagcacccacacccccaagccagaccgggccttccctgcccacctgccccccagccagagcatcccagacagcagctaccccatggaccaccgcttccggcggcagctgtctgagccctgcaacagcttcccccccctgcccaccatgccccgggagggccggcccatgtaccagaggcagatgtctgagcccaacatccccttccccccccagggcttcaagcaggagtaccatgaccctgtgtatgagcacaacaccatggtgggcagcgctgccagccagagcttccccccacccctgatgatcaagcaggagccccgggactttgcctatgattctgaggtgcccagctgccacagcatctacatgaggcaggagggcttcctggcccaccccagcaggacagagggctgcatgtttgagaagggcccccggcagttctatgatgacacctgtgtggtgcctgagaagtttgatggagacatcaagcaggagcccggcatgtaccgggagggccccacctaccagaggcggggcagcctgcagctgtggcagttcctggtggccctgctggatgaccccagcaacagccacttcatcgcctggacaggccggggcatggagttcaagctgattgagcctgaggaggtggcccggcgctggggcatccagaagaacagacctgccatgaactatgacaagctgagccgcagcctgcgctactactatgagaagggcatcatgcagaaggtggccggggagcgctacgtgtacaagtttgtgtgtgaccctgaggccctcttctccatggccttcccagacaaccagaggcccctgctgaagacagacatggagcggcacatcaatgaagaagatactgtgcccctgagccactttgatgagagcatggcctacatgcctgagggcggctgctgcaacccccacccctacaatgaaggctacgtgtactag

SEQ ID NO: 19536 - DNA, 372 bp, Artificial Sequence
  Description of Artificial Sequence: Synthetic coding sequence
atggatggcttctatgaccagcaggtgccctacatggtgaccaacagccagaggggcaggaactgcaatgagaagcccaccaacgtgaggaagaggaagttcatcaacagagacctggcccatgattctgaggagctgttccaggacctgagccagctgcaggagacctggctggccgaggcccaggtgcctgacaatgatgagcagtttgtgcctgactaccaggccgagagcctggccttccacggcctgcccctgaagatcaagaaggagccccacagcccctgcagcgagatcagcagcgcctgcagccaggagcagcccttcaagttctcctatggagagaagtgcctgtacaacgtgtctgcctag

SEQ ID NO: 19537 - DNA, 1434 bp, Artificial Sequence; identical to SEQ ID NO: 19534
  Description of Artificial Sequence: Synthetic coding sequence

SEQ ID NO: 19538 - DNA, 288 bp, Artificial Sequence
  Description of Artificial Sequence: Synthetic coding sequence
atggatggcttctatgaccagcaggtgccctacatggtgaccaacagccagaggggcaggaactgcaatgagaagcccaccaacgtgaggaagaggaagttcatcaacagagacctggcccatgattctgaggagctgttccaggacctgagccagctgcaggagacctggctggccgaggcccaggtgcctgacaatgatgagcagtttgtgcctgactaccaggccgagagcctggccttccacggcctgcccctgaagatcaagaaggagccccacagcccctag

SEQ ID NO: 19539 - DNA, 63 bp, Artificial Sequence
  Description of Artificial Sequence: Synthetic coding sequence
atggatggcttctatgaccagcaggtgccctacatggtgaccaacagccagaggggccgctag

SEQ ID NO: 19540 - DNA, 1314 bp, Artificial Sequence
  Description of Artificial Sequence: Synthetic coding sequence
atgctgcaggacctgagcgccagcgtcttcttccccccctgcagccagcacaggaccctggcccaggtgcctgacaatgatgagcagtttgtgcctgactaccaggccgagagcctggccttccacggcctgcccctgaagatcaagaaggagccccacagcccctgcagcgagatcagcagcgcctgcagccaggagcagcccttcaagttctcctatggagagaagtgcctgtacaacgtgtctgcctatgaccagaagccccaggtgggcatgaggcccagcaacccccccacccccagcagcacccctgtgagccccctgcaccacgccagccccaacagcacccacacccccaagccagaccgggccttccctgcccacctgccccccagccagagcatcccagacagcagctaccccatggaccaccgcttccggcggcagctgtctgagccctgcaacagcttcccccccctgcccaccatgccccgggagggccggcccatgtaccagaggcagatgtctgagcccaacatccccttccccccccagggcttcaagcaggagtaccatgaccctgtgtatgagcacaacaccatggtgggcagcgctgccagccagagcttccccccacccctgatgatcaagcaggagccccgggactttgcctatgattctgaggtgcccagctgccacagcatctacatgaggcaggagggcttcctggcccaccccagcaggacagagggctgcatgtttgagaagggcccccggcagttctatgatgacacctgtgtggtgcctgagaagtttgatggagacatcaagcaggagcccggcatgtaccgggagggccccacctaccagaggcggggcagcctgcagctgtggcagttcctggtggccctgctggatgaccccagcaacagccacttcatcgcctggacaggccggggcatggagttcaagctgattgagcctgaggaggtggcccggcgctggggcatccagaagaacagacctgccatgaactatgacaagctgagccgcagcctgcgctactactatgagaagggcatcatgcagaaggtggccggggagcgctacgtgtacaagtttgtgtgtgaccctgaggccctcttctccatggccttcccagacaaccagaggcccctgctgaagacagacatggagcggcacatcaatgaagaagatactgtgcccctgagccactttgatgagagcatggcctacatgcctgagggcggctgctgcaacccccacccctacaatgaaggctacgtgtactag

SEQ ID NO: 19541 - DNA, 1365 bp, Artificial Sequence
  Description of Artificial Sequence: Synthetic coding sequence
atggatggcttctatgaccagcaggtgccctacatggtgaccaacagccagaggggcaggaactgcaatgagaagcccaccaacgtgaggaagaggaagttcatcaacagagacctggcccatgattctgaggagctgttccaggacctgagccagctgcaggagacctggctggccgaggcccaggtgcctgacaatgatgagcagtttgtgcctgactaccaggccgagagcctggccttccacggcctgcccctgaagatcaagaaggagccccacagcccctgcagcgagatcagcagcgcctgcagccaggagcagcccttcaagttctcctatggagagaagtgcctgtacaacgtgtctgcctatgaccagaagccccaggtgggcatgaggcccagcaacccccccacccccagcagcacccctgtgagccccctgcaccacgccagccccaacagcacccacacccccaagccagaccgggccttccctgcccacctgccccccagccagagcatcccagacagcagctaccccatggaccaccgcttccggcggcagctgtctgagccctgcaacagcttcccccccctgcccaccatgccccgggagggccggcccatgtaccagaggcagatgtctgagcccaacatccccttccccccccagggcttcaagcaggagtaccatgaccctgtgtatgagcacaacaccatggtgggcagcgctgccagccagagcttccccccacccctgatgatcaagcaggagccccgggactttgcctatgattctggctgcatgtttgagaagggcccccggcagttctatgatgacacctgtgtggtgcctgagaagtttgatggagacatcaagcaggagcccggcatgtaccgggagggccccacctaccagaggcggggcagcctgcagctgtggcagttcctggtggccctgctggatgaccccagcaacagccacttcatcgcctggacaggccggggcatggagttcaagctgattgagcctgaggaggtggcccggcgctggggcatccagaagaacagacctgccatgaactatgacaagctgagccgcagcctgcgctactactatgagaagggcatcatgcagaaggtggccggggagagatatgtgtacaagtttgtgtgtgaccctgaggccctcttctccatggccttcccagacaaccagaggcccctgctgaagacagacatggagcggcacatcaatgaggaggacacagtgcccctgagccactttgatgagagcatggcctacatgcctgagggcggctgctgcaacccccacccctacaatgaaggctacgtgtactag

SEQ ID NO: 19542 - DNA, 1455 bp, Artificial Sequence
  Description of Artificial Sequence: Synthetic coding sequence
atggagaggaggatgaaggccggctacctggaccagcaggtgccctacaccttcagcagcaagagccctggaaatggcagcctgcgggaggccctgattggccccctgggcaagctgatggaccccggcagcctgccccccctggacagtgaagatctcttccaggacctgagccacttccaggagacctggctggccgaggcccaggtgcctgacagtgatgagcagtttgtgcctgacttccacagcgagaacctggccttccacagccccaccacccgcatcaagaaggagccccagagccccaggacagatcctgccctgagctgcagcaggaagccacccctgccctaccaccacggggagcagtgcctgtacagcagcgcctatgaccccccccggcagatcgccatcaagagccctgcccctggggccctgggccagagccccctgcagcccttccccagggctgagcagaggaacttcctgcggagcagcggcaccagccagccccaccctggccacggctacctgggggagcacagctctgtgttccagcagcccctggacatctgccacagcttcaccagccagggcggcggccgggagcccctgcctgccccctaccagcaccagctgtctgagccctgccccccctacccccagcagagcttcaagcaggagtaccatgaccccctgtatgagcaggccggccagcctgctgtggaccagggcggcgtgaatggccaccgctacccaggagctggggtggtgatcaagcaggagcagacagactttgcctatgacagtgatgtgacaggctgtgcctccatgtacctgcacacagagggcttcagcggccccagccctggagatggagccatgggctacggctatgagaagcccctgcggcccttcccagatgatgtgtgtgtggtgcctgagaagtttgaaggagacatcaagcaggagggcgtgggcgccttccgggagggccccccctaccagaggagaggagccctgcagctgtggcagttcctggtggccctgctggatgaccccaccaatgcccacttcatcgcctggacaggccggggcatggagttcaagctgattgagcctgaggaggtggcccggctgtggggcatccagaagaacagacctgccatgaactatgacaagctgagccgcagcctgcgctactactatgagaagggcatcatgcagaaggtggccggggagcgctacgtgtacaagtttgtgtgtgagcctgaggccctcttcagcctggccttcccagacaaccagaggcctgccctgaaggccgagtttgacaggcctgtgtctgaagaagatactgtgcccctgagccacctggatgagagccctgcctacctgcctgagctggccggccctgcccagcccttcggccccaagggcggctacagctactag

SEQ ID NO: 19543 - DNA, 1455 bp, Artificial Sequence; identical to SEQ ID NO: 19542
  Description of Artificial Sequence: Synthetic coding sequence

SEQ ID NO: 19544 - DNA, 1338 bp, Artificial Sequence
  Description of Artificial Sequence: Synthetic coding sequence
atggaccccggcagcctgccccccctggacagcgaggacctcttccaggacctgagccacttccaggagacctggctggccgaggcccaggtgcctgacagtgatgagcagtttgtgcctgacttccacagcgagaacctggccttccacagccccaccacccgcatcaagaaggagccccagagccccaggacagatcctgccctgagctgcagcaggaagccacccctgccctaccaccacggggagcagtgcctgtacagcagcgcctatgaccccccccggcagatcgccatcaagagccctgcccctggggccctgggccagagccccctgcagcccttccccagggctgagcagaggaacttcctgcggagcagcggcaccagccagccccaccctggccacggctacctgggggagcacagcagcgtcttccagcagcccctggacatctgccacagcttcaccagccagggcggcggccgggagcccctgcctgccccctaccagcaccagctgtctgagccctgccccccctacccccagcagagcttcaagcaggagtaccatgaccccctgtatgagcaggccggccagcctgctgtggaccagggcggcgtgaatggccaccgctacccaggggccggcgtggtgatcaagcaggagcagacagactttgcctatgacagtgatgtgacaggctgtgcctccatgtacctgcacacagagggcttcagcggccccagccctggagatggagccatgggctacggctatgagaagcccctgcggcccttcccagatgatgtgtgtgtggtgcctgagaagtttgaaggagacatcaagcaggagggcgtgggcgccttccgggagggccccccctaccagaggagaggagccctgcagctgtggcagttcctggtggccctgctggatgaccccaccaatgcccacttcatcgcctggacaggccggggcatggagttcaagctgattgagcctgaggaggtggcccggctgtggggcatccagaagaacagacctgccatgaactatgacaagctgagccgcagcctgcgctactactatgagaagggcatcatgcagaaggtggccggggagagatatgtgtacaagtttgtgtgtgagcctgaggccctcttcagcctggccttcccagacaaccagaggcctgccctgaaggccgagtttgacaggcctgtgtctgaggaggacacagtgcccctgagccacctggatgagagccctgcctacctgcctgagctggccggccctgcccagcccttcggccccaagggcggctacagctactag

SEQ ID NO: 19545 - DNA, 1293 bp, Artificial Sequence
  Description of Artificial Sequence: Synthetic coding sequence
atggagaggaggatgaaggccggctacctggaccagcaggtgccctacaccttcagcagcaagagccctggaaatggcagcctgcgggaggccctgattggccccctgggcaagctgatggaccccggcagcctgccccccctggacagtgaagatctcttccaggacctgagccacttccaggagacctggctggccgaggcccaggtgcctgacagtgatgagcagtttgtgcctgacttccacagcgagaacctggccttccacagccccaccacccgcatcaagaaggagccccagagccccaggacagatcctgccctgagctgcagcaggaagccacccctgccctaccaccacggggagcagtgcctgtacagcagctctgtgttccagcagcccctggacatctgccacagcttcaccagccagggcggcggccgggagcccctgcctgccccctaccagcaccagctgtctgagccctgccccccctacccccagcagagcttcaagcaggagtaccatgaccccctgtatgagcaggccggccagcctgctgtggaccagggcggcgtgaatggccaccgctacccaggagctggggtggtgatcaagcaggagcagacagactttgcctatgacagtgatgtgacaggctgtgcctccatgtacctgcacacagagggcttcagcggccccagccctggagatggagccatgggctacggctatgagaagcccctgcggcccttcccagatgatgtgtgtgtggtgcctgagaagtttgaaggagacatcaagcaggagggcgtgggcgccttccgggagggccccccctaccagaggagaggagccctgcagctgtggcagttcctggtggccctgctggatgaccccaccaatgcccacttcatcgcctggacaggccggggcatggagttcaagctgattgagcctgaggaggtggcccggctgtggggcatccagaagaacagacctgccatgaactatgacaagctgagccgcagcctgcgctactactatgagaagggcatcatgcagaaggtggccggggagcgctacgtgtacaagtttgtgtgtgagcctgaggccctcttcagcctggccttcccagacaaccagaggcctgccctgaaggccgagtttgacaggcctgtgtctgaagaagatactgtgcccctgagccacctggatgagagccctgcctacctgcctgagctggccggccctgcccagcccttcggccccaagggcggctacagctactag

SEQ ID NO: 19546 - DNA, 1338 bp, Artificial Sequence; identical to SEQ ID NO: 19544
  Description of Artificial Sequence: Synthetic coding sequence

SEQ ID NO: 19547 - DNA, 1791 bp, Artificial Sequence
  Description of Artificial Sequence: Synthetic coding sequence
atggccggccggcgggtgaatgtgaatgtgggcgtgctgggccacatcgacagcggcaagacagccctggcccgggccctgagcaccacagccagcacagctgcctttgacaagcagccccagagccgggagcggggcatcaccctggacctgggcttcagctgcttctctgtgcccctgcctgcccggctgcggagcagcctgcctgagttccaggccgcccctgaggccgagcctgagcctggagagcccctgctgcaggtgaccctggtggactgccccggccacgccagcctcatccgcaccatcatcggcggggcccagatcatcgacctgatgatgctggtgattgatgtgaccaagggcatgcagacccagagcgcagaatgtctggtgattggccagatcgcctgccagaagctggtggtggtgctgaacaagattgacctgctgcctgagggcaagaggcaggccgccatcgacaagatgaccaagaagatgcagaagaccctggagaacaccaagttccggggggcccccatcatccctgtggccgccaagccaggcggccctgaggcccctgagacagaggccccccagggcatccctgagctgattgagctgctgaccagccagatcagcatccccacccgggaccccagcggccccttcctgatgtctgtggaccactgcttcagcatcaagggccagggcaccgtgatgacaggcaccatcctgagcggcagcatcagcctgggggacagcgtggagatcccagccctgaaggtggtgaagaaggtgaagtccatgcagatgttccacatgcccatcaccagcgccatgcagggcgaccggctgggcatctgtgtgacccagtttgaccccaagctgctggagcggggcctggtgtgtgcccctgagagcctgcacacagtgcacgccgccctgatctctgtggagaagatcccctacttccggggccccctgcagaccaaggccaagttccacatcaccgtgggccatgaaacagtgatgggccgcctgatgttcttctccccagccccagacaactttgaccaggagcccatcctggacagcttcaacttcagccaggagtacctgttccaggagcagtacctgagcaaggacctgaccccagctgtgacagacaatgatgaggccgacaagaaggccggccaggccacagagggccactgcccccggcagcagtgggccctggtggagtttgagaagcctgtgacctgcccccggctgtgcctggtgattggcagccggctggatgctgacatccacaccaacacctgccgcctggccttccacggcatcctgctgcacggcctggaggacagaaattatgctgacagcttcctgccccggctgaaggtgtacaagctgaagcacaagcacggcctggtggagcgggccatggatgactacagcgtgattggccgcagcctcttcaagaaggagaccaacatccagctgtttgtgggcctgaaggtgcacctgagcactggagagctgggcatcatcgacagcgccttcggccagagcggcaagttcaagatccacatccctgggggcctgagccctgagagcaagaagatcctgaccccagccctgaagaagagggcccgggccggccgcggggaggccacccggcaggaggagagcgctgagaggtctgagcccagccagcacgtggtgctgagcctgaccttcaagcgctacgtgtttgacacccacaagaggatggtgcagagcccctag

SEQ ID NO: 19548 - DNA, 1233 bp, Artificial Sequence
  Description of Artificial Sequence: Synthetic coding sequence
atggctgctgagatccacagccggccccagagcagcaggcctgtgctgctgagcaagattgagggccaccaggatgctgtgacagctgccctgctgatccccaaggaggatggagtcatcacagccagcgaggacaggaccatccgggtgtggctgaagagggacagcggccagtactggcccagcatctaccacaccatggccagcccctgcagcgccatggcctaccaccacgacagccgccgcatctttgtgggccaggacaatggagctgtgatggagttccacgtgtctgaggacttcaacaagatgaacttcatcaagacctacccagcccaccagaacagagtgtctgccatcatcttcagcctggccacagagtgggtgatcagcacaggccatgacaagtgtgtgtcctggatgtgcaccaggagcggcaacatgctgggccgccacttcttcacctcctgggccagctgcctgcagtatgactttgacacccagtatgcctttgtgggggactacagcggccagatcaccctgctgaagctggagcagaacacctgcagcgtcatcaccaccctgaagggccacgagggctctgtggcctgcctgtggtgggaccccatccagaggctgctcttcagcggggccagtgacaacagcatcatcatgtgggacatcggcggcaggaagggccgcaccctgctgctgcagggccaccacgacaaggtgcagagcctgtgctacctgcagctgacccggcagctggtgtcctgcagcagtgatggcggcattgctgtgtggaacatggatgtgtcccgggaggaggccccccagtggctggagagtgacagctgccagaagtgtgagcagcccttcttctggaacatcaagcagatgtgggacaccaagaccctgggcctgcggcagcaccactgcaggaaatgtggccaggccgtgtgtgggaagtgcagcagcaagaggagcagctaccctgtgatgggctttgagttccaggtgcgggtgtgtgacagctgctatgacagcatcaaggatgaggacaggaccagcctggccaccttccacgagggcaagcacaacatcagccacatgtccatggacatcgcccggggcctgatggtgacctgtggcacagacagaattgtgaagatctgggacatgacccctgtggtgggctgcagcctggccaccggcttcagcccccactag

SEQ ID NO: 19549 - DNA, 1092 bp, Artificial Sequence
  Description of Artificial Sequence: Synthetic coding sequence
atggccggggacctgtctgctggcttcttcatggaggagctgaacacctaccggcagaagcagggcgtggtgctgaagtaccaggagctgcccaacagcggcccccctcatgaccggcgcttcaccttccaggtgatcattgatggccgggagttccctgagggggagggccgcagcaagaaggaggccaagaatgctgctgccaagctggccgtggagatcctgaacaaggagaagaaggctgtgagccccctgctgctgaccaccaccaacagcagcgagggcctgtccatgggcaactacatcggcctcatcaaccgcatcgcccagaagaagaggctgactgtgaactatgagcagtgtgccagcggcgtgcacggccctgagggcttccactacaagtgcaagatgggccagaaggagtacagcatcggcaccggcagcaccaagcaggaggccaagcagctggccgccaagctggcctacctgcagatcctgtctgaggagacctctgtgaagagtgactacctgagcagcggcagctttgccaccacctgtgagagccagagcaacagcctggtgaccagcaccctggccagcgagagcagcagcgagggggacttctctgctgacaccagcgagatcaacagcaacagcgacagcctgaacagcagcagcctgctgatgaatggcctgaggaacaaccagaggaaggccaagaggagcctggcccccaggtttgacctgcctgacatgaaggagaccaagtacacagtggacaagagatttggcatggacttcaaggagattgagctgattggcagcggcggcttcggccaggtgttcaaggccaagcacagaattgatggcaagacctacgtgatcaagagggtgaagtacaacaatgaaagcaagaccaagtgcctcttcatccagatggagttctgtgacaagggcaccctggagcagtggattgagaagagaagaggagagaagctggacaaggtgctggccctggagctgtttgagcagatcaccaagggcgtggactacatccacagcaagaagaagaagaagaagaagaagaagtag

SEQ ID NO: 19550 - DNA, 309 bp, Artificial Sequence
  Description of Artificial Sequence: Synthetic coding sequence
atggccggggacctgtctgctggcttcttcatggaggagctgaacacctaccggcagaagcagggcgtggtgctgaagtaccaggagctgcccaacagcggcccccctcatgaccggcgcttcaccttccaggtgatcattgatggccgggagttccctgagggggagggccgcagcaagaaggaggccaagaatgctgctgccaagctggccgtggagatcctgaacaaggagaagaaggctgtgagccccctgctgctgaccaccaccaacagcagcgagggcctgtccatgggcaactacatctag

SEQ ID NO: 19551 - DNA, 1656 bp, Artificial Sequence
  Description of Artificial Sequence: Synthetic coding sequence
atggccggggacctgtctgctggcttcttcatggaggagctgaacacctaccggcagaagcagggcgtggtgctgaagtaccaggagctgcccaacagcggcccccctcatgaccggcgcttcaccttccaggtgatcattgatggccgggagttccctgagggggagggccgcagcaagaaggaggccaagaatgctgctgccaagctggccgtggagatcctgaacaaggagaagaaggctgtgagccccctgctgctgaccaccaccaacagcagcgagggcctgtccatgggcaactacatcggcctcatcaaccgcatcgcccagaagaagaggctgactgtgaactatgagcagtgtgccagcggcgtgcacggccctgagggcttccactacaagtgcaagatgggccagaaggagtacagcatcggcaccggcagcaccaagcaggaggccaagcagctggccgccaagctggcctacctgcagatcctgtctgaggagacctctgtgaagagtgactacctgagcagcggcagctttgccaccacctgtgagagccagagcaacagcctggtgaccagcaccctggccagcgagagcagcagcgagggggacttctctgctgacaccagcgagatcaacagcaacagcgacagcctgaacagcagcagcctgctgatgaatggcctgaggaacaaccagaggaaggccaagaggagcctggcccccaggtttgacctgcctgacatgaaggagaccaagtacacagtggacaagagatttggcatggacttcaaggagattgagctgattggcagcggcggcttcggccaggtgttcaaggccaagcacagaattgatggcaagacctacgtgatcaagagggtgaagtacaacaatgagaaggccgagcgggaggtgaaggccctggccaagctggaccacgtgaacatcgtgcactacaacggctgctgggatggctttgattatgaccctgagaccagtgatgacagcctggagagcagtgactatgaccctgagaacagcaagaacagcagccgcagcaagaccaagtgcctcttcatccagatggagttctgtgacaagggcaccctggagcagtggattgagaagagaagaggagagaagctggacaaggtgctggccctggagctgtttgagcagatcaccaagggcgtggactacatccacagcaagaagctgatccaccgggacctgaagcccagcaacatcttcctggtggacaccaagcaggtgaagatcggggactttggcctggtgaccagcctgaagaatgatggcaagaggaccaggagcaagggcaccctgcgctacatgagccctgagcagatcagcagccaggactatggcaaggaggtggacctgtatgccctgggcctcatcctggccgagctgctgcacgtgtgtgacacagcctttgagaccagcaagttcttcacagacctgagagatggcatcatcagtgacatctttgacaagaaggagaagaccctgctgcagaagctgctgagcaagaagccagaggaccggcccaacaccagcgagatcctgcggaccctgactgtgtggaagaagagccctgagaagaatgaaagacacacctgctag

SEQ ID NO: 19552 - DNA, 351 bp, Artificial Sequence
  Description of Artificial Sequence: Synthetic coding sequence
atggccggggacctgtctgctggcttcttcatggaggagctgaacacctaccggcagaagcagggcgtggtgctgaagtaccaggagctgcccaacagcggcccccctcatgaccggcgcttcaccttccaggtgatcattgatggccgggagttccctgagggggagggccgcagcaagaaggaggccaagaatgctgctgccaagctggccgtggagatcctgaacaaggagaagaaggctgtgagccccctgctgctgaccaccaccaacagcagcgagggcctgtccatgggcaactacatcggcctcatcaaccgcatcgcccagaagaagaggctgactgtgtag

SEQ ID NO: 19553 - DNA, 1533 bp, Artificial Sequence
  Description of Artificial Sequence: Synthetic coding sequence
atggccggggacctgtctgctggcttcttcatggaggagctgaacacctaccggcagaagcagggcgtggtgctgaagtaccaggagctgcccaacagcggcccccctcatgaccggcgcttcaccttccaggtgatcattgatggccgggagttccctgagggggagggccgcagcaagaaggaggccaagaatgctgctgccaagctggccgtggagatcctgaacaaggagaagaaggctgtgagccccctgctgctgaccaccaccaacagcagcgagggcctgtccatgggcaactacatcggcctcatcaaccgcatcgcccagaagaagaggctgactgtgaactatgagcagtgtgccagcggcgtgcacggccctgagggcttccactacaagtgcaagatgggccagaaggagtacagcatcggcaccggcagcaccaagcaggaggccaagcagctggccgccaagctggcctacctgcagatcctgtctgaggagacctctgtgaagagtgactacctgagcagcggcagctttgccaccacctgtgagagccagagcaacagcctggtgaccagcaccctggccagcgagagcagcagcgagggggacttctctgctgacaccagcgagatcaacagcaacagcgacagcctgaacagcagcagcctgctgatgaatggcctgaggaacaaccagaggaaggccaagaggagcctggcccccaggtttgacctgcctgacatgaaggagaccaagtacacagtggacaagaggaaggccgagcgggaggtgaaggccctggccaagctggaccacgtgaacatcgtgcactacaacggctgctgggatggctttgattatgaccctgagaccagtgatgacagcctggagagcagtgactatgaccctgagaacagcaagaacagcagccgcagcaagaccaagtgcctcttcatccagatggagttctgtgacaagggcaccctggagcagtggattgagaagagaagaggagagaagctggacaaggtgctggccctggagctgtttgagcagatcaccaagggcgtggactacatccacagcaagaagctgatccaccgggacctgaagcccagcaacatcttcctggtggacaccaagcaggtgaagattggagactttggcctggtgaccagcctgaagaatgatggcaagaggaccaggagcaagggcaccctgcgctacatgagccctgagcagatcagcagccaggactatggcaaggaggtggacctgtatgccctgggcctcatcctggccgagctgctgcacgtgtgtgacacagcctttgagaccagcaagttcttcacagacctgagagatggcatcatcagtgacatctttgacaagaaggagaagaccctgctgcagaagctgctgagcaagaagccagaagatcggcccaacaccagcgagatcctgcggaccctgactgtgtggaagaagagccctgagaagaatgaaagacacacctgctag

SEQ ID NO: 19554 - DNA, 4800 bp, Artificial Sequence
  Description of Artificial Sequence: Synthetic coding sequence
atgaacaaggccccccagagcacaggccccccaccagcccccagccctggcctgccccagcctgccttccccccaggccagacagcccctgtggtgttcagcaccccccaggccacccagatgaacacccccagccagccccggcagcacttctaccccagccgggcccagccccccagcagcgctgccagccgggtgcagagcgctgccccagcccggcccggccctgctgcccacgtgtacccagctggcagccaggtgatgatgatccccagccagatctcctacccagccagccagggcgcctactacatccctggccagggccgcagcacctacgtggtgcccacccagcagtaccctgtgcagcccggggcccctggcttctacccaggggccagccccacagaatttggcacctacgccggggcctactacccagcccagggcgtgcagcagttccccaccggggtggcccccacccctgtgctgatgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgctgctgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaggaggacaagatccacaatgctgagaacatccagcctggagagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggccctgctggcctgggcccccggcgcagccagcagggccccaggaaggagcccaggaagatcatcgccaccgtgctgatgacagaggacatcaagctgaacaaggccgagaaggcctggaagcccagcagcaagaggacagctgctgacaaggacagaggagaggaggatgctgatggcagcaagacccaggacctcttccggcgggtgcgcagcatcctgaacaagctgaccccccagatgttccagcagctgatgaagcaggtgacccagctggccatcgacacagaggagcggctgaagggcgtcatcgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaagctgccacagctgaggagcggggccgcctgaaggaggagctggaggaggcccgggacatcgccaggagaagaagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgcccaggagaggagaccagggccccaagaccatcgaccagatccacaaggaggccgagatggaggagcaccgggagcacatcaaggtgcagcagctgatggccaagggcagtgacaagagaagaggaggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaggaccgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacattggagcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaaaggagtggccctgaagtctgtgacagccttcttcaagtggctgcgggaggccgaggaggagagtgaccacaactag

SEQ ID NO: 19555 - DNA, 4803 bp, Artificial Sequence
  Description of Artificial Sequence: Synthetic coding sequence
atgaacaaggccccccagagcacaggccccccaccagcccccagccctggcctgccccagcctgccttccccccaggccagacagcccctgtggtgttcagcaccccccaggccacccagatgaacacccccagccagccccggcagcacttctaccccagccgggcccagccccccagcagcgctgccagccgggtgcagagcgctgccccagcccggcccggccctgctgcccacgtgtacccagctggcagccaggtgatgatgatccccagccagatctcctacccagccagccagggcgcctactacatccctggccagggccgcagcacctacgtggtgcccacccagcagtaccctgtgcagcccggggcccctggcttctacccaggggccagccccacagaatttggcacctacgccggggcctactacccagcccagggcgtgcagcagttccccaccggggtggcccccacccctgtgctgatgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgctgctgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaggaggacaagatccacaatgctgagaacatccagcctggagagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggcccccaggccggcctgggccccaggaggagccagcagggccccaggaaggagcccaggaagatcatcgccaccgtgctgatgacagaggacatcaagctgaacaaggccgagaaggcctggaagcccagcagcaagaggacagctgctgacaaggacagaggagaagaagatgctgatggcagcaagacccaggacctcttcagaagagtgcgcagcatcctgaacaagctgaccccccagatgttccagcagctgatgaagcaggtgacccagctggccatcgacacagaggagcggctgaagggcgtgattgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaggccgccacagctgaggagcggggccgcctgaaggaggagctggaggaggcccgggacatcgcccggcggcgcagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgccccggcggggggaccagggccccaagaccatcgaccagatccacaaggaggccgagatggaggagcaccgggagcacatcaaggtgcagcagctgatggccaagggcagtgacaagaggcggggcggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaagatcgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacatcggggcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaagggcgtggccctgaagtctgtgacagccttcttcaagtggctgcgggaggccgaggaggagagtgaccacaactag

SEQ ID NO: 19556 - DNA, 4800 bp, Artificial Sequence; identical to SEQ ID NO: 19554
  Description of Artificial Sequence: Synthetic coding sequence

SEQ ID NO: 19557 - DNA, 4308 bp, Artificial Sequence
  Description of Artificial Sequence: Synthetic coding sequence
atgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgctgctgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaggaggacaagatccacaatgctgagaacatccagcctggagagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggccctgctggcctgggcccccggcgcagccagcagggccccaggaaggagcccaggaagatcatcgccaccgtgctgatgacagaggacatcaagctgaacaaggccgagaaggcctggaagcccagcagcaagaggacagctgctgacaaggacagaggagaggaggatgctgatggcagcaagacccaggacctcttccggcgggtgcgcagcatcctgaacaagctgaccccccagatgttccagcagctgatgaagcaggtgacccagctggccatcgacacagaggagcggctgaagggcgtcatcgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaagctgccacagctgaggagcggggccgcctgaaggaggagctggaggaggcccgggacatcgccaggagaagaagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgcccaggagaggagaccagggccccaagaccatcgaccagatccacaaggaggccgagatggaggagcaccgggagcacatcaaggtgcagcagctgatggccaagggcagtgacaagagaagaggaggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaggaccgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacattggagcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaaaggagtggccctgaagtctgtgacagccttcttcaagtggctgcgggaggccgaggaggagagtgaccacaactag

SEQ ID NO: 19558 - DNA, 4821 bp, Artificial Sequence
  Description of Artificial Sequence: Synthetic coding sequence
atgaacaaggccccccagagcacaggccccccaccagcccccagccctggcctgccccagcctgccttccccccaggccagacagcccctgtggtgttcagcaccccccaggccacccagatgaacacccccagccagccccggcagggcggcttccgcagcctgcagcacttctaccccagccgggcccagccccccagcagcgctgccagccgggtgcagagcgctgccccagcccggcccggccctgctgcccacgtgtacccagctggcagccaggtgatgatgatccccagccagatctcctacccagccagccagggcgcctactacatccctggccagggccgcagcacctacgtggtgcccacccagcagtaccctgtgcagcccggggcccctggcttctacccaggggccagccccacagaatttggcacctacgccggggcctactacccagcccagggcgtgcagcagttccccactggagtggcccccacccctgtgctgatgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaatggagagaccccccaggtggccgtcatcgtgcggccagatgacaggagccagggcgccatcatcgctgaccggcccggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagaccggggagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgccgccgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaagaagacaagatccacaatgctgagaacatccagcccggggagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggccctgctggcctgggccccaggaggagccagcagggccccaggaaggagcccaggaagatcatcgccaccgtgctgatgacagaggacatcaagctgaacaaggccgagaaggcctggaagcccagcagcaagaggacagctgctgacaaggacagaggagaagaagatgctgatggcagcaagacccaggacctcttcagaagagtgcgcagcatcctgaacaagctgaccccccagatgttccagcagctgatgaagcaggtgacccagctggccatcgacacagaggagcggctgaagggcgtgattgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaggccgccacagctgaggagcggggccgcctgaaggaggagctggaggaggcccgggacatcgcccggcggcgcagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgccccggcggggggaccagggccccaagaccatcgaccagatccacaaggaggccgagatggaggagcaccgggagcacatcaaggtgcagcagctgatggccaagggcagtgacaagaggcggggcggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaagatcgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacatcggggcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaagggcgtggccctgaagtctgtgacagccttcttcaagtggctgcgggaggccgaggaggagagtgaccacaactag

SEQ ID NO: 19559 - DNA, 4821 bp, Artificial Sequence; identical to SEQ ID NO: 19558
  Description of Artificial Sequence: Synthetic coding sequence

SEQ ID NO: 19560 - DNA, 4539 bp, Artificial Sequence
  Description of Artificial Sequence: Synthetic coding sequence
atgatgatccccagccagatctcctacccagccagccagggcgcctactacatccctggccagggccgcagcacctacgtggtgcccacccagcagtaccctgtgcagcccggggcccctggcttctacccaggggccagccccacagaatttggcacctacgccggggcctactacccagcccagggcgtgcagcagttccccactggagtggcccccacccctgtgctgatgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaatggagagaccccccaggtggccgtcatcgtgcggccagatgacaggagccagggcgccatcatcgctgaccggcccggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagaccggggagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgccgccgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaagaagacaagatccacaatgctgagaacatccagcccggggagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggccctgctggcctgggccccaggaggagccagcagggccccaggaaggagcccaggaagatcatcgccaccgtgctgatgacagaggacatcaagctgaacaaggccgagaaggcctggaagcccagcagcaagaggacagctgctgacaaggacagaggagaagaagatgctgatggcagcaagacccaggacctcttcagaagagtgcgcagcatcctgaacaagctgaccccccagatgttccagcagctgatgaagcaggtgacccagctggccatcgacacagaggagcggctgaagggcgtgattgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaggccgccacagctgaggagcggggccgcctgaaggaggagctggaggaggcccgggacatcgcccggcggcgcagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgccccggcggggggaccagggccccaagaccatcgaccagatccacaaggaggccgagatggaggagcaccgggagcacatcaaggtgcagcagctgatggccaagggcagtgacaagaggcggggcggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaagatcgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacatcggggcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaagggcgtggccctgaagtctgtgacagccttcttcaagtggctgcgggaggccgaggaggagagtgaccacaactag

SEQ ID NO: 19561 - DNA, 4539 bp, Artificial Sequence; identical to SEQ ID NO: 19560
  Description of Artificial Sequence: Synthetic coding sequence

SEQ ID NO: 19562 - DNA, 4683 bp, Artificial Sequence
  Description of Artificial Sequence: Synthetic coding sequence
atgaacacccccagccagccccggcagcacttctaccccagccgggcccagccccccagcagcgctgccagccgggtgcagagcgctgccccagcccggcccggccctgctgcccacgtgtacccagctggcagccaggtgatgatgatccccagccagatctcctacccagccagccagggcgcctactacatccctggccagggccgcagcacctacgtggtgcccacccagcagtaccctgtgcagcccggggcccctggcttctacccaggggccagccccacagaatttggcacctacgccggggcctactacccagcccagggcgtgcagcagttccccaccggggtggcccccacccctgtgctgatgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgctgctgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaggaggacaagatccacaatgctgagaacatccagcctggagagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggcccccaggccggcctgggccccaggaggagccagcagggccccaggaaggagcccaggaagatcatcgccaccgtgctgatgacagaggacatcaagctgaacaaggccgagaaggcctggaagcccagcagcaagaggacagctgctgacaaggacagaggagaagaagatgctgatggcagcaagacccaggacctcttcagaagagtgcgcagcatcctgaacaagctgaccccccagatgttccagcagctgatgaagcaggtgacccagctggccatcgacacagaggagcggctgaagggcgtgattgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaggccgccacagctgaggagcggggccgcctgaaggaggagctggaggaggcccgggacatcgcccggcggcgcagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgccccggcggggggaccagggccccaagaccatcgaccagatccacaaggaggccgagatggaggagcaccgggagcacatcaaggtgcagcagctgatggccaagggcagtgacaagaggcggggcggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaagatcgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacatcggggcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaagggcgtggccctgaagtctgtgacagccttcttcaagtggctgcgggaggccgaggaggagagtgaccacaactag

SEQ ID NO: 19563 - DNA, 4680 bp, Artificial Sequence
  Description of Artificial Sequence: Synthetic coding sequence
atgaacacccccagccagccccggcagcacttctaccccagccgggcccagccccccagcagcgctgccagccgggtgcagagcgctgccccagcccggcccggccctgctgcccacgtgtacccagctggcagccaggtgatgatgatccccagccagatctcctacccagccagccagggcgcctactacatccctggccagggccgcagcacctacgtggtgcccacccagcagtaccctgtgcagcccggggcccctggcttctacccaggggccagccccacagaatttggcacctacgccggggcctactacccagcccagggcgtgcagcagttccccaccggggtggcccccacccctgtgctgatgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgctgctgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaggaggacaagatccacaatgctgagaacatccagcctggagagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggccctgctggcctgggcccccggcgcagccagcagggccccaggaaggagcccaggaagatcatcgccaccgtgctgatgacagaggacatcaagctgaacaaggccgagaaggcctggaagcccagcagcaagaggacagctgctgacaaggacagaggagaggaggatgctgatggcagcaagacccaggacctcttccggcgggtgcgcagcatcctgaacaagctgaccccccagatgttccagcagctgatgaagcaggtgacccagctggccatcgacacagaggagcggctgaagggcgtcatcgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaagctgccacagctgaggagcggggccgcctgaaggaggagctggaggaggcccgggacatcgccaggagaagaagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgcccaggagaggagaccagggccccaagaccatcgaccagatccacaaggaggccgagatggaggagcaccgggagcacatcaaggtgcagcagctgatggccaagggcagtgacaagagaagaggaggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaggaccgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacattggagcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaaaggagtggccctgaagtctgtgacagccttcttcaagtggctgcgggaggccgaggaggagagtgaccacaactag

SEQ ID NO: 19564 - DNA, 4821 bp, Artificial Sequence; identical to SEQ ID NO: 19558
  Description of Artificial Sequence: Synthetic coding sequence

SEQ ID NO: 19565 - DNA, 492 bp, Artificial Sequence
  Description of Artificial Sequence: Synthetic coding sequence
atgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccactag

SEQ ID NO: 19566 - DNA, 4542 bp, Artificial Sequence
  Description of Artificial Sequence: Synthetic coding sequence
atgatgatccccagccagatctcctacccagccagccagggcgcctactacatccctggccagggccgcagcacctacgtggtgcccacccagcagtaccctgtgcagcccggggcccctggcttctacccaggggccagccccacagaatttggcacctacgccggggcctactacccagcccagggcgtgcagcagttccccactggagtggcccccacccctgtgctgatgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaatggagagaccccccaggtggccgtcatcgtgcggccagatgacaggagccagggcgccatcatcgctgaccggcccggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagaccggggagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgccgccgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaagaagacaagatccacaatgctgagaacatccagcccggggagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggcccccaggccggcctgggcccccggcgcagccagcagggccccaggaaggagcccaggaagatcatcgccaccgtgctgatgacagaggacatcaagctgaacaaggccgagaaggcctggaagcccagcagcaagaggacagctgctgacaaggacagaggagaggaggatgctgatggcagcaagacccaggacctcttccggcgggtgcgcagcatcctgaacaagctgaccccccagatgttccagcagctgatgaagcaggtgacccagctggccatcgacacagaggagcggctgaagggcgtcatcgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaagctgccacagctgaggagcggggccgcctgaaggaggagctggaggaggcccgggacatcgccaggagaagaagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgcccaggagaggagaccagggccccaagaccatcgaccagatccacaaggaggccgagatggaggagcaccgggagcacatcaaggtgcagcagctgatggccaagggcagtgacaagagaagaggaggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaggaccgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacattggagcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaaaggagtggccctgaagtctgtgacagccttcttcaagtggctgcgggaggccgaggaggagagtgaccacaactag

SEQ ID NO: 19567 - DNA, 432 bp, Artificial Sequence
  Description of Artificial Sequence: Synthetic coding sequence
atgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagtag

SEQ ID NO: 19568 - DNA, 4215 bp, Artificial Sequence
  Description of Artificial Sequence: Synthetic coding sequence
atgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgctgctgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaggaggacaagatccacaatgctgagaacatccagcctggagagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggcccccaggccggcctgggccccaggaggagccagcagggccccaggaaggagcccaggaagatcatcgccaccgtgctgatgacagaggacatcaagctgaacaaggccgagaaggcctggaagcccagcagcaagaggacagctgctgacaaggacagaggagaagaagatgctgatggcagcaagacccaggacctcttcagaagagtgcgcagcatcctgaacaagctgaccccccagatgttccagcagctgatgaagcaggtgacccagctggccatcgacacagaggagcggctgaagggcgtgattgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaggccgccacagctgaggagcggggccgcctgaaggaggagctggaggaggcccgggacatcgcccggcggcgcagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgccccggcggggggaccagggccccaagaccatcgaccagatccacaaggaggccgagatggaggagcaccgggagcacatcaaggtgcagcagctgatggccaagggcagtgacaagaggcggggcggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaagatcgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacatcggggcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaagggcgtggccctgaagtctgtgacagccttcttcaagtggctgcgggaggccgaggaggagagtgaccacaactag

SEQ ID NO: 19569 - DNA, 4212 bp, Artificial Sequence
  Description of Artificial Sequence: Synthetic coding sequence
atgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgctgctgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaggaggacaagatccacaatgctgagaacatccagcctggagagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggccctgctggcctgggcccccggcgcagccagcagggccccaggaaggagcccaggaagatcatcgccaccgtgctgatgacagaggacatcaagctgaacaaggccgagaaggcctggaagcccagcagcaagaggacagctgctgacaaggacagaggagaggaggatgctgatggcagcaagacccaggacctcttccggcgggtgcgcagcatcctgaacaagctgaccccccagatgttccagcagctgatgaagcaggtgacccagctggccatcgacacagaggagcggctgaagggcgtcatcgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaagctgccacagctgaggagcggggccgcctgaaggaggagctggaggaggcccgggacatcgccaggagaagaagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgcccaggagaggagaccagggccccaagaccatcgaccagatccacaaggaggccgagatggaggagcaccgggagcacatcaaggtgcagcagctgatggccaagggcagtgacaagagaagaggaggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaggaccgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacattggagcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaaaggagtggccctgaagtctgtgacagccttcttcaagtggctgcgggaggccgaggaggagagtgaccacaactag

SEQ ID NO: 19570 - DNA, 4311 bp, Artificial Sequence
  Description of Artificial Sequence: Synthetic coding sequence
atgaaccagcccccccagatcgcccccaagcgggagaggaagaccatccgcatccgggaccccaaccagggcggcaaggacatcacagaggagatcatgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggaggagctgctgcccccagagagcacccccatcccagccaacctgagccagaacctggaggccgctgctgccacccaggtggccgtgtctgtgcccaagagaagaaggaagatcaaggagctgaacaagaaggaggccgtgggggacctgctggatgccttcaaggaggccaacccagctgtgcctgaggtggagaaccagcccccagctggcagcaaccctggccctgagagcgagggcagcggcgtgccccccaggcctgaggaggctgatgagacctgggacagcaaggaggacaagatccacaatgctgagaacatccagcctggagagcagaagtatgagtacaagagtgaccagtggaagcccctgaacctggaggagaagaagagatatgaccgggagttcctgctgggcttccagttcatctttgcctccatgcagaagccagagggcctgccccacatcagtgatgtggtgctggacaaggccaacaagacccccctgcggcccctggaccccacccggctgcagggcatcaactgtggccctgacttcacccccagctttgccaacctgggccgcaccaccctgagcacccggggccccccccggggcggccctggaggagagctgccccggggcccccaggccggcctgggccccaggaggagccagcagggccccaggaaggagcccaggaagatcatcgccaccgtgctgatgacagaggacatcaagctgaacaaggccgagaaggcctggaagcccagcagcaagaggacagctgctgacaaggacagaggagaagaagatgctgatggcagcaagacccaggacctcttcagaagagtgcgcagcatcctgaacaagctgaccccccagatgttccagcagctgatgaagcaggtgacccagctggccatcgacacagaggagcggctgaagggcgtgattgacctgatctttgagaaggccatcagcgagcccaacttctctgtggcctatgccaacatgtgccgctgcctgatggccctgaaggtgcccaccacagagaagcccaccgtgacagtgaacttcaggaagctgctgctgaaccgctgccagaaggagtttgagaaggacaaggatgatgatgaggtgtttgagaagaagcagaaggagatggatgaggccgccacagctgaggagcggggccgcctgaaggaggagctggaggaggcccgggacatcgcccggcggcgcagcctgggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcatcaaggagaagaagaccagcagccgcatccgcttcatgctgcaggatgtgctggacctgcggggcagcaactgggtgccccggcggggggaccagggccccaagaccatcgaccagatccacaaggaggccgagatggaggagcaccgggagcacatcaaggtgcagcagctgatggccaagggcagtgacaagaggcggggcggccccccaggcccccccatcagccggggcctgcccctggtggatgatggcggctggaacacagtgcccatcagcaagggcagccggcccatcgacaccagccggctgaccaagatcaccaagccaggcagcattgacagcaacaaccagctgtttgcccctgggggccgcctgtcctggggcaagggcagcagcggcggcagcggggccaagcccagtgatgctgccagcgaggccgcccggcctgccaccagcaccctgaaccgcttcagcgccctgcagcaggccgtgcccacagagagcacagacaacagaagagtggtgcagaggagcagcctgagccgggagcggggggagaaggccggggacagaggagaccggctggagaggtctgagcggggcggggacagaggagaccggctggaccgggcccggaccccagccaccaagaggagcttcagcaaggaggtggaggagaggagccgggagcggcccagccagcctgagggcctgaggaaggccgccagcctgacagaagatcgggaccggggcagagatgctgtgaagcgggaggccgccctgccccctgtgagccccctgaaggccgccctgtctgaggaggagctggagaagaagagcaaggccatcatcgaggagtacctgcacctgaatgacatgaaggaggccgtgcagtgtgtgcaggagctggccagccccagcctgctcttcatctttgtgagacatggagtggagagcaccctggagaggtctgccatcgcccgggagcacatgggccagctgctgcaccagctgctgtgtgccggccacctgagcacagcccagtactaccagggcctgtatgagatcctggagctggccgaggacatggagattgacatcccccacgtgtggctgtacctggccgagctggtgacccccatcctgcaggagggcggcgtgcccatgggagagctgttccgggagatcaccaagcccctgcggcccctgggcaaggccgccagcctgctgctggagatcctgggcctgctgtgcaagtccatgggccccaagaaggtgggcaccctgtggagggaggccggcctgtcctggaaggagttcctgcctgagggccaggacatcggggcctttgtggccgagcagaaggtggagtacaccctgggggaggagagcgaggcccctggccagagggccctgcccagcgaggagctgaaccggcagctggagaagctgctgaaggagggcagcagcaaccagagggtgtttgactggattgaggccaacctgtctgagcagcagatcgtgagcaacaccctggtgcgggccctgatgacagctgtgtgctacagcgccatcatctttgagacccccctgcgggtggatgtggccgtgctgaaggcccgggccaagctgctgcagaagtacctgtgtgatgagcagaaggagctgcaggccctgtatgccctgcaggccctggtggtgaccctggagcagccccccaacctgctgaggatgttctttgatgccctgtatgatgaagatgtggtgaaggaggatgccttctacagctgggagagcagcaaggaccctgctgagcagcagggcaagggcgtggccctgaagtctgtgacagccttcttcaagtggctgcgggaggccgaggaggagagtgaccacaactag

SEQ ID NO: 19571 - DNA, 384 bp, Artificial Sequence
  Description of Artificial Sequence: Synthetic coding sequence
atgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagccctag

SEQ ID NO: 19572 - DNA, 264 bp, Artificial Sequence
  Description of Artificial Sequence: Synthetic coding sequence
atgaacacccccagccagccccggcagcacttctaccccagccgggcccagccccccagcagcgctgccagccgggtgcagagcgctgccccagcccggcccggccctgctgcccacgtgtacccagctggcagccaggtgatgatgatccccagccagatctcctacccagccagccagggcgcctactacatccctggccagggccgcagcacctacgtggtgcccacccagcagtaccctgtgcagcccggggccccctag

SEQ ID NO: 19573 - DNA, 858 bp, Artificial Sequence
  Description of Artificial Sequence: Synthetic coding sequence
atgtctggggccaggacagccagcacccccaccccaccccagacaggaggcggcctggagccccaggccaacggggagaccccccaggtggccgtgattgtgcggccagatgacaggagccagggcgccatcatcgctgacaggcctggcctgcccggccctgagcacagccccagcgagagccagcccagcagccccagccccacccccagccccagccctgtgctggagcccggcagcgagcccaacctggccgtgctgagcatccctggggacaccatgaccaccatccagatgtctgtggaggagagcacccccatcagccgggagactggagagccctaccgcctgagccctgagcccacccccctggccgagcccatcctggaggtggaggtgaccctgagcaagcctgtgcctgagagcgagttcagcagcagccccctgcaggcccccacccccctggccagccacacagtggagatccacgagcccaacggcatggtgcccagcgaggacctggagcctgaggtggagagcagccctgagctggcccctcctccagcctgccccagcgagagccctgtgcccatcgcccccacagcccagcctgaggagctgctgaatggagcccccagccccccagctgtggacctgagccctgtgtctgagcctgaggagcaggccaaggaggtgacagcctccatggccccacccaccatccccagcgccaccccagccacagcccccagcgccaccagccctgcccaggaggaggagatggaggaggaggaggaggaggaggagggggaggccggggaggccggggaggccgagagcgagaagggcggggagtag

SEQ ID NO: 19574 - DNA, 1836 bp, Artificial Sequence
  Description of Artificial Sequence: Synthetic coding sequence
atggccgccagcgccaagaagaagaacaagaagggcaagaccatcagcctgacagacttcctggctgaagatggcggcactggaggcggcagcacctacgtgtccaagcctgtgtcctgggcagatgaaacagatgacctggagggagatgtgtccaccacctggcacagcaatgatgatgatgtgtaccgggccccacccatcgacaggagcatcctgcccacagcccccagggctgcccgggagcccaacatcgacaggagccggctgcccaagagccccccctacacagccttcctgggcaacctgccctatgatgtgacagaggagagcatcaaggagttcttccggggcctgaacatctctgctgtgcggctgccccgggagcccagcaaccctgagcggctgaagggcttcggctacgccgagtttgaggacctggacagcctgctgagcgccctgagcctgaatgaggagagcctgggcaacagacgcatccgggtggatgtggccgaccaggcccaggacaaggacagagatgacaggagctttggccgggacaggaacagagacagcgacaagacagacacagactggagggcccggcctgccacagacagctttgatgactacccacccaggagaggagatgacagctttggagacaagtacagagacagatatgacagcgaccgctacagagatggctacagagatggctacagagatggcccccggcgggacatggacagatatggaggccgggacagatatgatgaccggggcagccgggactatgaccggggctatgacagccgcatcggcagcggccggcgggcctttggaagtggctacagaagagatgatgactacagaggaggaggagacagatatgaagatagatatgacagaagagatgaccgctcctggagcagcagagatgactacagcagagatgactacagaagagatgaccggggccccccccagaggcccaagctgaacctgaagcccaggagcacccccaaggaggatgacagcagcgccagcaccagccagagcaccagggctgccagcatctttggaggagccaagcctgtggacacagctgcccgggagcgggaggtggaggagcggctgcagaaggagcaggagaagctgcagaggcagctggatgagcccaagctggagcggcggccccgggagcggcaccccagctggaggtctgaggagacccaggagcgggagaggagcaggacaggcagcgagagcagccagacaggcaccagcaccaccagcagcagaaatgccaggagaagagagagcgagaagagcctggagaatgagaccctgaacaaggaggaggactgccacagccccaccagcaagccacccaagccagaccagcccctgaaggtgatgcctgcccccccacccaaggaaaatgcctgggtgaagaggagcagcaaccccccagcccggagccagagcagtgacacagagcagcagagccccaccagcggcggcggcaaggtggccccagcccagcccagcgaggagggccctggcaggaaggatgagaacaaggtggatggcatgaatgcccccaagggccagacaggcaacagcagccggggccctggagatggcggcaacagagaccactggaaggagagtgacaggaaggatggcaagaaggaccaggacagccgcagcgcccctgagcccaagaagccagaagaaaatcctgccagcaagttcagcagcgccagcaaatatgctgccctgtctgtggatggagaagatgaaaatgaaggagaagattatgcagagtag

SEQ ID NO: 19575 - DNA, 1764 bp, Artificial Sequence
  Description of Artificial Sequence: Synthetic coding sequence
atggccgccagcgccaagaagaagaacaagaagggcaagaccatcagcctgacagacttcctggctgaagatggcggcactggaggcggcagcacctacgtgtccaagcctgtgtcctgggcagatgaaacagatgacctggagggagatgtgtccaccacctggcacagcaatgatgatgatgtgtaccgggccccacccatcgacaggagcatcctgcccacagcccccagggctgcccgggagcccaacatcgacaggagccggctgcccaagagccccccctacacagccttcctgggcaacctgccctatgatgtgacagaggagagcatcaaggagttcttccggggcctgaacatctctgctgtgcggctgccccgggagcccagcaaccctgagcggctgaagggcttcggctacgccgagtttgaggacctggacagcctgctgagcgccctgagcctgaatgaggagagcctgggcaacagacgcatccgggtggatgtggccgaccaggcccaggacaaggacagagatgacaggagctttggccgggacaggaacagagacagcgacaagacagacacagactggagggcccggcctgccacagacagctttgatgactacccacccaggagaggagatgacagctttggagacaagtacagagacagatatggaggccgggacagatatgatgaccggggcagccgggactatgaccggggctatgacagccgcatcggcagcggccggcgggcctttggaagtggctacagaagagatgatgactacagaggaggaggagacagatatgaagatagatatgacagaagagatgaccgctcctggagcagcagagatgactacagcagagatgactacagaagagatgaccggggccccccccagaggcccaagctgaacctgaagcccaggagcacccccaaggaggatgacagcagcgccagcaccagccagagcaccagggctgccagcatctttggaggagccaagcctgtggacacagctgcccgggagcgggaggtggaggagcggctgcagaaggagcaggagaagctgcagaggcagctggatgagcccaagctggagcggcggccccgggagcggcaccccagctggaggtctgaggagacccaggagcgggagaggagcaggacaggcagcgagagcagccagacaggcaccagcaccaccagcagcagaaatgccaggagaagagagagcgagaagagcctggagaatgagaccctgaacaaggaggaggactgccacagccccaccagcaagccacccaagccagaccagcccctgaaggtgatgcctgcccccccacccaaggaaaatgcctgggtgaagaggagcagcaaccccccagcccggagccagagcagtgacacagagcagcagagccccaccagcggcggcggcaaggtggccccagcccagcccagcgaggagggccctggcaggaaggatgagaacaaggtggatggcatgaatgcccccaagggccagacaggcaacagcagccggggccctggagatggcggcaacagagaccactggaaggagagtgacaggaaggatggcaagaaggaccaggacagccgcagcgcccctgagcccaagaagccagaagaaaatcctgccagcaagttcagcagcgccagcaaatatgctgccctgtctgtggatggagaagatgaaaatgaaggagaagattatgcagagtag

SEQ ID NO: 19576 - DNA, 714 bp, Artificial Sequence
  Description of Artificial Sequence: Synthetic coding sequence
atgctggacctgaccagccggggccaggtgggcaccagcaggaggatggccgaggccgcctgcagcgcccacttcctggagaccacccccacccccaacccccccaccacagaggaggagaagacagagagcaaccaggaggtggccaaccctgagcactacatcaagcaccccctgcagaaccgctgggccctgtggttcttcaagaatgacaagagcaagacctggcaggccaacctgcggctcatcagcaagtttgacacagtggaggacttctgggccctgtacaaccacatccagctgagcagcaacctgatgcctggctgtgactacagcctcttcaaggatggcatcgagcccatgtgggaggatgagaagaacaagaggggcggccgctggctgatcaccctgaacaagcagcagaggagaagtgacctggaccgcttctggctggagaccctgctgtgcctgattggagagagctttgatgactacagtgatgatgtgtgtggggctgtggtgaatgtgcgggccaagggggacaagatcgccatctggaccacagaatgtgaaaatcgggaggccgtgacccacatcggccgggtgtacaaggagcggctgggcctgccccccaagatcgtgattggctaccagagccatgctgacacagccaccaagagcggcagcaccaccaagaacagatttgtggtgtag

SEQ ID NO: 19577 - DNA, 654 bp, Artificial Sequence
  Description of Artificial Sequence: Synthetic coding sequence
atggccaccgtggagcctgagaccacccccacccccaacccccccaccacagaggaggagaagacagagagcaaccaggaggtggccaaccctgagcactacatcaagcaccccctgcagaaccgctgggccctgtggttcttcaagaatgacaagagcaagacctggcaggccaacctgcggctcatcagcaagtttgacacagtggaggacttctgggccctgtacaaccacatccagctgagcagcaacctgatgcctggctgtgactacagcctcttcaaggatggcatcgagcccatgtgggaggatgagaagaacaagaggggcggccgctggctgatcaccctgaacaagcagcagaggagaagtgacctggaccgcttctggctggagaccctgctgtgcctgattggagagagctttgatgactacagtgatgatgtgtgtggggctgtggtgaatgtgcgggccaagggggacaagatcgccatctggaccacagaatgtgaaaatcgggaggccgtgacccacatcggccgggtgtacaaggagcggctgggcctgccccccaagatcgtgattggctaccagagccatgctgacacagccaccaagagcggcagcaccaccaagaacagatttgtggtgtag

SEQ ID NO: 19578 - DNA, 747 bp, Artificial Sequence
  Description of Artificial Sequence: Synthetic coding sequence
atggccaccgtggagcctgagaccacccccacccccaacccccccaccacagaggaggagaagacagagagcaaccaggaggtggccaaccctgagcactacatcaagcaccccctgcagaaccgctgggccctgtggttcttcaagaatgacaagagcaagacctggcaggccaacctgcggctcatcagcaagtttgacacagtggaggacttctgggccctgtacaaccacatccagctgagcagcaacctgatgcctggctgtgactacagcctcttcaaggatggcatcgagcccatgtgggaggatgagaagaacaagaggggcggccgctggctgatcaccctgaacaagcagcagaggagaagtgacctggaccgcttctggctggagacccgctgggacctggccatgctgccccggctggtgagcaacttctggccccaggtgatcctgcccctgcagccccccaaggtgctggagctgcagctgctgtgcctgattggagagagctttgatgactacagtgatgatgtgtgtggggctgtggtgaatgtgcgggccaagggggacaagatcgccatctggaccacagaatgtgagaaccgggaggccgtgacccacatcggccgggtgtacaaggagcggctgggcctgccccccaagatcgtcatcggctaccagagccacgccgacacagccaccaagagcggcagcaccaccaagaacagatttgtggtgtag

SEQ ID NO: 19579 - DNA, 357 bp, Artificial Sequence
  Description of Artificial Sequence: Synthetic coding sequence
atgtctgggggcagcagctgcagccagacccccagccgggccatcccagccaccaggagagtggtgctgggagatggagtgcagctgcccccaggggactacagcaccacccctgggggcaccctcttcagcaccaccccaggcggcacccgcatcatctatgacaggaagttcctgatggagtgcaggaacagccctgtgaccaagaccccaccccgggacctgcccaccatccctggggtgaccagccccagcagtgatgagccccccatggaggccagccagagccacctgaggaacagccctgaggacaagagagctggaggagaggagagccagtttgagatggacatctag

SEQ ID NO: 19580 - DNA, 1857 bp, Artificial Sequence
  Description of Artificial Sequence: Synthetic coding sequence
atggccagcacagactacagcacctacagccaggccgccgcccagcagggctacagcgcctacacagcccagcccacccagggctacgcccagaccacccaggcctacggccagcagagctatggcacctacggccagcccacagatgtgtcctacacccaggcccagaccacagccacctacggccagacagcctatgccaccagctatggccagcccccaacaggctacaccacccccacagccccccaggcctacagccagcctgtgcagggctatggaactggagcctatgacaccaccacagccaccgtgaccaccacccaggccagctatgctgcccagagcgcctacggcacccagcctgcctacccagcctacggccagcagcctgctgccacagcccccacccggccccaggacggcaacaagcccacagagaccagccagccccagagcagcactggaggctacaaccagcccagcctgggctacggccagagcaactacagctacccccaggtgcccggcagctaccccatgcagcctgtgacagcccctccttcctacccacccaccagctacagcagcacccagcccaccagctatgaccagagcagctacagccagcagaacacctacggccagcccagcagctatggccagcagagcagctatggccagcagagcagctatggccagcagccccccaccagctacccaccccagacaggcagctacagccaggcccccagccagtacagccagcagagcagcagctatggccagcagagcagcttccggcaggaccaccccagctccatgggcgtgtatggccaggagagcggcggcttcagcggccctggagagaacagatccatgagcggccctgacaacagaggccggggccggggcggctttgaccggggcggcatgagccgggaccctgatgaggacagcgacaacagcgccatctacgtgcagggcctgaatgattctgtgaccctggatgacctggccgacttcttcaagcagtgtggggtggtgaagatgaacaagaggacaggccagcccatgatccacatctacctggacaaggagaccgggaagcccaagggagatgccaccgtgtcctatgaggaccccccaacagccaaggctgctgtggagtggtttgatggcaaggacttccagggcagcaagctgaaggtgtccctggccaggaagaagccacccatgaacagcatgaggggcggcctgcccccccgggagggccggggcatgcccccacccctgcggggcggccctgggggccctgggggccctgggggccccatgggccgcatgggcggccggggcggggacagaggaggcttccccccccggggcccccggggcagccggggcaaccccagcggcggcggcaatgtgcagcacagagctggggactggcagtgccccaaccctggctgcggcaaccagaactttgcctggaggacagagtgcaaccagtgcaaggcccccaagccagagggcttcctgcccccacccttccccccacctggaggagaccggggccggggcggccctgggggcatgagaggaggccggggcggcctgatggaccggggcggccctgggggcatgttccggggcggccggggcggggacagaggaggcttccggggcggccggggcatggaccggggcggctttggaggcggccggcggggcggccctgggggccccccaggccccctgatggagcagatgggcggccggcggggcggccggggcggccctgggaagatggacaagggggagcaccggcaggagcggcgggaccggccctactag

SEQ ID NO: 19581 - DNA, 1803 bp, Artificial Sequence
  Description of Artificial Sequence: Synthetic coding sequence
atggccagcacagactacagcacctacagccaggccgccgcccagcagggctacagcgcctacacagcccagcccacccagggctacgcccagaccacccaggcctacggccagcagagctatggcacctacggccagcccacagatgtgtcctacacccaggcccagaccacagccacctacggccagacagcctatgccaccagctatggccagcccccaacaggctacaccacccccacagccccccaggcctacagccagcctgtgcagggctatggaactggagcctatgacaccaccacagccaccgtgaccaccacccaggccagctatgctgcccagagcgcctacggcacccagcctgcctacccagcctacggccagcagcctgctgccacagcccccaccagctacagcagcacccagcccaccagctatgaccagagcagctacagccagcagaacacctacggccagcccagcagctatggccagcagagcagctatggccagcagagcagctatggccagcagccccccaccagctacccaccccagacaggcagctacagccaggcccccagccagtacagccagcagagcagcagctatggccagcagagcagcttccggcaggaccaccccagctccatgggcgtgtatggccaggagagcggcggcttcagcggccctggagagaacagatccatgagcggccctgacaacagaggccggggccggggcggctttgaccggggcggcatgagcagaggaggccggggcggcggccggggcggcatgggcagcgctggggagcggggcggcttcaacaagccaggcggccccatggatgagggccctgacctggacctgggcccccctgtggaccctgatgaggacagcgacaacagcgccatctacgtgcagggcctgaatgattctgtgaccctggatgacctggccgacttcttcaagcagtgtggggtggtgaagatgaacaagaggacaggccagcccatgatccacatctacctggacaaggagaccgggaagcccaagggagatgccaccgtgtcctatgaggaccccccaacagccaaggctgctgtggagtggtttgatggcaaggacttccagggcagcaagctgaaggtgtccctggccaggaagaagccacccatgaacagcatgaggggcggcctgcccccccgggagggccggggcatgcccccacccctgcggggcggccctgggggccctgggggccctgggggccccatgggccgcatgggcggccggggcggggacagaggaggcttccccccccggggcccccggggcagccggggcaaccccagcggcggcggcaatgtgcagcacagagctggggactggcagtgccccaaccctggctgcggcaaccagaactttgcctggaggacagagtgcaaccagtgcaaggcccccaagccagagggcttcctgcccccacccttccccccacctggaggagaccggggccggggcggccctgggggcatgagaggaggccggggcggcctgatggaccggggcggccctgggggcatgttccggggcggccggggcggggacagaggaggcttccggggcggccggggcatggaccggggcggctttggaggcggccggcggggcggccctgggggccccccaggccccctgatggagcagatgggcggccggcggggcggccggggcggccctgggaagatggacaagggggagcaccggcaggagcggcgggaccggccctactag

SEQ ID NO: 19582 - DNA, 1752 bp, Artificial Sequence
  Description of Artificial Sequence: Synthetic coding sequence
atggccagcacagactacagcacctacagccaggccgccgcccagcagggctacagcgcctacacagcccagcccacccagggctacgcccagaccacccaggcctacggccagcagagctatggcacctacggccagcccacagatgtgtcctacacccaggcccagaccacagccacctacggccagacagcctatgccaccagctatggccagcccccaacaggctacaccacccccacagccccccaggcctacagccagcctgtgcagggctatggaactggagcctatgacaccaccacagccaccgtgaccaccacccaggccagctatgctgcccagagcgcctacggcacccagcctgcctacccagcctacggccagcagcctgctgccacagcccccacccggccccaggacggcaacaagcccacagagaccagccagccccagagcagcactggaggctacaaccagcccagcctgggctacggccagagcaactacagctacccccaggtgcccggcagctaccccatgcagcctgtgacagcccctccttcctacccacccaccagctacagcagcacccagcccaccagctatgaccagagcagctacagccagcagaacacctacggccagcccagcagctatggccagcagagcagctatggccagcagagcagctatggccagcagccccccaccagctacccaccccagacaggcagctacagccaggcccccagccagtacagccagcagagcagcagctatggccagcagaggcccatggatgagggccctgacctggacctgggcccccctgtggaccctgatgaagattctgacaacagcgccatctacgtgcagggcctgaatgacagcgtgaccctggatgacctggccgacttcttcaagcagtgtggggtggtgaagatgaacaagaggacaggccagcccatgatccacatctacctggacaaggagaccgggaagcccaagggagatgccaccgtgtcctatgaagatcctcccacagccaaggctgctgtggagtggtttgatggcaaggacttccagggcagcaagctgaaggtgtccctggccaggaagaagccacccatgaacagcatgagaggaggcctgcccccccgggagggccggggcatgcccccacccctgcggggcggccctgggggccctgggggccctgggggccccatgggccgcatgggcggccggggcggggaccggggcggcttccccccccggggcccccggggcagccggggcaaccccagcggcggcggcaatgtgcagcaccgggccggggactggcagtgccccaaccctggctgcggcaaccagaactttgcctggaggacagagtgcaaccagtgcaaggcccccaagccagagggcttcctgcccccacccttccccccacctggaggagaccggggccggggcggccctgggggcatgaggggcggccggggcggcctgatggacagaggaggccctgggggcatgttccggggcggccggggcggggaccggggcggcttccggggcggccggggcatggacagaggaggctttggaggcggcagaagaggaggccctgggggccccccaggccccctgatggagcagatgggcggcagaagaggaggccggggcggccctgggaagatggacaagggggagcaccggcaggagcggcgggaccggccctactag

SEQ ID NO: 19583 - DNA, 1971 bp, Artificial Sequence
  Description of Artificial Sequence: Synthetic coding sequence
atggccagcacagactacagcacctacagccaggccgccgcccagcagggctacagcgcctacacagcccagcccacccagggctacgcccagaccacccaggcctacggccagcagagctatggcacctacggccagcccacagatgtgtcctacacccaggcccagaccacagccacctacggccagacagcctatgccaccagctatggccagcccccaacaggctacaccacccccacagccccccaggcctacagccagcctgtgcagggctatggaactggagcctatgacaccaccacagccaccgtgaccaccacccaggccagctatgctgcccagagcgcctacggcacccagcctgcctacccagcctacggccagcagcctgctgccacagcccccacccggccccaggacggcaacaagcccacagagaccagccagccccagagcagcactggaggctacaaccagcccagcctgggctacggccagagcaactacagctacccccaggtgcccggcagctaccccatgcagcctgtgacagcccctccttcctacccacccaccagctacagcagcacccagcccaccagctatgaccagagcagctacagccagcagaacacctacggccagcccagcagctatggccagcagagcagctatggccagcagagcagctatggccagcagccccccaccagctacccaccccagacaggcagctacagccaggcccccagccagtacagccagcagagcagcagctatggccagcagagcagcttccggcaggaccaccccagctccatgggcgtgtatggccaggagagcggcggcttcagcggccctggagagaacagatccatgagcggccctgacaacagaggccggggccggggcggctttgaccggggcggcatgagcagaggaggccggggcggcggccggggcggcatgggcagcgctggggagcggggcggcttcaacaagccaggcggccccatggatgagggccctgacctggacctgggcccccctgtggaccctgatgaggacagcgacaacagcgccatctacgtgcagggcctgaatgattctgtgaccctggatgacctggccgacttcttcaagcagtgtggggtggtgaagatgaacaagaggacaggccagcccatgatccacatctacctggacaaggagaccgggaagcccaagggagatgccaccgtgtcctatgaggaccccccaacagccaaggctgctgtggagtggtttgatggcaaggacttccagggcagcaagctgaaggtgtccctggccaggaagaagccacccatgaacagcatgaggggcggcctgcccccccgggagggccggggcatgcccccacccctgcggggcggccctgggggccctgggggccctgggggccccatgggccgcatgggcggccggggcggggacagaggaggcttccccccccggggcccccggggcagccggggcaaccccagcggcggcggcaatgtgcagcacagagctggggactggcagtgccccaaccctggctgcggcaaccagaactttgcctggaggacagagtgcaaccagtgcaaggcccccaagccagagggcttcctgcccccacccttccccccacctggaggagaccggggccggggcggccctgggggcatgagaggaggccggggcggcctgatggaccggggcggccctgggggcatgttccggggcggccggggcggggacagaggaggcttccggggcggccggggcatggaccggggcggctttggaggcggccggcggggcggccctgggggccccccaggccccctgatggagcagatgggcggccggcggggcggccggggcggccctgggaagatggacaagggggagcaccggcaggagcggcgggaccggccctactag

SEQ ID NO: 19584 - DNA, 1968 bp, Artificial Sequence
  Description of Artificial Sequence: Synthetic coding sequence
atggccagcacagactacagcacctacagccaggccgccgcccagcagggctacagcgcctacacagcccagcccacccagggctacgcccagaccacccaggcctacggccagcagagctatggcacctacggccagcccacagatgtgtcctacacccaggcccagaccacagccacctacggccagacagcctatgccaccagctatggccagcccccaacaggctacaccacccccacagccccccaggcctacagccagcctgtgcagggctatggaactggagcctatgacaccaccacagccaccgtgaccaccacccaggccagctatgctgcccagagcgcctacggcacccagcctgcctacccagcctacggccagcagcctgctgccacagcccccacccggccccaggacggcaacaagcccacagagaccagccagccccagagcagcactggaggctacaaccagcccagcctgggctacggccagagcaactacagctacccccaggtgcccggcagctaccccatgcagcctgtgacagcccctccttcctacccacccaccagctacagcagcacccagcccaccagctatgaccagagcagctacagccagcagaacacctacggccagcccagcagctatggccagcagagcagctatggccagcagagcagctatggccagcagccccccaccagctacccaccccagacaggcagctacagccaggcccccagccagtacagccagcagagcagcagctatggccagcagagcagcttccggcaggaccaccccagctccatgggcgtgtatggccaggagagcggcggcttcagcggccctggagagaacagatccatgagcggccctgacaacagaggccggggccggggcggctttgaccggggcggcatgagcagaggaggccggggcggcggccggggcggcatgggcgctggggagcggggcggcttcaacaagccaggcggccccatggatgagggccctgacctggacctgggcccccctgtggaccctgatgaagattctgacaacagcgccatctacgtgcagggcctgaatgacagcgtgaccctggatgacctggccgacttcttcaagcagtgtggggtggtgaagatgaacaagaggacaggccagcccatgatccacatctacctggacaaggagaccgggaagcccaagggagatgccaccgtgtcctatgaagatcctcccacagccaaggctgctgtggagtggtttgatggcaaggacttccagggcagcaagctgaaggtgtccctggccaggaagaagccacccatgaacagcatgagaggaggcctgcccccccgggagggccggggcatgcccccacccctgcggggcggccctgggggccctgggggccctgggggccccatgggccgcatgggcggccggggcggggaccggggcggcttccccccccggggcccccggggcagccggggcaaccccagcggcggcggcaatgtgcagcaccgggccggggactggcagtgccccaaccctggctgcggcaaccagaactttgcctggaggacagagtgcaaccagtgcaaggcccccaagccagagggcttcctgcccccacccttccccccacctggaggagaccggggccggggcggccctgggggcatgaggggcggccggggcggcctgatggacagaggaggccctgggggcatgttccggggcggccggggcggggaccggggcggcttccggggcggccggggcatggacagaggaggctttggaggcggcagaagaggaggccctgggggccccccaggccccctgatggagcagatgggcggcagaagaggaggccggggcggccctgggaagatggacaagggggagcaccggcaggagcggcgggaccggccctactag

SEQ ID NO: 19585 - DNA, 1986 bp, Artificial Sequence
  Description of Artificial Sequence: Synthetic coding sequence
atggccagcacagactacagcacctacagccaggccgccgcccagcagggctacagcgcctacacagcccagcccacccagggctacgcccagaccacccaggcctacggccagcagagctatggcacctacggccagcccacagatgtgtcctacacccaggcccagaccacagccacctacggccagacagcctatgccaccagctatggccagcccccaacagtggagggcaccagcacaggctacaccacccccacagccccccaggcctacagccagcctgtgcagggctatggaactggagcctatgacaccaccacagccaccgtgaccaccacccaggccagctatgctgcccagagcgcctacggcacccagcctgcctacccagcctacggccagcagcctgctgccacagcccccacccggccccaggacggcaacaagcccacagagaccagccagccccagagcagcactggaggctacaaccagcccagcctgggctacggccagagcaactacagctacccccaggtgcccggcagctaccccatgcagcctgtgacagcccctccttcctacccacccaccagctacagcagcacccagcccaccagctatgaccagagcagctacagccagcagaacacctacggccagcccagcagctatggccagcagagcagctatggccagcagagcagctatggccagcagccccccaccagctacccaccccagacaggcagctacagccaggcccccagccagtacagccagcagagcagcagctatggccagcagagcagcttccggcaggaccaccccagctccatgggcgtgtatggccaggagagcggcggcttcagcggccctggagagaacagatccatgagcggccctgacaacagaggccggggccggggcggctttgaccggggcggcatgagcagaggaggccggggcggcggccggggcggcatgggcgctggggagcggggcggcttcaacaagccaggcggccccatggatgagggccctgacctggacctgggcccccctgtggaccctgatgaagattctgacaacagcgccatctacgtgcagggcctgaatgacagcgtgaccctggatgacctggccgacttcttcaagcagtgtggggtggtgaagatgaacaagaggacaggccagcccatgatccacatctacctggacaaggagaccgggaagcccaagggagatgccaccgtgtcctatgaagatcctcccacagccaaggctgctgtggagtggtttgatggcaaggacttccagggcagcaagctgaaggtgtccctggccaggaagaagccacccatgaacagcatgagaggaggcctgcccccccgggagggccggggcatgcccccacccctgcggggcggccctgggggccctgggggccctgggggccccatgggccgcatgggcggccggggcggggaccggggcggcttccccccccggggcccccggggcagccggggcaaccccagcggcggcggcaatgtgcagcaccgggccggggactggcagtgccccaaccctggctgcggcaaccagaactttgcctggaggacagagtgcaaccagtgcaaggcccccaagccagagggcttcctgcccccacccttccccccacctggaggagaccggggccggggcggccctgggggcatgaggggcggccggggcggcctgatggacagaggaggccctgggggcatgttccggggcggccggggcggggaccggggcggcttccggggcggccggggcatggacagaggaggctttggaggcggcagaagaggaggccctgggggccccccaggccccctgatggagcagatgggcggcagaagaggaggccggggcggccctgggaagatggacaagggggagcaccggcaggagcggcgggaccggccctactag

SEQ ID NO: 19586 - DNA, 543 bp, Artificial Sequence
  Description of Artificial Sequence: Synthetic coding sequence
atggccagcacagactacagcacctacagccaggccgccgcccagcagggctacagcgcctacacagcccagcccacccagggctacgcccagaccacccaggccagctatgctgcccagagcgcctacggcacccagcctgcctacccagcctacggccagcagcctgctgccacagcccccacccggccccaggacggcaacaagcccacagagaccagccagccccagagcagcactggaggctacaaccagcccagcctgggctacggccagagcaactacagctacccccaggtgcccggcagctaccccatgcagcctgtgacagccccacccagctacccacccaccagctacagcagcacccagcccaccagctatgaccagagcagctacagccagcagaacacctacggccagcccagcagctatggccagcagagcagctatggccagcagagcagctatggccagcagccccccaccagctacccaccccagacaggcagctacagccaggcccccagccagtacagctag

SEQ ID NO: 19587 - DNA, 1065 bp, Artificial Sequence
  Description of Artificial Sequence: Synthetic coding sequence
atggccagcacagactacagcacctacagccaggccgccgcccagcagggctacagcgcctacacagcccagcccacccagggctacgcccagaccacccaggcctacggccagcagagctatggcacctacggccagcccacagatgtgtcctacacccaggcccagaccacagccacctacggccagacagcctatgccaccagctatggccagcccccaacaggctacaccacccccacagccccccaggcctacagccagcctgtgcagggctatggaactggagcctatgacaccaccacagccaccgtgaccaccacccaggccagctatgctgcccagagcgcctacggcacccagcctgcctacccagcctacggccagcagcctgctgccacagcccccacccggccccaggacggcaacaagcccacagagaccagccagccccagagcagcactggaggctacaaccagcccagcctgggctacggccagagcaactacagctacccccaggtgcccggcagctaccccatgcagcctgtgacagcccctccttcctacccacccaccagctacagcagcacccagcccaccagctatgaccagagcagctacagccagcagaacacctacggccagcccagcagctatggccagcagagcagctatggccagcagagcagctatggccagcagccccccaccagctacccaccccagacaggcagctacagccaggcccccagccagtacagccagcagagcagcagctatggccagcagagcagcttccggcaggaccaccccagctccatgggcgtgtatggccaggagagcggcggcttcagcggccctggagagaacagatccatgagcggccctgacaacagaggccggggccggggcggctttgaccggggcggcatgagcagaggaggccggggcggcggccggggcggcatgggcctgcagagcgagagcctggtgtacaccagcatcctgaagaagtacccctacagcgtgctgagccggcagcacaatgagaagtgggactag

SEQ ID NO: 19588 - DNA, 972 bp, Artificial Sequence
  Description of Artificial Sequence: Synthetic coding sequence
atggaccccgggaaggacaaggagggcgtgccccagcccagcggccccccagccaggaagaagtttgtgatccccctggatgaagatgaggtgcccccaggagtggccaagcccctcttccgcagcacccagagcctgcccaccgtggacaccagcgcccaggccgccccccagacctatgcagaatatgccatcagccagcccctggagggcgctggggccacctgccccaccggcagcgagcccctggccggggagacccccaaccaggccctgaagccaggggccaagagcaacagcatcatcgtgagcccccggcagaggggcaaccctgtgctgaagtttgtgagaaatgtgccctgggagtttggagatgtgatcccagactatgtgctgggccagagcacctgtgccctcttcctgagcctgcgctaccacaacctgcacccagactacatccacggccgcctgcagagcctgggcaagaactttgccctgcgggtgctgctggtgcaggtggatgtgaaggacccccagcaggccctgaaggagctggccaagatgtgcatcctggccgactgcaccctcatcctggcctggagccctgaggaggccggccgctacctggagacctacaaggcctatgagcagaagccagctgacctgctgatggagaagctggagcaggactttgtgtcccgggtgacagaatgtctgaccaccgtgaagtctgtgaacaagacagacagccagaccctgctgaccaccttcggcagcctggagcagctgattgctgccagccgggaggacctggccctgtgccccggcctgggcccccagaaggtgcgggccctgggcaagaaccccaggtcctggggcaaggagcgggcccccaacaagcacaacctgcggccccagagcttcaaggtgaagaaggagcccaagaccaggcacagcggcttccggctgtag

SEQ ID NO: 19589 - DNA, 894 bp, Artificial Sequence
  Description of Artificial Sequence: Synthetic coding sequence
atggaccccgggaaggacaaggagggcgtgccccagcccagcggccccccagccaggaagaagtttgtgatccccctggatgaagatgaggtgcccccaggagtggccaagcccctcttccgcagcacccagagcctgcccaccgtggacaccagcgcccaggccgccccccagacctatgcagaatatgccatcagccagcccctggagggcgctggggccacctgccccaccggcagcgagcccctggccggggagacccccaaccaggccctgaagccaggggccaagagcaacagcatcatcgtgagcccccggcagaggggcaaccctgtgctgaagtttgtgagaaatgtgccctgggagtttggagatgtgatcccagactatgtgctgggccagagcacctgtgccctcttcctgagcctgcgctaccacaacctgcacccagactacatccacggccgcctgcagagcctgggcaagaactttgccctgcgggtgctgctggtgcaggtggatgtgaaggacccccagcaggccctgaaggagctggccaagatgtgcatcctggccgactgcaccctcatcctggcctggagccctgaggaggccggccgctacctggagacctacaaggcctatgagcagaagccagctgacctgctgatggagaagctggagcaggactttgtgtcccgggtgacagaatgtctgaccaccgtgaagtctgtgaacaagacagacagccagaccctgctgaccaccttcggcagcctggagcagctgattgctgccagccgggaggacctggccctgtgccccggcctgggcccccagaaggcccggcggctgtttgatgtgctgcacgagcccttcctgaaggtgccctag

SEQ ID NO: 19590 - DNA, 822 bp, Artificial Sequence
  Description of Artificial Sequence: Synthetic coding sequence
atggaccccgggaaggacaaggagggcgtgccccagcccagcggccccccagccaggaagaagtttgtgatccccctggatgaagatgaggtgcccccaggagtggccaagcccctcttccgcagcacccagagcctgcccaccgtggacaccagcgcccaggccgccccccagacctatgcagaatatgccatcagccagcccctggagggcgctggggccacctgccccaccggcagcgagcccctggccggggagacccccaaccaggccctgaagccaggggccaagagcaacagcatcatcgtgagcccccggcagaggggcaaccctgtgctgaagtttgtgagaaatgtgccctgggagtttggagatgtgatcccagactatgtgctgggccagagcacctgtgccctcttcctgagcctgcgctaccacaacctgcacccagactacatccacggccgcctgcagagcctgggcaagaactttgccctgcgggtgctgctggtgcaggtggatgtgaaggacccccagcaggccctgaaggagctggccaagatgtgcatcctggccgactgcaccctcatcctggcctggagccctgaggaggccggccgctacctggagacctacaaggcctatgagcagaagccagctgacctgctgatggagaagctggagcaggactttgtgagccgcagcctggagcagctgattgctgccagccgggaggacctggccctgtgccccggcctgggcccccagaaggcccggcggctgtttgatgtgctgcacgagcccttcctgaaggtgccctag

SEQ ID NO: 19591 - DNA, 678 bp, Artificial Sequence
  Description of Artificial Sequence: Synthetic coding sequence
atggaccccgggaaggacaaggagggcgtgccccagcccagcggccccccagccaggaagaagtttgtgatccccctggatgaagatgaggtgcccccaggagtgcggggcaaccctgtgctgaagtttgtgagaaatgtgccctgggagtttggagatgtgatcccagactatgtgctgggccagagcacctgtgccctcttcctgagcctgcgctaccacaacctgcacccagactacatccacggccgcctgcagagcctgggcaagaactttgccctgcgggtgctgctggtgcaggtggatgtgaaggacccccagcaggccctgaaggagctggccaagatgtgcatcctggccgactgcaccctcatcctggcctggagccctgaggaggccggccgctacctggagacctacaaggcctatgagcagaagccagctgacctgctgatggagaagctggagcaggactttgtgtcccgggtgacagaatgtctgaccaccgtgaagtctgtgaacaagacagacagccagaccctgctgaccaccttcggcagcctggagcagctgattgctgccagccgggaggacctggccctgtgccccggcctgggcccccagaaggcccggcggctgtttgatgtgctgcacgagcccttcctgaaggtgccctag

SEQ ID NO: 19592 - DNA, 120 bp, Artificial Sequence
  Description of Artificial Sequence: Synthetic coding sequence
atggaccccgggaaggacaaggagggcgtgccccagcccagcggccccccagccaggaagaagtttgtgatccccctggatgaagatgaggtgcccccaggagtgtccaagcccctgtag

SEQ ID NO: 19593 - DNA, 726 bp, Artificial Sequence
  Description of Artificial Sequence: Synthetic coding sequence
atggccagcctgagcggcctggccagcgccctggagagctaccggggccgggacaggctcatccgggtgctgggctactgctgccagctggtgggcggcgtgctggtggagcagtgcccagcccggtctgaggtgggcacccggctgctggtggtgtccacccagctgagccactgcaggaccatcctgcggctgtttgatgacctggccatgtttgtgtacaccaagcagtatggcctgggcgcccaggaggaggatgcctttgtgcgctgtgtgtctgtgctgggcaacctggccgaccagctgtactacccctgtgagcacgtggcctgggccgcagatgcccgggtgctgcacgtggacagcagccgctggtggaccctgagcaccaccctgtgggccctgagcctgctgctgggcgtggcccggagcctgtggatgctgctgaagctgcggcagaggctgcggagccccacagcccccttcaccagccccctgccccggggcaagagaagagccatggaggcccagatgcagagcgaggccctgagcctgctgagcaacctggccgacctggccaatgctgtgcactggctgccccggggcgtgctgtgggccggccgcttccccccctggctggtgggcctgatgggcaccatcagcagcatcctgtccatgtaccaggccgcccgggccggcggccaggccgaggccaccaccccctag

SEQ ID NO: 19594 - DNA, 1218 bp, Artificial Sequence
  Description of Artificial Sequence: Synthetic coding sequence
atgagggagctgaagaggaccctggatgccaagggccatggagtgctggagatgcccagcggcaccgggaagacagtgtccctgctggccctgatcatggcctaccagagggcctaccccctggaggtgaccaagctgatctactgcagcaggacagtgcctgagattgagaaggtgattgaggagctgaggaagctgctgaacttctatgagaagcaggagggggagaagctgcccttcctgggcctggccctgagcagcaggaagaacctgtgcatccaccctgaggtgacccccctgcgctttgggaaggatgtggatggcaagtgccacagcctgacagccagctatgtgcgggcccagtaccagcacgacaccagcctgccccactgccgcttctatgaggagtttgatgcccacggccgggaggtgcccctgcctgctggcatctacaacctggatgacctgaaggccctgggccggcggcagggctggtgcccctacttcctggcccgctacagcatcctgcacgccaacgtggtggtgtacagctaccactacctgctggaccccaagattgctgacctggtgtccaaggagctggccaggaaggctgtggtggtgtttgatgaggcccacaacatcgacaacgtgtgcatcgacagcatgtctgtgaacctgaccaggaggaccctggaccgctgccagggcaacctggagaccctgcagaagacagtgctgcgcatcaaggagacagatgagcagaggctgagagatgagtaccgccgcctggtggagggcctgcgggaggccagcgctgcccgggagacagatgcccacctggccaaccctgtgctgcctgatgaggtgctgcaggaggccgtgcccggcagcatcagaacagctgagcacttcctgggcttcctgcggcggctgctggagtatgtgaagtggaggctgcgggtgcagcacgtggtgcaggagagccccccagccttcctgagcggcctggcccagagggtgtgcatccagaggaagcccctgcgcttctgtgccgagcggctgcggagcctgctgcacaccctggagatcacagacctggccgacttcagccccctgaccctgctggccaactttgccaccctggtgtccacctacgccaagggccaggcccagcactgcggcagcagcaggaaccagaagaggagccacccctag

SEQ ID NO: 19595 - DNA, 2133 bp, Artificial Sequence
  Description of Artificial Sequence: Synthetic coding sequence
atgagggagctgaagaggaccctggatgccaaggcctaccccctggaggtgaccaagctgatctactgcagcaggacagtgcctgagattgagaaggtgattgaggagctgaggaagctgctgaacttctatgagaagcaggagggggagaagctgcccttcctgggcctggccctgagcagcaggaagaacctgtgcatccaccctgaggtgacccccctgcgctttgggaaggatgtggatggcaagtgccacagcctgacagccagctatgtgcgggcccagtaccagcacgacaccagcctgccccactgccgcttctatgaggagtttgatgcccacggccgggaggtgcccctgcctgctggcatctacaacctggatgacctgaaggccctgggccggcggcagggctggtgcccctacttcctggcccgctacagcatcctgcacgccaacgtggtggtgtacagctaccactacctgctggaccccaagattgctgacctggtgtccaaggagctggccaggaaggctgtggtggtgtttgatgaggcccacaacatcgacaacgtgtgcatcgacagcatgtctgtgaacctgaccaggaggaccctggaccgctgccagggcaacctggagaccctgcagaagacagtgctgcgcatcaaggagacagatgagcagaggctgagagatgagtaccgccgcctggtggagggcctgcgggaggccagcgctgcccgggagacagatgcccacctggccaaccctgtgctgcctgatgaggtgctgcaggaggccgtgcccggcagcatcagaacagctgagcacttcctgggcttcctgcggcggctgctggagtatgtgaagtggaggctgcgggtgcagcacgtggtgcaggagagccccccagccttcctgagcggcctggcccagagggtgtgcatccagaggaagcccctgcgcttctgtgccgagcggctgcggagcctgctgcacaccctggagatcacagacctggccgacttcagccccctgaccctgctggccaactttgccaccctggtgtccacctacgccaagggcttcaccatcatcatcgagccctttgatgacaggacccccaccatcgccaaccccatcctgcacttcagctgcatggatgccagcctggccatcaagcctgtgtttgagcgcttccagagcgtcatcatcaccagcggcaccctgagccccctggacatctaccccaagatcctggacttccaccctgtgaccatggccaccttcaccatgaccctggcccgggtgtgcctgtgccccatgatcatcggcagaggaaatgaccaggtggccatcagcagcaagtttgagacccgggaggacattgctgtgatccggaactacggcaacctgctgctggagatgtctgctgtggtgcctgatggcatcgtggccttcttcaccagctaccagtacatggagagcacagtggcctcctggtatgagcagggcatcctggagaacatccagaggaacaagctgctcttcatcgagacccaggatggagctgagacctctgtggccctggagaagtaccaggaggcctgtgaaaatggccgcggggccatcctgctgtctgtggcccggggcaaggtgtctgagggcatcgactttgtgcaccactacggccgggctgtgatcatgtttggagtgccctacgtgtacacccagagccgcatcctgaaggcccggctggagtacctgcgggaccagttccagatccgggagaatgacttcctgacctttgatgccatgagacatgctgcccagtgtgtgggccgggccatccggggcaagacagattatggcctgatggtgtttgctgacaagagatttgcccggggggacaagaggggcaagctgccccgctggatccaggagcacctgacagatgccaacctgaacctgactgtggatgaaggagtgcaggtggccaagtacttcctgcggcagatggcccagcccttccaccgggaggaccagctgggcctgagcctgctgagcctggagcagctggagagcgaggagaccctgaagagaattgagcagatcgcccagcagctgtag

SEQ ID NO: 19596 - DNA, 2211 bp, Artificial Sequence
  Description of Artificial Sequence: Synthetic coding sequence
atgagggagctgaagaggaccctggatgccaagggccatggagtgctggagatgcccagcggcaccgggaagacagtgtccctgctggccctgatcatggcctaccagagggcctaccccctggaggtgaccaagctgatctactgcagcaggacagtgcctgagattgagaaggtgattgaggagctgaggaagctgctgaacttctatgagaagcaggagggggagaagctgcccttcctgggcctggccctgagcagcaggaagaacctgtgcatccaccctgaggtgacccccctgcgctttgggaaggatgtggatggcaagtgccacagcctgacagccagctatgtgcgggcccagtaccagcacgacaccagcctgccccactgccgcttctatgaggagtttgatgcccacggccgggaggtgcccctgcctgctggcatctacaacctggatgacctgaaggccctgggccggcggcagggctggtgcccctacttcctggcccgctacagcatcctgcacgccaacgtggtggtgtacagctaccactacctgctggaccccaagattgctgacctggtgtccaaggagctggccaggaaggctgtggtggtgtttgatgaggcccacaacatcgacaacgtgtgcatcgacagcatgtctgtgaacctgaccaggaggaccctggaccgctgccagggcaacctggagaccctgcagaagacagtgctgcgcatcaaggagacagatgagcagaggctgagagatgagtaccgccgcctggtggagggcctgcgggaggccagcgctgcccgggagacagatgcccacctggccaaccctgtgctgcctgatgaggtgctgcaggaggccgtgcccggcagcatcagaacagctgagcacttcctgggcttcctgcggcggctgctggagtatgtgaagtggaggctgcgggtgcagcacgtggtgcaggagagccccccagccttcctgagcggcctggcccagagggtgtgcatccagaggaagcccctgcgcttctgtgccgagcggctgcggagcctgctgcacaccctggagatcacagacctggccgacttcagccccctgaccctgctggccaactttgccaccctggtgtccacctacgccaagggcttcaccatcatcatcgagccctttgatgacaggacccccaccatcgccaaccccatcctgcacttcagctgcatggatgccagcctggccatcaagcctgtgtttgagcgcttccagagcgtcatcatcaccagcggcaccctgagccccctggacatctaccccaagatcctggacttccaccctgtgaccatggccaccttcaccatgaccctggcccgggtgtgcctgtgccccatgatcatcggcagaggaaatgaccaggtggccatcagcagcaagtttgagacccgggaggacattgctgtgatccggaactacggcaacctgctgctggagatgtctgctgtggtgcctgatggcatcgtggccttcttcaccagctaccagtacatggagagcacagtggcctcctggtatgagcagggcatcctggagaacatccagaggaacaagctgctcttcatcgagacccaggatggagctgagacctctgtggccctggagaagtaccaggaggcctgtgaaaatggccgcggggccatcctgctgtctgtggcccggggcaaggtgtctgagggcatcgactttgtgcaccactacggccgggctgtgatcatgtttggagtgccctacgtgtacacccagagccgcatcctgaaggcccggctggagtacctgcgggaccagttccagatccgggagaatgacttcctgacctttgatgccatgagacatgctgcccagtgtgtgggccgggccatccggggcaagacagattatggcctgatggtgtttgctgacaagagatttgcccggggggacaagaggggcaagctgccccgctggatccaggagcacctgacagatgccaacctgaacctgactgtggatgaaggagtgcaggtggccaagtacttcctgcggcagatggcccagcccttccaccgggaggaccagctgggcctgagcctgctgagcctggagcagctggagagcgaggagaccctgaagagaattgagcagatcgcccagcagctgtag

SEQ ID NO: 19597 - DNA, 2049 bp, Artificial Sequence
  Description of Artificial Sequence: Synthetic coding sequence
atgaagctgaatgtggatggcctgctggtgtacttcccctatgactacatctacccagagcagttctcctacatgagggagctgaagaggaccctggatgccaagggccatggagtgctggagatgcccagcggcaccgggaagacagtgtccctgctggccctgatcatggcctaccagagggcctaccccctggaggtgaccaagctgatctactgcagcaggacagtgcctgagattgagaaggtgattgaggagctgaggaagctgctgaacttctatgagaagcaggagggggagaagctgcccttcctgggcctggccctgagcagcaggaagaacctgtgcatccaccctgagatcctgcacgccaacgtggtggtgtacagctaccactacctgctggaccccaagattgctgacctggtgtccaaggagctggccaggaaggctgtggtggtgtttgatgaggcccacaacatcgacaacgtgtgcatcgacagcatgtctgtgaacctgaccaggaggaccctggaccgctgccagggcaacctggagaccctgcagaagacagtgctgcgcatcaaggagacagatgagcagaggctgagagatgagtaccgccgcctggtggagggcctgcgggaggccagcgctgcccgggagacagatgcccacctggccaaccctgtgctgcctgatgaggtgctgcaggaggccgtgcccggcagcatcagaacagctgagcacttcctgggcttcctgcggcggctgctggagtatgtgaagtggaggctgcgggtgcagcacgtggtgcaggagagccccccagccttcctgagcggcctggcccagagggtgtgcatccagaggaagcccctgcgcttctgtgccgagcggctgcggagcctgctgcacaccctggagatcacagacctggccgacttcagccccctgaccctgctggccaactttgccaccctggtgtccacctacgccaagggcttcaccatcatcatcgagccctttgatgacaggacccccaccatcgccaaccccatcctgcacttcagctgcatggatgccagcctggccatcaagcctgtgtttgagcgcttccagagcgtcatcatcaccagcggcaccctgagccccctggacatctaccccaagatcctggacttccaccctgtgaccatggccaccttcaccatgaccctggcccgggtgtgcctgtgccccatgatcatcggcagaggaaatgaccaggtggccatcagcagcaagtttgagacccgggaggacattgctgtgatccggaactacggcaacctgctgctggagatgtctgctgtggtgcctgatggcatcgtggccttcttcaccagctaccagtacatggagagcacagtggcctcctggtatgagcagggcatcctggagaacatccagaggaacaagctgctcttcatcgagacccaggatggagctgagacctctgtggccctggagaagtaccaggaggcctgtgaaaatggccgcggggccatcctgctgtctgtggcccggggcaaggtgtctgagggcatcgactttgtgcaccactacggccgggctgtgatcatgtttggagtgccctacgtgtacacccagagccgcatcctgaaggcccggctggagtacctgcgggaccagttccagatccgggagaatgacttcctgacctttgatgccatgagacatgctgcccagtgtgtgggccgggccatccggggcaagacagattatggcctgatggtgtttgctgacaagagatttgcccggggggacaagaggggcaagctgccccgctggatccaggagcacctgacagatgccaacctgaacctgactgtggatgaaggagtgcaggtggccaagtacttcctgcggcagatggcccagcccttccaccgggaggaccagctgggcctgagcctgctgagcctggagcagctggagagcgaggagaccctgaagagaattgagcagatcgcccagcagctgtag

SEQ ID NO: 19598 - DNA, 2283 bp, Artificial Sequence
  Description of Artificial Sequence: Synthetic coding sequence
atgaagctgaatgtggatggcctgctggtgtacttcccctatgactacatctacccagagcagttctcctacatgagggagctgaagaggaccctggatgccaagggccatggagtgctggagatgcccagcggcaccgggaagacagtgtccctgctggccctgatcatggcctaccagagggcctaccccctggaggtgaccaagctgatctactgcagcaggacagtgcctgagattgagaaggtgattgaggagctgaggaagctgctgaacttctatgagaagcaggagggggagaagctgcccttcctgggcctggccctgagcagcaggaagaacctgtgcatccaccctgaggtgacccccctgcgctttgggaaggatgtggatggcaagtgccacagcctgacagccagctatgtgcgggcccagtaccagcacgacaccagcctgccccactgccgcttctatgaggagtttgatgcccacggccgggaggtgcccctgcctgctggcatctacaacctggatgacctgaaggccctgggccggcggcagggctggtgcccctacttcctggcccgctacagcatcctgcacgccaacgtggtggtgtacagctaccactacctgctggaccccaagattgctgacctggtgtccaaggagctggccaggaaggctgtggtggtgtttgatgaggcccacaacatcgacaacgtgtgcatcgacagcatgtctgtgaacctgaccaggaggaccctggaccgctgccagggcaacctggagaccctgcagaagacagtgctgcgcatcaaggagacagatgagcagaggctgagagatgagtaccgccgcctggtggagggcctgcgggaggccagcgctgcccgggagacagatgcccacctggccaaccctgtgctgcctgatgaggtgctgcaggaggccgtgcccggcagcatcagaacagctgagcacttcctgggcttcctgcggcggctgctggagtatgtgaagtggaggctgcgggtgcagcacgtggtgcaggagagccccccagccttcctgagcggcctggcccagagggtgtgcatccagaggaagcccctgcgcttctgtgccgagcggctgcggagcctgctgcacaccctggagatcacagacctggccgacttcagccccctgaccctgctggccaactttgccaccctggtgtccacctacgccaagggcttcaccatcatcatcgagccctttgatgacaggacccccaccatcgccaaccccatcctgcacttcagctgcatggatgccagcctggccatcaagcctgtgtttgagcgcttccagagcgtcatcatcaccagcggcaccctgagccccctggacatctaccccaagatcctggacttccaccctgtgaccatggccaccttcaccatgaccctggcccgggtgtgcctgtgccccatgatcatcggcagaggaaatgaccaggtggccatcagcagcaagtttgagacccgggaggacattgctgtgatccggaactacggcaacctgctgctggagatgtctgctgtggtgcctgatggcatcgtggccttcttcaccagctaccagtacatggagagcacagtggcctcctggtatgagcagggcatcctggagaacatccagaggaacaagctgctcttcatcgagacccaggatggagctgagacctctgtggccctggagaagtaccaggaggcctgtgaaaatggccgcggggccatcctgctgtctgtggcccggggcaaggtgtctgagggcatcgactttgtgcaccactacggccgggctgtgatcatgtttggagtgccctacgtgtacacccagagccgcatcctgaaggcccggctggagtacctgcgggaccagttccagatccgggagaatgacttcctgacctttgatgccatgagacatgctgcccagtgtgtgggccgggccatccggggcaagacagattatggcctgatggtgtttgctgacaagagatttgcccggggggacaagaggggcaagctgccccgctggatccaggagcacctgacagatgccaacctgaacctgactgtggatgaaggagtgcaggtggccaagtacttcctgcggcagatggcccagcccttccaccgggaggaccagctgggcctgagcctgctgagcctggagcagctggagagcgaggagaccctgaagagaattgagcagatcgcccagcagctgtag

SEQ ID NO: 19599 - DNA, 2751 bp, Artificial Sequence
  Description of Artificial Sequence: Synthetic coding sequence
atggagagcggccagcctgcccggcgcatcgccatggcccccctgctggagtatgaaaggcagctggtgctggagctgctggacacagatggcctggtggtgtgtgcccggggcctgggcgctgaccggctgctgtaccacttcctgcagctgcactgccacccagcctgcctggtgctggtgctgaacacccagcctgctgaggaggagtacttcatcaaccagctgaagattgagggcgtggagcacctgccccggcgggtgaccaatgagatcaccagcaacagccgctatgaggtgtacacccagggcggcgtcatctttgccaccagccgcatcctggtggtggacttcctgacagaccgcatccccagcgacctgatcaccggcatcctggtgtaccgggcccaccgcatcatcgagagctgccaggaggccttcatcctgcggctcttccggcagaagaacaagaggggcttcatcaaggccttcacagacaatgctgtggcctttgacaccggcttctgccacgtggagcgggtgatgaggaacctgtttgtgaggaagctgtacctgtggccccgcttccacgtggccgtgaacagcttcctggagcagcacaagccagaggtggtggagatccacgtgtccatgacccccaccatgctggccatccagacagccatcctggacatcctgaatgcctgcctgaaggagctgaagtgccacaaccccagcctggaggtggaggacctgagcctggagaatgccatcggcaagccctttgacaagaccatccgccactacctggaccccctgtggcaccagctgggcgccaagaccaagagcctggtgcaggacctgaagatcctgcggaccctgctgcagtacctgagccagtatgactgtgtgaccttcctgaacctgctggagagcctgcgggccacagagaaggccttcggccagaacagcggctggctgttcctggacagcagcacctccatgttcatcaatgcccgggcccgggtgtaccacctgcctgatgccaagatgagcaagaaggagaagatcagcgagaagatggagatcaaggagggggaggagaccaagaaggagctggtgctggagagcaaccccaagtgggaggccctgacagaggtgctgaaggagattgaagctgagaacaaggagagcgaggccctgggcggccctggccaggtgctgatctgtgccagtgatgacaggacctgcagccagctgcgggactacatcaccctgggcgctgaggccttcctgctgcggctgtacaggaagacctttgagaaggacagcaaggccgaggaggtgtggatgaagttcaggaaggaggacagcagcaagaggatcaggaagagccacaagaggcccaaggacccccagaacaaggagcgggccagcaccaaggagaggaccctgaagaagaagaagaggaagctgaccctgacccagatggtgggcaagccagaggagctggaggaggagggagatgtggaggagggctacagaagagagatcagcagcagccctgagagctgcccagaggagatcaagcatgaggagtttgatgtgaacctgagcagtgatgctgccttcggcatcctgaaggagcccctgaccatcatccaccccctgctgggctgcagcgacccctatgccctgaccagggtgctgcacgaggtggagcccaggtatgtggtgctgtatgatgctgagctgacctttgtgcggcagctggagatctaccgggccagcaggcctgggaagcccctgcgggtgtacttcctgatctacggcggcagcacagaggagcagcgctacctgacagccctgaggaaggagaaggaggcctttgagaagctgatccgggagaaggcctccatggtggtgcctgaggagcgggagggcagagatgagaccaacctggacctggtgcggggcacagccagcgcagatgtgtccacagacaccaggaaggccggcggccaggagcagaatggcacccagcagagcatcgtggtggacatgagggagttccgctctgagctgcccagcctcatccacagaagaggcatcgacatcgagcctgtgaccctggaggtgggggactacatcctgaccccagagatgtgtgtggagaggaagagcatcagtgacctgattggcagcctgaacaacggccgcctgtacagccagtgcatctccatgagccgctactacaagaggcctgtgctgctgattgaatttgaccccagcaagcccttcagcctgaccagcagaggagccctcttccaggagatcagcagcaatgacatcagcagcaagctgaccctgctgaccctgcacttcccccggctgcgcatcctgtggtgccccagcccccacgccacagctgagctgtttgaggagctgaagcagagcaagccccagccagatgctgccacagccctggccatcacagctgacagcgagaccctgcctgagagcgagaagtacaaccctggcccccaggacttcctgctgaagatgcctggggtgaatgccaagaactgccgcagcctgatgcaccacgtgaagaacattgctgagctggccgccctgagccaggatgagctgaccagcatcctgggcaatgctgccaatgccaagcagctgtatgacttcatccacaccagctttgctgaggtggtgtccaagggcaagggcaagaagtag

SEQ ID NO: 19600 - DNA, 2715 bp, Artificial Sequence
  Description of Artificial Sequence: Synthetic coding sequence
atggcccccctgctggagtatgagcggcagctggtgctggagctgctggacacagatggcctggtggtgtgtgcccggggcctgggcgctgaccggctgctgtaccacttcctgcagctgcactgccacccagcctgcctggtgctggtgctgaacacccagcctgctgaggaggagtacttcatcaaccagctgaagattgaaggagtggagcacctgcccaggagagtgaccaatgagatcaccagcaacagccgctatgaggtgtacacccagggcggcgtcatctttgccaccagccgcatcctggtggtggacttcctgacagaccgcatccccagcgacctgatcaccggcatcctggtgtaccgggcccaccgcatcatcgagagctgccaggaggccttcatcctgcggctcttccggcagaagaacaagaggggcttcatcaaggccttcacagacaatgctgtggcctttgacaccggcttctgccacgtggagcgggtgatgaggaacctgtttgtgaggaagctgtacctgtggccccgcttccacgtggccgtgaacagcttcctggagcagcacaagccagaggtggtggagatccacgtgtccatgacccccaccatgctggccatccagacagccatcctggacatcctgaatgcctgcctgaaggagctgaagtgccacaaccccagcctggaggtggaggacctgagcctggagaatgccatcggcaagccctttgacaagaccatccgccactacctggaccccctgtggcaccagctgggcgccaagaccaagagcctggtgcaggacctgaagatcctgcggaccctgctgcagtacctgagccagtatgactgtgtgaccttcctgaacctgctggagagcctgcgggccacagagaaggccttcggccagaacagcggctggctgttcctggacagcagcacctccatgttcatcaatgcccgggcccgggtgtaccacctgcctgatgccaagatgagcaagaaggagaagatcagcgagaagatggagatcaaggagggggaggagaccaagaaggagctggtgctggagagcaaccccaagtgggaggccctgacagaggtgctgaaggagattgaagctgagaacaaggagagcgaggccctgggcggccctggccaggtgctgatctgtgccagtgatgacaggacctgcagccagctgcgggactacatcaccctgggcgctgaggccttcctgctgcggctgtacaggaagacctttgagaaggacagcaaggccgaggaggtgtggatgaagttcagaaaagaagacagcagcaagaggatcaggaagagccacaagaggcccaaggacccccagaacaaggagcgggccagcaccaaggagaggaccctgaagaagaagaagaggaagctgaccctgacccagatggtgggcaagccagaggagctggaggaggagggagatgtggaggagggctaccgccgggagatcagcagcagccctgagagctgcccagaggagatcaagcatgaggagtttgatgtgaacctgagcagtgatgctgccttcggcatcctgaaggagcccctgaccatcatccaccccctgctgggctgcagcgacccctatgccctgaccagggtgctgcacgaggtggagccccgctacgtggtgctgtatgatgctgagctgacctttgtgcggcagctggagatctaccgggccagcaggcctgggaagcccctgcgctacttcctgatctacggcggcagcacagaggagcagcgctacctgacagccctgaggaaggagaaggaggcctttgagaagctgatccgggagaaggcctccatggtggtgcctgaggagcgggagggcagagatgagaccaacctggacctggtgcggggcacagccagcgcagatgtgtccacagacaccaggaaggccggcggccaggagcagaatggcacccagcagagcatcgtggtggacatgagggagttccgctctgagctgcccagcctcatccacagaagaggcatcgacatcgagcctgtgaccctggaggtgggggactacatcctgaccccagagatgtgtgtggagaggaagagcatcagtgacctgattggcagcctgaacaacggccgcctgtacagccagtgcatctccatgagccgctactacaagaggcctgtgctgctgattgaatttgaccccagcaagcccttcagcctgaccagcagaggagccctcttccaggagatcagcagcaatgacatcagcagcaagctgaccctgctgaccctgcacttcccccggctgcgcatcctgtggtgccccagcccccacgccacagctgagctgtttgaggagctgaagcagagcaagccccagccagatgctgccacagccctggccatcacagctgacagcgagaccctgcctgagagcgagaagtacaaccctggcccccaggacttcctgctgaagatgcctggggtgaatgccaagaactgccgcagcctgatgcaccacgtgaagaacattgctgagctggccgccctgagccaggatgagctgaccagcatcctgggcaatgctgccaatgccaagcagctgtatgacttcatccacaccagctttgctgaggtggtgtccaagggcaagggcaagaagtag

SEQ ID NO: 19601 - DNA, 1071 bp, Artificial Sequence
  Description of Artificial Sequence: Synthetic coding sequence
atggcccccctgctggagtatgagcggcagctggtgctggagctgctggacacagatggcctggtggtgtgtgcccggggcctgggcgctgaccggctgctgtaccacttcctgcagctgcactgccacccagcctgcctggtgctggtgctgaacacccagcctgctgaggaggagtacttcatcaaccagctgaagattgaaggagtggagcacctgcccaggagagtgaccaatgagatcaccagcaacagccgctatgaggtgtacacccagggcggcgtcatctttgccaccagccgcatcctggtggtggacttcctgacagaccgcatccccagcgacctgatcaccggcatcctggtgtaccgggcccaccgcatcatcgagagctgccaggaggccttcatcctgcggctcttccggcagaagaacaagaggggcttcatcaaggccttcacagacaatgctgtggcctttgacaccggcttctgccacgtggagcgggtgatgaggaacctgtttgtgaggaagctgtacctgtggccccgcttccacgtggccgtgaacagcttcctggagcagcacaagccagaggtggtggagatccacgtgtccatgacccccaccatgctggccatccagacagccatcctggacatcctgaatgcctgcctgaaggagctgaagtgccacaaccccagcctggaggtggaggacctgagcctggagaatgccatcggcaagccctttgacaagaccatccgccactacctggaccccctgtggcaccagctgggcgccaagaccaagagcctggtgcaggacctgaagatcctgcggaccctgctgcagtacctgagccagtatgactgtgtgaccttcctgaacctgctggagagcctgcgggccacagagaaggccttcggccagaacagcggctggctgttcctggacagcagcacctccatgttcatcaatgcccgggcccgggtgtaccacctgcctgatgccaagatgagcaagaaggagaagatcagcgagaagatcaagaagaagaagaagaagtag

SEQ ID NO: 19602 - DNA, 3561 bp, Artificial Sequence
  Description of Artificial Sequence: Synthetic coding sequence
atgggcgtgcagggcctgtggaagctgctggagtgcagcggccggcaggtgtccccagaggccctggagggcaagatcctggccgtggacatcagcatctggctgaaccaggccctgaagggcgtgcgggacagacatggcaacagcattgagaacccccacctgctgaccctcttccaccggctgtgcaagctgctcttcttccgcatccggcccatctttgtgtttgatggagatgcccccctgctgaagaagcagaccctggtgaagaggcggcagaggaaggacctggccagcagtgacagcaggaagaccacagagaagctgctgaagaccttcctgaagaggcaggccatcaagacagccttccgcagcaagagagatgaggccctgcccagcctgacccaggtgcggcgggagaatgacctgtatgtgctgccccccctgcaggaggaggagaagcacagcagcgaggaggaggatgagaaggagtggcaggagaggatgaaccagaagcaggccctgcaggaggagttcttccacaacccccaggccatcgacatcgagagcgaggacttcagcagcctgcccccagaggtgaagcatgagatcctgacagacatgaaggagttcaccaagagaagaaggaccctgtttgaggccatgcctgaggagagtgatgacttcagccagtaccagctgaagggcctgctgaagaagaactacctgaaccagcacattgaacatgtgcagaaggagatgaaccagcagcacagcggccacatccggcggcagtatgaagatgagggcggcttcctgaaggaggtggagagcagaagagtggtgtctgaggacaccagccactacatcctgatcaagggcatccaggccaagacagtggccgaggtggacagcgagagcctgcccagcagcagcaagatgcacggcatgagctttgatgtgaagagcagcccctgtgagaagctgaagacagagaaggagccagatgccaccccacccagccccaggaccctgctggccatgcaggccgccctgctgggcagcagcagcgaggaggagctggagagcgagaacagacggcaggcccggggcagaaatgccccagctgctgtggatgagggcagcatcagccccaggaccctgagcgccatcaagagggccctggatgatgatgaagatgtgaaggtgtgtgctggagatgatgtgcagacaggaggccctggagctgaggagatgaggatcaacagcagcacagagaacagtgatgagggcctgaaggtgagagatggcaagggcatccccttcaccgccaccctggccagcagctctgtgaacagcgctgaggagcacgtggccagcaccaatgaaggccgggagcccacagacagcgtgcccaaggagcagatgagcctggtgcacgtgggcacagaggccttccccatcagtgatgagagcatgatcaaggacaggaaggaccggctgcccctggagagcgctgtggtgcgccacagtgatgcccctggcctgcccaacggccgggagctgaccccagccagccccacctgcaccaacagcgtgtccaagaatgagacccacgccgaggtgctggagcagcagaatgagctgtgcccctatgagagcaagtttgacagcagcctgctgagcagtgatgatgagaccaagtgcaagcccaacagcgccagcgaggtgattggccctgtgtccctgcaggagaccagcagcatcgtgtctgtgcccagcgaggccgtggacaacgtggagaatgtggtgtccttcaatgccaaggagcacgagaacttcctggagaccatccaggagcagcagaccacagagagcgctggccaggacctgatcagcatccccaaggctgtggagcccatggagattgattctgaggagagcgagagtgatggcagcttcatcgaggtgcagagcgtcatcagtgatgaggagctgcaggccgagttccctgagaccagcaagccacccagcgagcagggcgaggaggagctggtgggcacccgggagggggaggccccagctgagagcgagagcctgctgcgggacaacagcgagagagatgatgtggatggagagccccaggaggccgagaaggatgctgaggacagcctgcacgagtggcaggacatcaacctggaggagctggagaccctggagagcaacctgctggcccagcagaacagcctgaaggcccagaagcagcagcaggagagaattgctgccaccgtgacaggccagatgttcctggagagccaggagctgctgcggctgtttggcatcccctacatccaggcccccatggaggccgaggcccagtgtgccatcctggacctgacagaccagaccagcggcaccatcacagatgacagcgacatctggctgtttggagcccggcacgtgtacagaaacttcttcaacaagaacaagtttgtggagtactaccagtatgtggacttccacaaccagctgggcctggacaggaacaagctgatcaacctggcctacctgctgggcagtgactacacagagggcatccccaccgtgggctgtgtgacagccatggagatcctgaatgagttccctggccacggcctggagcccctgctgaagttcagcgagtggtggcatgaggcccagaagaaccccaagatccggcccaacccccatgacaccaaggtgaagaagaagctgcggaccctgcagctgaccccaggcttccccaacccagctgtggccgaggcctacctgaagcctgtggtggatgacagcaagggcagcttcctgtggggcaagccagacctggacaagatccgggagttctgccagcgctacttcggctggaacagaaccaagacagatgagagcctcttccctgtgctgaagcagctggatgcccagcagacccagctgagaattgacagcttcttccggctggcccagcaggagaaggaggatgccaagaggatcaagagccagaggctgaacagagctgtgacctgcatgctgaggaaggagaaggaggccgccgccagcgagattgaggccgtgtctgtggccatggagaaggagtttgagctgctggacaaggccaagggcaagacccagaagaggggcatcaccaacaccctggaggagagcagcagcctgaagaggaagaggctgagtgacagcaagggcaagaacacctgtggcggcttcctgggggagacctgcctgtctgagagcagtgatggcagcagcagtgaagatgctgagagcagcagcctgatgaatgtgcagaggagaacagctgccaaggagcccaagaccagcgccagtgacagccagaacagcgtgaaggaggcccctgtgaagaatggaggagccaccaccagcagcagcagtgacagtgatgatgatggcggcaaggagaagatggtgctggtgacagcccggtctgtgtttgggaagaagaggaggaagctgcggcgggcccggggcaggaagaggaagacctag

SEQ ID NO: 19603 - DNA, 1260 bp, Artificial Sequence
  Description of Artificial Sequence: Synthetic coding sequence
atgttcctggagagccaggagctgctgcggctgtttggcatcccctacatccaggcccccatggaggccgaggcccagtgtgccatcctggacctgacagaccagaccagcggcaccatcacagatgacagcgacatctggctgtttggagcccggcacgtgtacagaaacttcttcaacaagaacaagtttgtggagtactaccagtatgtggacttccacaaccagctgggcctggacaggaacaagctgatcaacctggcctacctgctgggcagtgactacacagagggcatccccaccgtgggctgtgtgacagccatggagatcctgaatgagttccctggccacggcctggagcccctgctgaagttcagcgagtggtggcatgaggcccagaagaaccccaagatccggcccaacccccatgacaccaaggtgaagaagaagctgcggaccctgcagctgaccccaggcttccccaacccagctgtggccgaggcctacctgaagcctgtggtggatgacagcaagggcagcttcctgtggggcaagccagacctggacaagatccgggagttctgccagcgctacttcggctggaacagaaccaagacagatgagagcctcttccctgtgctgaagcagctggatgcccagcagacccagctgagaattgacagcttcttccggctggcccagcaggagaaggaggatgccaagaggatcaagagccagaggctgaacagagctgtgacctgcatgctgaggaaggagaaggaggccgccgccagcgagattgaagctgtgtctgtggccatggagaaggagtttgagctgctggacaaggccaagggcaagacccagaagaggggcatcaccaacaccctggaggagagcagcagcctgaagaggaagaggctgagtgacagcaagggcaagaacacctgtggcggcttcctgggggagacctgcctgtctgagagcagtgatggcagcagcagtgaagatgctgagagcagcagcctgatgaatgtgcagaggagaacagctgccaaggagcccaagaccagcgccagtgacagccagaacagcgtgaaggaggcccctgtgaagaatggaggagccaccaccagcagcagcagtgacagtgatgatgatggcggcaaggagaagatggtgctggtgacagcccggtctgtgtttgggaagaagaggaggaagctgcggcgggcccggggcaggaagaggaagacctag

SEQ ID NO: 19604 - DNA, 3057 bp, Artificial Sequence
  Description of Artificial Sequence: Synthetic coding sequence
atgaaccagaagcaggccctgcaggaggagttcttccacaacccccaggccatcgacatcgagagcgaggacttcagcagcctgcccccagaggtgaagcatgagatcctgacagacatgaaggagttcaccaagagaagaaggaccctgtttgaggccatgcctgaggagagtgatgacttcagccagtaccagctgaagggcctgctgaagaagaactacctgaaccagcacattgaacatgtgcagaaggagatgaaccagcagcacagcggccacatccggcggcagtatgaagatgagggcggcttcctgaaggaggtggagagcagaagagtggtgtctgaggacaccagccactacatcctgatcaagggcatccaggccaagacagtggccgaggtggacagcgagagcctgcccagcagcagcaagatgcacggcatgagctttgatgtgaagagcagcccctgtgagaagctgaagacagagaaggagccagatgccaccccacccagccccaggaccctgctggccatgcaggccgccctgctgggcagcagcagcgaggaggagctggagagcgagaacagacggcaggcccggggcagaaatgccccagctgctgtggatgagggcagcatcagccccaggaccctgagcgccatcaagagggccctggatgatgatgaagatgtgaaggtgtgtgctggagatgatgtgcagacaggaggccctggagctgaggagatgaggatcaacagcagcacagagaacagtgatgagggcctgaaggtgagagatggcaagggcatccccttcaccgccaccctggccagcagctctgtgaacagcgctgaggagcacgtggccagcaccaatgaaggccgggagcccacagacagcgtgcccaaggagcagatgagcctggtgcacgtgggcacagaggccttccccatcagtgatgagagcatgatcaaggacaggaaggaccggctgcccctggagagcgctgtggtgcgccacagtgatgcccctggcctgcccaacggccgggagctgaccccagccagccccacctgcaccaacagcgtgtccaagaatgagacccacgccgaggtgctggagcagcagaatgagctgtgcccctatgagagcaagtttgacagcagcctgctgagcagtgatgatgagaccaagtgcaagcccaacagcgccagcgaggtgattggccctgtgtccctgcaggagaccagcagcatcgtgtctgtgcccagcgaggccgtggacaacgtggagaatgtggtgtccttcaatgccaaggagcacgagaacttcctggagaccatccaggagcagcagaccacagagagcgctggccaggacctgatcagcatccccaaggctgtggagcccatggagattgattctgaggagagcgagagtgatggcagcttcatcgaggtgcagagcgtcatcagtgatgaggagctgcaggccgagttccctgagaccagcaagccacccagcgagcagggcgaggaggagctggtgggcacccgggagggggaggccccagctgagagcgagagcctgctgcgggacaacagcgagagagatgatgtggatggagagccccaggaggccgagaaggatgctgaggacagcctgcacgagtggcaggacatcaacctggaggagctggagaccctggagagcaacctgctggcccagcagaacagcctgaaggcccagaagcagcagcaggagagaattgctgccaccgtgacaggccagatgttcctggagagccaggagctgctgcggctgtttggcatcccctacatccaggcccccatggaggccgaggcccagtgtgccatcctggacctgacagaccagaccagcggcaccatcacagatgacagcgacatctggctgtttggagcccggcacgtgtacagaaacttcttcaacaagaacaagtttgtggagtactaccagtatgtggacttccacaaccagctgggcctggacaggaacaagctgatcaacctggcctacctgctgggcagtgactacacagagggcatccccaccgtgggctgtgtgacagccatggagatcctgaatgagttccctggccacggcctggagcccctgctgaagttcagcgagtggtggcatgaggcccagaagaaccccaagatccggcccaacccccatgacaccaaggtgaagaagaagctgcggaccctgcagctgaccccaggcttccccaacccagctgtggccgaggcctacctgaagcctgtggtggatgacagcaagggcagcttcctgtggggcaagccagacctggacaagatccgggagttctgccagcgctacttcggctggaacagaaccaagacagatgagagcctcttccctgtgctgaagcagctggatgcccagcagacccagctgagaattgacagcttcttccggctggcccagcaggagaaggaggatgccaagaggatcaagagccagaggctgaacagagctgtgacctgcatgctgaggaaggagaaggaggccgccgccagcgagattgaggccgtgtctgtggccatggagaaggagtttgagctgctggacaaggccaagggcaagacccagaagaggggcatcaccaacaccctggaggagagcagcagcctgaagaggaagaggctgagtgacagcaagggcaagaacacctgtggcggcttcctgggggagacctgcctgtctgagagcagtgatggcagcagcagtgaagatgctgagagcagcagcctgatgaatgtgcagaggagaacagctgccaaggagcccaagaccagcgccagtgacagccagaacagcgtgaaggaggcccctgtgaagaatggaggagccaccaccagcagcagcagtgacagtgatgatgatggcggcaaggagaagatggtgctggtgacagcccggtctgtgtttgggaagaagaggaggaagctgcggcgggcccggggcaggaagaggaagacctag

SEQ ID NO: 19605 - DNA, 4836 bp, Artificial Sequence
  Description of Artificial Sequence: Synthetic coding sequence
cagggcgctgtgaagagcttctgcaccagcgccagcggggcccccctgggccccaagggagatggccactacccctggagctgccctgtgacccacacccgggagaagatctatgccatctgcagcgactatgccttcctgaaccaggccaccagcatctacaagacccccaaccccagccgcagcccctgcctgcctgacagcaccagcctgtctgctggcaacaacagcagccgctacatcggcatccccaccagcaccagcgagatcatctacaatgaggagaacagcctggagaacctgagcaacagcctgggcaagctgcccctggcctgggagattgacaagtcagaatttgatggagtgaccaccaacagcaagcacaagtctggaaatgccaagaagcaggtgtccaagaggaagaccagtgacaagaagggccgctaccagaaggagtgcccccagcacagccccctggaggacatcaagcagaggaaggtgctggacctgcggcgctggtactgcatcagccggccccagtacaagaccagctgtggcatcagcagcctcatcagctgctggaacttcctgtacagcaccatgggcgccggcaacctgccccccatcacccaggaggaggccctgcacatcctgggcttccagcccccatttgaggacatccgcttcggccccttcaccggcaacaccaccctgatgcgctggttccggcagatcaatgaccacttccacgtgaagggctgcagctatgtgctgtacaagccccacggcaagaacaagacagctggggagacagccagcggggccctgagcaagctgacccggggcctgaaggatgagagcctggcctacatctaccactgccagaaccactacttctgccccatcggctttgaggccacccctgtgaaggccaacaaggccttcagccggggccccctgagcccccaggaggtggagtactggatcctgattggagagagcagcaggaagcacccagccatccactgcaagaagtgggccgacatcgtgacagacctgaacacccagaaccctgagtacctggacatccgccacctggagcggggcctgcagtacaggaagaccaagaaggtgggcggcaacctgcactgcatcatcgccttccagaggctgaactggcagcgcttcggcctgtggaacttccccttcggcaccatccggcaggagagccagccccccacccacgcccagggcatcgccaagtctgagagcgaggacaacatcagcaagaagcagcacggccgcctgggccgctccttcagcgccagcttccaccaggacagcgcctggaagaagatgagcaacatcagcatctggctgaaccaggccctgaagggcgtgcgggacagacatggcaacagcattgagaacccccacctgctgaccctcttccaccggctgtgcaagctgctcttcttccgcatccggcccatctttgtgtttgatggagatgcccccctgctgaagaagcagaccctggtgaagaggcggcagaggaaggacctggccagcagtgacagcaggaagaccacagagaagctgctgaagaccttcctgaagaggcaggccatcaagacagccttccgcagcaagagagatgaggccctgcccagcctgacccaggtgagaagagaaaatgacctgtatgtgctgccccccctgcaggaggaggagaagcacagcagcgaggaggaggatgagaaggagtggcaggagaggatgaaccagaagcaggccctgcaggaggagttcttccacaacccccaggccattgatattgaaagtgaggacttcagcagcctgcccccagaggtgaagcatgagatcctgacagacatgaaggagttcaccaagagaagaaggaccctgtttgaggccatgcctgaggagagtgatgacttcagccagtaccagctgaagggcctgctgaagaagaactacctgaaccagcacatcgagcacgtgcagaaggagatgaaccagcagcacagcggccacatccggcggcagtatgaagatgaaggaggcttcctgaaggaggtggagagccggcgggtggtgtctgaggacaccagccactacatcctgatcaagggcatccaggccaagacagtggccgaggtggacagcgagagcctgcccagcagcagcaagatgcacggcatgagctttgatgtgaagagcagcccctgtgagaagctgaagacagagaaggagccagatgccaccccacccagccccaggaccctgctggccatgcaggccgccctgctgggcagcagcagcgaggaggagctggagagtgaaaatcggcggcaggcccggggcagaaatgccccagctgctgtggatgagggcagcatcagccccaggaccctgagcgccatcaagagggccctggatgatgatgaagatgtgaaggtgtgtgctggagatgatgtgcagacaggaggccctggagctgaggagatgaggatcaacagcagcacagaaaattctgatgagggcctgaaggtgagagatggcaagggcatccccttcaccgccaccctggccagcagctctgtgaacagcgctgaggagcacgtggccagcaccaatgaaggccgggagcccacagattctgtgcccaaggagcagatgagcctggtgcacgtgggcacagaggccttccccatcagtgatgagagcatgatcaaggacaggaaggaccggctgcccctggagagcgctgtggtgcgccacagtgatgcccctggcctgcccaacggccgggagctgaccccagccagccccacctgcaccaacagcgtgtccaagaatgagacccatgctgaggtgctggagcagcagaatgagctgtgcccctatgagagcaagtttgacagcagcctgctgagcagtgatgatgagaccaagtgcaagcccaacagcgccagcgaggtgattggccctgtgtccctgcaggagaccagcagcatcgtgtctgtgcccagcgaggccgtggacaacgtggagaatgtggtgtccttcaatgccaaggagcacgagaacttcctggagaccatccaggagcagcagaccacagaatctgctggccaggacctgatcagcatccccaaggctgtggagcccatggagattgacagcgaggagagcgagagtgatggcagcttcatcgaggtgcagagcgtcatcagtgatgaggagctgcaggccgagttccctgagaccagcaagcccccatctgagcagggcgaggaggagctggtgggcacccgggagggggaggccccagctgagagcgagagcctgctgcgggacaacagcgagagagatgatgtggatggagagccccaggaggccgagaaggatgctgaggacagcctgcacgagtggcaggacatcaacctggaggagctggagaccctggagagcaacctgctggcccagcagaacagcctgaaggcccagaagcagcagcaggagagaattgctgccaccgtgacaggccagatgttcctggagagccaggagctgctgcggctgtttggcatcccctacatccaggcccccatggaggccgaggcccagtgtgccatcctggacctgacagaccagaccagcggcaccatcacagatgacagcgacatctggctgtttggagcccggcacgtgtacagaaacttcttcaacaagaacaagtttgtggagtactaccagtatgtggacttccacaaccagctgggcctggacaggaacaagctgatcaacctggcctacctgctgggcagtgactacacagagggcatccccaccgtgggctgtgtgacagccatggagatcctgaatgagttccctggccacggcctggagcccctgctgaagttcagcgagtggtggcatgaggcccagaagaaccccaagatccggcccaacccccatgacaccaaggtgaagaagaagctgcggaccctgcagctgaccccaggcttccccaacccagctgtggccgaggcctacctgaagcctgtggtggatgacagcaagggcagcttcctgtggggcaagccagacctggacaagatccgggagttctgccagcgctacttcggctggaacagaaccaagacagatgagagcctcttccctgtgctgaagcagctggatgcccagcagacccagctgagaattgacagcttcttccggctggcccagcaggagaaggaggatgccaagaggatcaagagccagaggctgaacagagctgtgacctgcatgctgaggaaggagaaggaggccgccgccagcgagattgaagctgtgtctgtggccatggagaaggagtttgagctgctggacaaggccaagggcaagacccagaagaggggcatcaccaacaccctggaggagagcagcagcctgaagaggaagaggctgagtgacagcaagggcaagaacacctgtggcggcttcctgggggagacctgcctgtctgagagcagtgatggcagcagcagtgaagatgctgagagcagcagcctgatgaatgtgcagaggagaacagctgccaaggagcccaagaccagcgccagtgacagccagaacagcgtgaaggaggcccctgtgaagaatggaggagccaccaccagcagcagcagtgacagtgatgatgatggcggcaaggagaagatggtgctggtgacagcccggtctgtgtttgggaagaagaggaggaagctgcggcgggcccggggcaggaagaggaagacctag

SEQ ID NO: 19606 - DNA, 699 bp, Artificial Sequence
  Description of Artificial Sequence: Synthetic coding sequence
atgggcgtgcagggcctgtggaagctgctggagtgcagcggccggcaggtgtccccagaggccctggagggcaagatcctggccgtggacatcagcatctggctgaaccaggccctgaagggcgtgcgggacagacatggcaacagcattgagaacccccacctgctgaccctcttccaccggctgtgcaagctgctcttcttccgcatccggcccatctttgtgtttgatggagatgcccccctgctgaagaagcagaccctggtgaagaggcggcagaggaaggacctggccagcagtgacagcaggaagaccacagagaagctgctgaagaccttcctgaagaggcaggccatcaagacagccttccgcagcaagagagatgaggccctgcccagcctgacccaggtgcggcgggagaatgacctgtatgtgctgccccccctgcaggaggaggagaagcacagcagcgaggaggaggatgagaaggagtggcaggagaggatgaaccagaagcaggccctgcaggaggagttcttccacaacccccaggccatcgacatcgagagcgaggacttcagcagcctgcccccagaggtgaagcatgagatcctgacagacatgaaggagttcaccaagagaagaaggaccctgtttgaggccatgcctgaggtgtacctgcccctgctgcagccctag

SEQ ID NO: 19607 - DNA, 4482 bp, Artificial Sequence
  Description of Artificial Sequence: Synthetic coding sequence
atgcccaatgaaggcatcccccacagcagccagacccaggagcaggactgcctgcagagccagcctgtgagcaacaatgaggagatggccatcaagcaggagagcggaggagatggagaggtggaggagtacctgtccttccgctctgtgggagatggcctgagcaccagcgctgtgggctgtgccagcgctgccccccggcggggccctgccctgctgcacatcgacagacaccagatccaggccgtggagcccagcgcccaggccctggagctgcagggcctgggcgtggatgtgtatgaccaggatgtgctggagcagggcgtgctgcagcaggtggacaatgccatccacgaggccagccgggccagccagctggtggatgtggagaaggagtacagatctgtgctggatgacctgaccagctgcaccaccagcctgcggcagatcaacaagatcatcgagcagctgagcccccaggccgccaccagccgggacatcaacaggaagctggacagcgtgaagaggcagaagtacaacaaggagcagcagctgaagaagatcacagccaagcagaagcacctgcaggccatcctgggcggcgctgaggtgaagattgagctggaccacgccagcctggaggaggatgctgagcccggccccagcagcctgggctccatgctgatgcctgtgcaggagacagcctgggaggagctgatcagaacaggccagatgacccccttcggcacccagatcccccagaagcaggagaagaagcccaggaagatcatgctgaatgaggccagcggctttgagaagtacctggccgaccaggccaagctgagctttgagaggaagaagcagggctgcaacaagagagctgccaggaaggccccagcccctgtgaccccaccagcccctgtgcagaacaagaacaagcccaacaagaaggcccgggtgctgagcaagaaggaggagcggctgaagaagcacatcaagaagctgcagaagagggccctgcagttccagggcaaggtgggcctgcccaaggcccggcggccctgggagagtgacatgaggcctgaggccgagggggacagcgagggggaggagagcgagtacttccccacagaggaggaggaggaggaggaggatgatgaggtggagggcgctgaggccgacctgtctggagatggaacagattatgagctgaagcccctgcccaagggcggcaagaggcagaagaaggtgcctgtgcaggagattgatgatgacttcttccccagcagcggggaggaggccgaggccgcctctgtgggggagggcggcggcggcggcaggaaggtgggccgctacagagatgatggagatgaggactactacaagcagaggctgcggcgctggaacaagctgcggctgcaggacaaggagaagaggctgaagctggaggatgacagcgaggagagtgatgctgagtttgatgagggcttcaaggtgcccggcttcctgttcaagaagctgttcaagtaccagcagacaggagtgcgctggctgtgggagctgcactgccagcaggccggcggcatcctgggagatgagatgggcctgggcaagaccatccagatcatcgccttcctggccggcctgagctacagcaagatccgcacccggggcagcaactacagatttgagggcctgggccccaccgtgattgtgtgccccaccaccgtgatgcaccagtgggtgaaggagttccacacctggtggccacccttccgggtggccatcctgcacgagaccggcagctacacccacaagaaggagaagctgatcagagatgtggcccactgccacggcatcctgatcaccagctacagctacatccggctgatgcaggatgacatcagccgctatgactggcactacgtgatcctggatgagggccacaagatccggaaccccaatgctgctgtgaccctggcctgcaagcagttccgcaccccccaccgcatcatcctgagcggcagccccatgcagaacaacctgcgggagctgtggagcctgtttgacttcatcttccctgggaagctgggcaccctgcctgtgttcatggagcagttctctgtgcccatcaccatgggcggctacagcaatgccagccctgtgcaggtgaagacagcctacaagtgtgcctgtgtgctgcgggacaccatcaacccctacctgctgcggaggatgaagagtgatgtgaagatgagcctgagcctgcctgacaagaatgagcaggtgctcttctgccgcctgacagatgagcagcacaaggtgtaccagaactttgtggacagcaaggaggtgtaccgcatcctgaatggagagatgcagatcttcagcggcctcatcgccctgaggaagatctgcaaccacccagacctcttcagcggcggccccaagaacctgaagggcctgcctgatgatgagctggaggaggaccagtttggctactggaagaggtctgggaagatgattgtggtggagagcctgctgaagatctggcacaagcagggccagagggtgctgctcttcagccagagccggcagatgctggacatcctggaggtgttcctgcgggcccagaagtacacctacctgaagatggatggcaccaccaccatcgccagccggcagcccctcatcacccgctacaatgaagacaccagcatctttgtgttcctgctgaccaccagggtgggcggcctgggcgtgaacctgaccggggccaacagagtggtgatctatgaccctgactggaaccccagcacagacacccaggcccgggagcgggcctggagaattggccagaagaagcaggtgacagtgtaccgcctgctgacagctggcaccatcgaggagaagatctaccaccggcagatcttcaagcagttcctgaccaacagagtgctgaaggaccccaagcagaggcgcttcttcaagagcaatgacctgtatgagctgttcaccctgaccagcccagatgccagccagagcacagagaccagcgccatctttgctggcactggaagtgatgtgcagacccccaagtgccacctgaagaggcgcatccagcctgccttcggggctgaccatgatgtgcccaagaggaagaagtttcctgccagcaacatctctgtgaatgatgccaccagcagcgaggagaagtctgaggccaagggagctgaggtgaatgctgtgaccagcaacagaagtgaccccctgaaggatgacccccacatgagcagcaatgtgaccagcaatgaccggctgggggaggagaccaatgctgtgtctggccctgaggagctgagcgtcatctctggaaatggagagtgcagcaacagcagcggcaccgggaagacctccatgcccagcggagatgagagcattgatgagaagctgggcctgagctacaagcgggagcggcccagccaggcccagacagaggccttctgggagaacaagcagatggagaacaacttctacaagcacaagagcaagaccaagcaccacagcgtggccgaggaggagaccctggagaagcacctgcggcccaagcagaagcccaagaacagcaagcactgcagagatgccaagtttgagggcacccgcatcccccacctggtgaagaagaggcgctaccagaagcaggacagcgagaacaagtctgaggccaaggagcagagcaatgatgattatgtgctggagaagctgttcaagaagtctgtgggcgtgcacagcgtgatgaagcatgatgccatcatggatggagccagcccagactatgtgctggtggaggccgaggccaacagagtggcccaggatgccctgaaggccctgcggctgagccggcagcgctgcctgggcgctgtgtctggagtgcccacctggacaggccaccggggcatcagcggggccccagctgggaagaagagcagatttgggaagaagaggaacagcaacttctctgtgcagcaccccagcagcaccagccccacagagaagtgccaggacggcatcatgaagaaggagggcaaggacaacgtgcctgagcacttcagcggccgggcagaagatgctgacagcagcagcggccccctggccagcagcagcctgctggccaagatgagggccaggaaccacctgatcctgcctgagcggctggagagcgagagcggccacctgcaggaggccagcgccctgctgcccaccacagaacatgatgacctgctggtggagatgaggaacttcatcgccttccaggcccacacagatggccaggccagcacccgggagatcctgcaggagtttgagagcaagctgagcgccagccagagctgtgtgttccgggagctgctgaggaacctgtgcaccttccacaggaccagcggcggggagggcatctggaagctgaagccagagtactgctag

SEQ ID NO: 19608 - DNA, 2613 bp, Artificial Sequence
  Description of Artificial Sequence: Synthetic coding sequence
cagcagcccttccaccgccacctgctgatgaccacagccctgcacagcgagaagctgatcagagatgtggcccactgccacggcatcctgatcaccagctacagctacatccggctgatgcaggatgacatcagccgctatgactggcactacgtgatcctggatgagggccacaagatccggaaccccaatgctgctgtgaccctggcctgcaagcagttccgcaccccccaccgcatcatcctgagcggcagccccatgcagaacaacctgcgggagctgtggagcctgtttgacttcatcttccctgggaagctgggcaccctgcccgtcttcatggagcagttctctgtgcccatcaccatgggcggctacagcaatgccagccctgtgcaggtgaagacagcctacaagtgtgcctgtgtgctgcgggacaccatcaacccctacctgctgcggaggatgaagagtgatgtgaagatgagcctgagcctgcctgacaagaatgagcagatcttcagcggcctgattgccctgaggaagatctgcaaccacccagacctcttcagcggcggccccaagaacctgaagggcctgcctgatgatgagctggaggaggaccagtttggctactggaagaggtctgggaagatgattgtggtggagagcctgctgaagatctggcacaagcagggccagagggtgctgctcttcagccagagccggcagatgctggacatcctggaggtgttcctgcgggcccagaagtacacctacctgaagatggatggcaccaccaccatcgccagccggcagcccctcatcacccgctacaatgaagacaccagcatctttgtgttcctgctgaccaccagggtgggcggcctgggcgtgaacctgactggagccaacagagtggtgatctatgaccctgactggaaccccagcacagacacccaggcccgggagcgggcctggagaattggccagaagaagcaggtgacagtgtaccgcctgctgacagctggcaccatcgaggagaagatctaccaccggcagatcttcaagcagttcctgaccaacagagtgctgaaggaccccaagcagaggcgcttcttcaagagcaatgacctgtatgagctgttcaccctgaccagcccagatgccagccagagcacagagaccagcgccatctttgctggcaccggcagtgatgtgcagacccccaagtgccacctgaagaggcgcatccagcctgcctttggagctgaccatgatgtgcccaagaggaagaagtttcctgccagcaacatctctgtgaatgatgccaccagcagcgaggagaagtctgaggccaagggagctgaggtgaatgctgtgaccagcaacagaagtgaccccctgaaggatgacccccacatgagcagcaatgtgaccagcaatgaccggctgggggaggagaccaatgctgtgtctggccctgaggagctgagcgtcatctctggaaatggagaatgtagcaacagcagcggcaccgggaagacctccatgcccagcggagatgagagcattgatgagaagctgggcctgagctacaagcgggagcggcccagccaggcccagacagaggccttctgggagaacaagcagatggagaacaacttctacaagcacaagagcaagaccaagcaccacagcgtggccgaggaggagaccctggagaagcacctgcggcccaagcagaagcccaagaacagcaagcactgcagagatgccaagtttgagggcacccgcatcccccacctggtgaagaagaggcgctaccagaagcaggacagcgagaacaagtctgaggccaaggagcagagcaatgatgattatgtgctggagaagctgttcaagaagtctgtgggcgtgcacagcgtgatgaagcatgatgccatcatggatggagccagcccagactatgtgctggtggaggccgaggccaacagagtggcccaggatgccctgaaggccctgcggctgagccggcagcgctgcctgggcgctgtgtctggagtgcccacctggacaggccaccggggcatcagcggggccccagctgggaagaagagcagatttgggaagaagaggaacagcaacttctctgtgcagcaccccagcagcaccagccccacagagaagtgccaggacggcatcatgaagaaggagggcaaggacaacgtgcctgagcacttcagcggccgggcagaagatgctgacagcagcagcggccccctggccagcagcagcctgctggccaagatgagggccaggaaccacctgatcctgcctgagcggctggagagcgagagcggccacctgcaggaggccagcgccctgctgcccaccacagaacatgatgacctgctggtggagatgaggaacttcatcgccttccaggcccacacagatggccaggccagcacccgggagatcctgcaggagtttgagagcaagctgagcgccagccagagctgtgtgttccgggagctgctgaggaacctgtgcaccttccacaggaccagcggcggggagggcatctggaagctgaagccagagtactgctag

SEQ ID NO: 19609 - DNA, 540 bp, Artificial Sequence
  Description of Artificial Sequence: Synthetic coding sequence
atgcccaatgaaggcatcccccacagcagccagacccaggagcaggactgcctgcagagccagcctgtgagcaacaatgaggagatggccatcaagcaggagagcggaggagatggagaggtggaggagtacctgtccttccgctctgtgggagatggcctgagcaccagcgctgtgggctgtgccagcgctgccccccggcggggccctgccctgctgcacatcgacagacaccagatccaggccgtggagcccagcgcccaggccctggagctgcagggcctgggcgtggatgtgtatgaccaggatgtgctggagcagggcgtgctgcagcaggtggacaatgccatccacgaggccagccgggccagccagctggtggatgtggagaaggagtacagatctgtgctggatgacctgaccagctgcaccaccagcctgcggcagatcaacaagatcatcgagcagctgagcccccaggccgccaccagccgggacatcaacaggaagctggacagcgtgaagaggcagaagtactag

SEQ ID NO: 19610 - DNA, 318 bp, Artificial Sequence
  Description of Artificial Sequence: Synthetic coding sequence
atgagcctgagcctgcctgacaagaatgagcaggtgctcttctgccgcctgacagatgagcagcacaaggtgtaccagaactttgtggacagcaaggaggtgtaccgcatcctgaatggagagatgcaggaggtgctgcagagcttcaccagcatccacctgcacgagagccccctgaacttcttccgctccttccaggtgcggggcagccgcagccactacccaggcaagggcatgcagaccaccctgggcatcgtgaacttcctggtggtgaccctgaagaggaagaagaggaaccgcttctccccagacctgtag

SEQ ID NO: 19611 - DNA, 2592 bp, Artificial Sequence
  Description of Artificial Sequence: Synthetic coding sequence
atgcaggatgacatcagccgctatgactggcactacgtgatcctggatgagggccacaagatccggaaccccaatgctgctgtgaccctggcctgcaagcagttccgcaccccccaccgcatcatcctgagcggcagccccatgcagaacaacctgcgggagctgtggagcctgtttgacttcatcttccctgggaagctgggcaccctgcctgtgttcatggagcagttctctgtgcccatcaccatgggcggctacagcaatgccagccctgtgcaggtgaagacagcctacaagtgtgcctgtgtgctgcgggacaccatcaacccctacctgctgcggaggatgaagagtgatgtgaagatgagcctgagcctgcctgacaagaatgagcaggtgctcttctgccgcctgacagatgagcagcacaaggtgtaccagaactttgtggacagcaaggaggtgtaccgcatcctgaatggagagatgcagatcttcagcggcctcatcgccctgaggaagatctgcaaccacccagacctcttcagcggcggccccaagaacctgaagggcctgcctgatgatgagctggaggaggaccagtttggctactggaagaggtctgggaagatgattgtggtggagagcctgctgaagatctggcacaagcagggccagagggtgctgctcttcagccagagccggcagatgctggacatcctggaggtgttcctgcgggcccagaagtacacctacctgaagatggatggcaccaccaccatcgccagccggcagcccctcatcacccgctacaatgaagacaccagcatctttgtgttcctgctgaccaccagggtgggcggcctgggcgtgaacctgaccggggccaacagagtggtgatctatgaccctgactggaaccccagcacagacacccaggcccgggagcgggcctggagaattggccagaagaagcaggtgacagtgtaccgcctgctgacagctggcaccatcgaggagaagatctaccaccggcagatcttcaagcagttcctgaccaacagagtgctgaaggaccccaagcagaggcgcttcttcaagagcaatgacctgtatgagctgttcaccctgaccagcccagatgccagccagagcacagagaccagcgccatctttgctggcactggaagtgatgtgcagacccccaagtgccacctgaagaggcgcatccagcctgccttcggggctgaccatgatgtgcccaagaggaagaagtttcctgccagcaacatctctgtgaatgatgccaccagcagcgaggagaagtctgaggccaagggagctgaggtgaatgctgtgaccagcaacagaagtgaccccctgaaggatgacccccacatgagcagcaatgtgaccagcaatgaccggctgggggaggagaccaatgctgtgtctggccctgaggagctgagcgtcatctctggaaatggagagtgcagcaacagcagcggcaccgggaagacctccatgcccagcggagatgagagcattgatgagaagctgggcctgagctacaagcgggagcggcccagccaggcccagacagaggccttctgggagaacaagcagatggagaacaacttctacaagcacaagagcaagaccaagcaccacagcgtggccgaggaggagaccctggagaagcacctgcggcccaagcagaagcccaagaacagcaagcactgcagagatgccaagtttgagggcacccgcatcccccacctggtgaagaagaggcgctaccagaagcaggacagcgagaacaagtctgaggccaaggagcagagcaatgatgattatgtgctggagaagctgttcaagaagtctgtgggcgtgcacagcgtgatgaagcatgatgccatcatggatggagccagcccagactatgtgctggtggaggccgaggccaacagagtggcccaggatgccctgaaggccctgcggctgagccggcagcgctgcctgggcgctgtgtctggagtgcccacctggacaggccaccggggcatcagcggggccccagctgggaagaagagcagatttgggaagaagaggaacagcaacttctctgtgcagcaccccagcagcaccagccccacagagaagtgccaggacggcatcatgaagaaggagggcaaggacaacgtgcctgagcacttcagcggccgggcagaagatgctgacagcagcagcggccccctggccagcagcagcctgctggccaagatgagggccaggaaccacctgatcctgcctgagcggctggagagcgagagcggccacctgcaggaggccagcgccctgctgcccaccacagaacatgatgacctgctggtggagatgaggaacttcatcgccttccaggcccacacagatggccaggccagcacccgggagatcctgcaggagtttgagagcaagctgagcgccagccagagctgtgtgttccgggagctgctgaggaacctgtgcaccttccacaggaccagcggcggggagggcatctggaagctgaagccagagtactgctag

SEQ ID NO: 19612 - DNA, 1191 bp, Artificial Sequence
  Description of Artificial Sequence: Synthetic coding sequence
atgctgggcttcctgagcgcccggcagacaggcctggaggaccccctgcggctgcggcgggcagagagcaccaggagagtgctgggcctggagctgaacaaggacagagatgtggagcgcatccacggcggcggcatcaacaccctggacatcgagcctgtggagggccgctacatgctgagcggcggcagtgatggagtcatcgtgctgtatgacctggagaacagcagccggcagagctactacacctgcaaggctgtgtgcagcatcggccgggaccacccagatgtgcaccgctacagcgtggagaccgtgcagtggtacccccatgacaccggcatgttcaccagcagcagctttgacaagaccctgaaggtgtgggacaccaacaccctgcagacagcagatgtgttcaactttgaggagaccgtgtacagccaccacatgagccctgtgtccaccaagcactgcctggtggccgtgggcacccggggccccaaggtgcagctgtgtgacctgaagagcggcagctgcagccacatcctgcagggccaccggcaggagatcctggccgtgtcctggagccccaggtatgactacatcctggccacagccagcgctgacagccgggtgaagctgtgggatgtgagaagagccagcggctgcctgatcaccctggaccagcacaacgggaagaagagccaggccgtggagagcgccaacacagcccacaacgggaaggtgaatggcctgtgcttcaccagtgatggcctgcacctgctgactgtgggcacagacaacaggatgaggctgtggaacagcagcaatggagagaacaccctggtgaactacggcaaggtgtgcaacaacagcaagaagggcctgaagttcaccgtgtcctgtggctgcagcagcgagtttgtgtttgtgccctacggcagcaccatcgctgtgtacacagtgtacagcggggagcagatcaccatgctgaagggccactacaagacagtggactgctgcgtgttccagagcaacttccaggagctgtacagcggcagccgggactgcaacatcctggcctgggtgcccagcctgtatgagcctgtgcctgatgatgatgagaccaccaccaagagccagctgaacccagcctttgaagatgcctggagcagcagtgatgaggagggctag

SEQ ID NO: 19613 - DNA, 1017 bp, Artificial Sequence
  Description of Artificial Sequence: Synthetic coding sequence
atgctgagcggcggcagtgatggagtcatcgtgctgtatgacctggagaacagcagccggcagagctactacacctgcaaggctgtgtgcagcatcggccgggaccacccagatgtgcaccgctacagcgtggagaccgtgcagtggtacccccatgacaccggcatgttcaccagcagcagctttgacaagaccctgaaggtgtgggacaccaacaccctgcagacagcagatgtgttcaactttgaggagaccgtgtacagccaccacatgagccctgtgtccaccaagcactgcctggtggccgtgggcacccggggccccaaggtgcagctgtgtgacctgaagagcggcagctgcagccacatcctgcagggccaccggcaggagatcctggccgtgtcctggagccccaggtatgactacatcctggccacagccagcgctgacagccgggtgaagctgtgggatgtgagaagagccagcggctgcctgatcaccctggaccagcacaacgggaagaagagccaggccgtggagagcgccaacacagcccacaacgggaaggtgaatggcctgtgcttcaccagtgatggcctgcacctgctgactgtgggcacagacaacaggatgaggctgtggaacagcagcaatggagagaacaccctggtgaactacggcaaggtgtgcaacaacagcaagaagggcctgaagttcaccgtgtcctgtggctgcagcagcgagtttgtgtttgtgccctacggcagcaccatcgctgtgtacacagtgtacagcggggagcagatcaccatgctgaagggccactacaagacagtggactgctgcgtgttccagagcaacttccaggagctgtacagcggcagccgggactgcaacatcctggcctgggtgcccagcctgtatgagcctgtgcctgatgatgatgagaccaccaccaagagccagctgaacccagcctttgaagatgcctggagcagcagtgatgaggagggctag

SEQ ID NO: 19614 - DNA, 1188 bp, Artificial Sequence
  Description of Artificial Sequence: Synthetic coding sequence
atggccaccagcagcgccccagctggggtgaggaccaggtatgctggggtgtttgtgaggaccccaaatggatttggaggccccagcagccccagcgagagccgggtgaacacagagagctttggaacaggcatcaacaccctggacatcgagcctgtggagggccgctacatgctgagcggcggcagtgatggagtgattgtgctgtatgacctggagaacagcagccggcagagctactacacctgcaaggctgtgtgcagcatcggccgggaccacccagatgtgcaccgctacagcgtggagaccgtgcagtggtacccccatgacaccggcatgttcaccagcagcagctttgacaagaccctgaaggtgtgggacaccaacaccctgcagacagcagatgtgttcaactttgaggagaccgtgtacagccaccacatgagccctgtgtccaccaagcactgcctggtggccgtgggcacccggggccccaaggtgcagctgtgtgacctgaagagcggcagctgcagccacatcctgcagggccaccggcaggagatcctggccgtgtcctggagccccaggtatgactacatcctggccacagccagcgctgacagccgggtgaagctgtgggatgtgcggcgggccagcggctgcctgatcaccctggaccagcacaacgggaagaagagccaggccgtggagagcgccaacacagcccacaacgggaaggtgaatggcctgtgcttcaccagtgatggcctgcacctgctgactgtgggcacagacaacaggatgaggctgtggaacagcagcaatggagagaacaccctggtgaactacggcaaggtgtgcaacaacagcaagaagggcctgaagttcaccgtgtcctgtggctgcagcagcgagtttgtgtttgtgccctacggcagcaccatcgctgtgtacacagtgtacagcggggagcagatcaccatgctgaagggccactacaagacagtggactgctgcgtgttccagagcaacttccaggagctgtacagcggcagccgggactgcaacatcctggcctgggtgcccagcctgtatgagcctgtgcctgatgatgatgagaccaccaccaagagccagctgaacccagcctttgaagatgcctggagcagcagtgatgaggagggctag

SEQ ID NO: 19615 - DNA, 732 bp, Artificial Sequence
  Description of Artificial Sequence: Synthetic coding sequence
atgggctacaagtacatcaccatcggcacccggggccccaaggtgcagctgtgtgacctgaagagcggcagctgcagccacatcctgcagggccaccggcaggagatcctggccgtgtcctggagccccaggtatgactacatcctggccacagccagcgctgacagccgggtgaagctgtgggatgtgcggcgggccagcggctgcctgatcaccctggaccagcacaacgggaagaagagccaggccgtggagagcgccaacacagcccacaacgggaaggtgaatggcctgtgcttcaccagtgatggcctgcacctgctgactgtgggcacagacaacaggatgaggctgtggaacagcagcaatggagagaacaccctggtgaactacggcaaggtgtgcaacaacagcaagaagggcctgaagttcaccgtgtcctgtggctgcagcagcgagtttgtgtttgtgccctacggcagcaccatcgctgtgtacacagtgtacagcggggagcagatcaccatgctgaagggccactacaagacagtggactgctgcgtgttccagagcaacttccaggagctgtacagcggcagccgggactgcaacatcctggcctgggtgcccagcctgtatgagcctgtgcctgatgatgatgagaccaccaccaagagccagctgaacccagcctttgaagatgcctggagcagcagtgatgaggagggctag

SEQ ID NO: 19616 - DNA, 2541 bp, Artificial Sequence
  Description of Artificial Sequence: Synthetic coding sequence
atgggcatccagggcctgctgcagttcatcaaggaggccagcgagcccatccacgtgaggaagtacaagggccaggtggtggccgtggacacctactgctggctgcacaagggggccatcgcctgtgccgagaagctggccaagggggagcccacagacagatatgtgggcttctgcatgaagtttgtgaacatgctgctgagccacggcatcaagcccatcctggtgtttgatggctgcaccctgcccagcaagaaggaggtggagaggagccggcgggagcggcggcaggccaacctgctgaagggcaagcagctgctgcgggagggcaaggtgtctgaggcccgggagtgcttcaccaggagcatcaacatcacccacgccatggcccacaaggtgatcaaggccgcccggagccagggcgtggactgcctggtggccccctatgaagcagatgcccagctggcctacctgaacaaggccggcatcgtgcaggccatcatcacagaggacagcgacctgctggccttcggctgcaagaaggtgatcctgaagatggaccagtttggaaatggcctggagattgaccaggcccggctgggcatgtgccggcagctgggagatgtgttcacagaggagaagttccgctacatgtgcatcctgagcggctgtgactacctgagcagcctgcggggcatcggcctggccaaggcctgcaaggtgctgcggctggccaacaacccagacatcgtgaaggtgatcaagaagattggccactacctgaagatgaacatcaccgtgcctgaggactacatcaatggcttcatccgggccaacaacaccttcctgtaccagctggtgtttgaccccatcaagaggaagctgatccccctgaatgcctatgaagatgatgtggaccctgagaccctgtcctatgccggccagtatgtggatgacagcatcgccctgcagatcgccctgggcaacaaggacatcaacacctttgagcagattgatgactacaacccagacacagccatgcctgcccacagccgcagccacagctgggatgacaagacctgccagaagagcgccaacgtgagcagcatctggcacaggaactacagccccaggcctgagagcggcaccgtgtctgatgccccccagctgaaggagaaccccagcacagtgggcgtggagagggtcatcagcaccaagggcctgaacctgcccaggaagagcagcatcgtgaagaggcccaggtctgctgagctgtctgaagatgacctgctgagccagtacagcctgtccttcaccaagaagaccaagaagaacagcagcgagggcaacaagagcctgtccttcagcgaggtgtttgtgcctgacctggtgaatggccccaccaacaagaagtctgtgtccaccccacccaggaccaggaacaagtttgccaccttcctgcagaggaagaatgaggagagcggggctgtggtggtgcccggcaccaggagccgcttcttctgcagcagtgacagcacagactgtgtgagcaacaaggtgtccatccagcccctggatgaaacagctgtgacagacaaggagaacaacctgcacgagagtgaatatggagaccaggagggcaagaggctggtggacacagatgtggccaggaacagcagtgatgacatccccaacaaccacatccctggggaccacatcccagacaaggccaccgtcttcacagatgaggagagctacagctttgagagcagcaagttcaccaggaccatcagcccccccaccctgggcaccctgcggagctgcttctcctggagcggcggcctgggggacttcagcaggacccccagccccagccccagcacagccctgcagcagttccggaggaagagtgacagccccaccagcctgcctgagaacaacatgtctgatgtgtcccagctgaagtctgaggagagcagtgatgatgagagccaccccctgcgggaggaggcctgcagcagccagagccaggagagcggggagttcagcctgcagagcagcaatgccagcaagctgagccagtgcagcagcaaggacagcgacagcgaggagagtgactgcaacatcaagctgctggacagccagagcgaccagaccagcaagctgcggctgagccacttcagcaagaaggacacccccctgaggaacaaggtgcccggcctgtacaagagcagcagcgctgacagcctgagcaccaccaagatcaagcccctgggccctgcccgggccagcggcctgagcaagaagccagccagcatccagaagaggaagcaccacaatgctgagaacaagccaggcctgcagatcaagctgaatgagctgtggaagaactttggcttcaagaaggacagcgagaagctgcccccctgcaagaagcccctgagccctgtgcgggacaacatccagctgaccccagaggccgaggaggacatcttcaacaagccagaatgtggccgggtgcagagggccatcttccagtag

SEQ ID NO: 19617 - DNA, 510 bp, Artificial Sequence
  Description of Artificial Sequence: Synthetic coding sequence
atgggcatccagggcctgctgcagttcatcaaggaggccagcgagcccatccacgtgaggaagtacaagggccaggtggtggccgtggacacctactgctggctgcacaagggggccatcgcctgtgccgagaagctggccaagggggagcccacagacagaagacggcaggccaacctgctgaagggcaagcagctgctgcgggagggcaaggtgtctgaggcccgggagtgcttcaccaggagcatcaacatcacccacgccatggcccacaaggtgatcaaggccgcccggagccagggcgtggactgcctggtggccccctatgaagcagatgcccagctggcctacctgaacaaggccggcatcgtgcaggccatcatcacagaggacagcgacctgctggccttcggctgcaagaaggtgatcctgaagatggaccagtttggaaatggcctggagattgaccaggcccggctgggcatgtgccggcagctgggagatgtgtag

SEQ ID NO: 19618 - DNA, 2541 bp, Artificial Sequence; identical to SEQ ID NO: 19616
  Description of Artificial Sequence: Synthetic coding sequence

SEQ ID NO: 19619 - DNA, 408 bp, Artificial Sequence
  Description of Artificial Sequence: Synthetic coding sequence
atgggcatccagggcctgctgcagttcatcaaggaggccagcgagcccatccacgtgaggaagtacaagggccaggtggtggccgtggacacctactgctggctgcacaagggggccatcgcctgtgccgagaagctggccaagggggagcccacagacagatatgtgggcttctgcatgaagtttgtgaacatgctgctgagccacggcatcaagcccatcctggtgtttgatggctgcaccctgcccagcaagaaggaggtggagaggagccggcgggagcggcggcaggccaacctgctgaagggcaagcagctgctgcgggagggcaaggtgtctgaggcccgggagtgcttcaccaggagcatcaacatcacccacgccatggcccacaaggtgatcaagtag

SEQ ID NO: 19620 - DNA, 2412 bp, Artificial Sequence
  Description of Artificial Sequence: Synthetic coding sequence
atgggcatccagggcctgctgcagttcatcaaggaggccagcgagcccatccacgtgaggaagtacaagggccaggtggtggccgtggacacctactgctggctgcacaagggggccatcgcctgtgccgagaagctggccaagggggagcccacagacagatatgtgggcttctgcatgaagtttgtgaacatgctgctgagccacggcatcaagcccatcctggtgtttgatggctgcaccctgcccagcaagaaggaggtggagaggagccggcgggagcggcggcaggccaacctgctgaagggcaagcagctgctgcgggagggcaaggtgtctgaggcccgggagtgcttcaccaggagcatcaacatcacccacgccatggcccacaaggtgatcaaggccgcccggagccagggcgtggactgcctggtggccccctatgaagcagatgcccagctggcctacctgaacaaggccggcatcgtgcaggccatcatcacagaggacagcgacctgctggccttcggctgcaagaaggtgatcctgaagatggaccagtttggaaatggcctggagattgaccaggcccggctgggcatgtgccggcagctgggagatgtgttcacagaggagaagttccgctacatgtgcatcctgagcggctgtgactacctgagcagcctgcggggcatcggcctggccaaggcctgcaaggtgctgcggctggccaacaacccagacatcgtgaaggtgatcaagaagattggccactacctgaagatgaacatcaccgtgcctgaggactacatcaatggcttcatccgggccaacaacaccttcctgtaccagctggtgtttgaccccatcaagaggaagctgatccccctgaatgcctatgaagatgatgtggaccctgagaccctgtcctatgccggccagtatgtggatgacagcatcgccctgcagatcgccctgggcaacaaggacatcaacacctttgagcagattgatgactacaacccagacacagccatgcctgcccacagccgcagccacagctgggatgacaagacctgccagaagagcgccaacgtgagcagcatctggcacaggaactacagccccaggcctgagagcggcaccgtgtctgatgccccccagctgaaggagaaccccagcacagtgggcgtggagagggtcatcagcaccaagggcctgaacctgcccaggaagagcagcatcgtgaagaggcccaggtctgctgagctgtctgaagatgacctgctgagccagtacagcctgtccttcaccaagaagaccaagaagaacagcagcgagggcaacaagagcctgtccttcagcgaggtgtttgtgcctgacctggtgaatggccccaccaacaagaagtctgtgtccaccccacccaggaccaggaacaagtttgccaccttcctgcagaggaagaatgaggagagcggggctgtggtggtgcccggcaccaggagccgcttcttctgcagcagtgacagcacagactgtgtgagcaacaaggtgtccatccagcccctggatgaaacagctgtgacagacaaggagaacaacctgcacgagagtgaatatggagaccaggagggcaagaggctggtggacacagatgtggccaggaacagcagtgatgacatccccaacaaccacatccctggggaccacatcccagacaaggccaccgtcttcacagatgaggagagctacagctttgagagcagcaagttcaccaggaccatcagcccccccaccctgggcaccctgcggagctgcttctcctggagcggcggcctgggggacttcagcaggacccccagccccagccccagcacagccctgcagcagttccggaggaagagtgacagccccaccagcctgcctgagaacaacatgtctgatgtgtcccagctgaagtctgaggagagcagtgatgatgagagccaccccctgcgggaggaggcctgcagcagccagagccaggagagcggggagttcagcctgcagagcagcaatgccagcaagctgagccagtgcagcagcaaggacagcgacagcgaggagagtgactgcaacatcaagctgctggacagccagagcgaccagaccagcaagctgcggctgagccacttcagcaagaaggacacccccctgaggaacaaggtgcccggcctgtacaagagcagcagcgctgacagcctgagcaccaccaagatcaagcccctgggccctgcccgggccagcggcctgagcaagaagccagccagcatccagaagaggaagcaccacaatgctgagaacaagccaggcctgcagatcaagctgaatgagctgtggaagaactttggcttcaagaagttctag

SEQ ID NO: 19621 - DNA, 36 bp, Artificial Sequence; identical to SEQ ID NO: 10645
  Description of Artificial Sequence: Synthetic coding sequence

SEQ ID NO: 19622 - DNA, 2241 bp, Artificial Sequence
  Description of Artificial Sequence: Synthetic coding sequence
atgcaggccaagaagcgctacttcatcctgctgtctgctggcagctgcctggccctgctcttctactttggaggcctgcagttccgggccagccgcagccacagccggcgggaggagcacagcggcagaaatggcctgcaccaccccagcccagaccacttctggccccgcttcccagatgccctgcggccctttgtgccctgggaccagctggagaatgaagacagctctgtgcacatcagcccccggcagaagagagatgccaacagcagcatctacaagggcaagaagtgcaggatggagagctgctttgacttcaccctgtgcaagaagaatggcttcaaggtgtatgtgtacccccagcagaagggggagaagattgctgagagctaccagaacatcctggccgccatcgagggcagccgcttctacaccagtgaccccagccaggcctgcctgtttgtgctgagcctggacaccctggaccgggaccagctgagcccccagtatgtgcacaacctgcggagcaaggtgcagagcctgcacctgtggaacaacggcaggaaccacctgatcttcaacctgtacagcggcacctggccagactacacagaagatgtgggctttgatattggccaggccatgctggccaaggccagcatcagcacagagaacttccggcccaactttgatgtgtccatccccctcttcagcaaggaccaccccaggactggaggagagcggggcttcctgaagttcaacaccatcccccccctgaggaagtacatgctggtgttcaagggcaagcgctacctgactggaattggaagtgacaccagaaatgccctgtaccacgtgcacaacggggaggatgtggtgctgctgaccacctgcaagcacggcaaggactggcagaagcacaaggacagccgctgtgaccgggacaacacagaatatgagaagtatgactaccgggagatgctgcacaatgccaccttctgcctggtgccccggggccggcggctgggcagcttccgcttcctggaggccctgcaggccgcctgtgtgcctgtgatgctgagcaatggctgggagctgcccttcagcgaggtgatcaactggaaccaggccgctgtgattggagatgagcggctgctgctgcagatccccagcaccatccgcagcatccaccaggacaagatcctggccctgcggcagcagacccagttcctgtgggaggcctacttcagctctgtggagaagatcgtgctgaccaccctggagatcatccaggaccgcatcttcaagcacatcagcaggaacagcctcatctggaacaagcaccctgggggcctgtttgtgctgccccagtacagcagctacctgggggacttcccctactactatgccaacctgggcctgaagccacccagcaagttcaccgctgtgattcatgctgtgacccccctggtgtcccagagccagcctgtgctgaagctgctggtggccgccgccaagagccagtactgtgcccagatcatcgtgctgtggaactgtgacaagcccctgcctgccaagcaccgctggccagccacagctgtgcctgtggtggtgattgaaggagagagcaaggtgatgagcagccgcttcctgccctatgacaacatcatcacagatgctgtgctgagcctggatgaggacacagtgctgagcaccacagaggtggactttgccttcaccgtgtggcagagcttccctgagagaattgtgggctacccagcccggagccacttctgggacaacagcaaggagcgctggggctacaccagcaagtggaccaatgactacagcatggtgctgactggagctgccatctaccacaagtactaccactacctgtacagccactacctgcctgccagcctgaagaacatggtggaccagctggccaactgtgaggacatcctgatgaacttcctggtgtctgctgtgaccaagctgccccccatcaaggtgacccagaagaagcagtacaaggagaccatgatgggccagaccagccgggccagccgctgggccgaccctgaccactttgcccagaggcagagctgcatgaacacctttgcctcctggtttggctacatgcccctcatccacagccagatgaggctggaccctgtgctcttcaaggaccaggtgtccatcctgaggaagaagtacagagacatcgagcggctgtag

SEQ ID NO: 19623 - DNA, 2157 bp, Artificial Sequence
  Description of Artificial Sequence: Synthetic coding sequence
atgtgtgcctctgtgaagtacaacatccggggccctgccctgatccccaggatgaagaccaagcaccgcatctactacatcaccctcttcagcatcgtgctgctgggcctcatcgccaccggcatgttccagttctggccccacagcattgagagcagcaatgactggaatgtggagaagaggagcatcagagatgtgcctgtggtgcggctgcctgctgacagccccatccctgagcggggggacctgagctgcaggatgcacacctgctttgatgtgtaccgctgtggcttcaaccccaagaacaagatcaaggtgtacatctatgccctgaagaagtatgtggatgactttggagtgtctgtgagcaacaccatcagccgggagtacaatgagctgctgatggccatcagtgacagcgactactacacagatgacatcaacagagcctgcctgtttgtgcccagcattgatgtgctgaaccagaacaccctgcgcatcaaggagacagcccaggccatggcccagctgagccgctgggaccggggcaccaaccacctgctcttcaacatgctgcccggcggccccccagactacaacacagccctggatgtgccccgggaccgggccctgctggccggcggcggcttcagcacctggacctaccggcagggctatgatgtgtccatccctgtgtacagccccctgtctgctgaggtggacctgcctgagaagggccctggcccccggcagtacttcctgctgagcagccaggtgggcctgcaccctgagtaccgggaggacctggaggccctgcaggtgaagcacggggagagcgtgctggtgctggacaagtgcaccaacctgtctgagggcgtgctgtctgtgaggaagcgctgccacaagcaccaggtgtttgactacccccaggtgctgcaggaggccaccttctgtgtggtgctgcggggggcccggctgggccaggccgtgctgagtgatgtgctgcaggccggctgtgtgcctgtggtgattgctgacagctacatcctgcccttcagcgaggtgctggactggaagagggcctctgtggtggtgcctgaggagaagatgtctgatgtgtacagcatcctgcagagcatcccccagaggcagatcgaggagatgcagaggcaggcccgctggttctgggaggcctacttccagagcatcaaggccatcgccctggccaccctgcagatcatcaatgaccgcatctacccctatgctgccatctcctatgaggagtggaatgaccccccagctgtgaagtggggctctgtgagcaaccccctcttcctgcccctcatccccccccagagccagggcttcaccgccatcgtgctgacctatgacagagtggagagcctcttccgggtcatcacagaggtgtccaaggtgcccagcctgagcaagctgctggtggtgtggaacaaccagaacaagaaccccccagaggacagcctgtggcccaagatccgggtgcccctgaaggtggtgaggacagctgagaacaagctgagcaaccgcttcttcccctatgatgaaattgaaacagaagctgtgctggccattgatgatgacatcatcatgctgaccagtgatgagctgcagtttggctatgaggtgtggagggagttcccagaccggctggtgggctacccaggccgcctgcacctgtgggaccacgagatgaacaagtggaagtatgagagcgagtggaccaatgaggtgtccatggtgctgactggagctgccttctaccacaagtacttcaactacctgtacacctacaagatgcctggggacatcaagaactgggtggatgcccacatgaactgtgaagatattgccatgaacttcctggtggccaacgtgacaggcaaggccgtcatcaaggtgacccccaggaagaagttcaagtgcccagagtgcacagccattgatggcctgagcctggaccagacccacatggtggagaggtctgagtgcatcaacaagtttgcctctgtgtttggcaccatgcccctgaaggtggtggagcacagagctgaccctgtgctgtacaaggatgacttccctgagaagctgaagagcttccccaacatcggcagcctgtag

SEQ ID NO: 19624 - DNA, 2187 bp, Artificial Sequence
  Description of Artificial Sequence: Synthetic coding sequence
atgtgtgcctctgtgaagtacaacatccggggccctgccctgatccccaggatgaagaccaagcaccgcatctactacatcaccctcttcagcatcgtgctgctgggcctcatcgccaccggcatgttccagttctggccccacagcattgagagcagcaatgactggaatgtggagaagaggagcatcagagatgtgcctgtggtgcggctgcctgctgacagccccatccctgagcggggggacctgagctgcaggatgcacacctgctttgatgtgtaccgctgtggcttcaaccccaagaacaagatcaaggtgtacatctatgccctgaagaagtatgtggatgactttggagtgtctgtgagcaacaccatcagccgggagtacaatgagctgctgatggccatcagtgacagcgactactacacagatgacatcaacagagcctgcctgtttgtgcccagcattgatgtgctgaaccagaacaccctgcgcatcaaggagacagcccaggccatggcccagctgagccgctgggaccggggcaccaaccacctgctcttcaacatgctgcccggcggccccccagactacaacacagccctggatgtgccccgggaccgggccctgctggccggcggcggcttcagcacctggacctaccggcagggctatgatgtgtccatccctgtgtacagccccctgtctgctgaggtggacctgcctgagaagggccctggcccccggcagtacttcctgctgagcagccaggtgggcctgcaccctgagtaccgggaggacctggaggccctgcaggtgaagcacggggagagcgtgctggtgctggacaagtgcaccaacctgtctgagggcgtgctgtctgtgaggaagcgctgccacaagcaccaggtgtttgactacccccaggtgctgcaggaggccaccttctgtgtggtgctgcggggggcccggctgggccaggccgtgctgagtgatgtgctgcaggccggctgtgtgcctgtggtgattgctgacagctacatcctgcccttcagcgaggtgctggactggaagagggcctctgtggtggtgcctgaggagaagatgtctgatgtgtacagcatcctgcagagcatcccccagaggcagatcgaggagatgcagaggcagctgttcatggagcccgcccggcgggagaactggagcgctgccaaccaccagatgaacagcctcatctggccccgggagcagtgggacagccagatcatcaatgaccgcatctacccctatgctgccatctcctatgaggagtggaatgaccccccagctgtgaagtggggctctgtgagcaaccccctcttcctgcccctcatccccccccagagccagggcttcaccgccatcgtgctgacctatgacagagtggagagcctcttccgggtcatcacagaggtgtccaaggtgcccagcctgagcaagctgctggtggtgtggaacaaccagaacaagaaccccccagaggacagcctgtggcccaagatccgggtgcccctgaaggtggtgaggacagctgagaacaagctgagcaaccgcttcttcccctatgatgaaattgaaacagaagctgtgctggccattgatgatgacatcatcatgctgaccagtgatgagctgcagtttggctatgaggtgtggagggagttcccagaccggctggtgggctacccaggccgcctgcacctgtgggaccacgagatgaacaagtggaagtatgagagcgagtggaccaatgaggtgtccatggtgctgactggagctgccttctaccacaagtacttcaactacctgtacacctacaagatgcctggggacatcaagaactgggtggatgcccacatgaactgtgaagatattgccatgaacttcctggtggccaacgtgacaggcaaggccgtcatcaaggtgacccccaggaagaagttcaagtgcccagagtgcacagccattgatggcctgagcctggaccagacccacatggtggagaggtctgagtgcatcaacaagtttgcctctgtgtttggcaccatgcccctgaaggtggtggagcacagagctgaccctgtgctgtacaaggatgacttccctgagaagctgaagagcttccccaacatcggcagcctgtag

SEQ ID NO: 19625 - DNA, 2256 bp, Artificial Sequence
  Description of Artificial Sequence: Synthetic coding sequence
atgagctgtgccagcggcagcggcggcggcctgcggcaccccctgcgctgccagaagccctgggatgaggagtgtgaggaggaggccgtgtgtgtgatcatgtgtgcctctgtgaagtacaacatccggggccctgccctgatccccaggatgaagaccaagcaccgcatctactacatcaccctcttcagcatcgtgctgctgggcctgattgccaccggcatgttccagttctggccccacagcattgagagcagcaatgactggaatgtggagaagaggagcatcagagatgtgcctgtggtgcggctgcctgctgacagccccatccctgagcggggggacctgagctgcaggatgcacacctgctttgatgtgtaccgctgtggcttcaaccccaagaacaagatcaaggtgtacatctatgccctgaagaagtatgtggatgactttggagtgtctgtgagcaacaccatcagccgggagtacaatgagctgctgatggccatcagtgacagcgactactacacagatgacatcaacagagcctgcctgtttgtgcccagcattgatgtgctgaaccagaacaccctgcgcatcaaggagacagcccaggccatggcccagctgagccgctgggaccggggcaccaaccacctgctcttcaacatgctgcccggcggccccccagactacaacacagccctggatgtgccccgggaccgggccctgctggccggcggcggcttcagcacctggacctaccggcagggctatgatgtgtccatccctgtgtacagccccctgtctgctgaggtggacctgcctgagaagggccctggcccccggcagtacttcctgctgagcagccaggtgggcctgcaccctgagtaccgggaggacctggaggccctgcaggtgaagcatggagagagcgtgctggtgctggacaagtgcaccaacctgtctgaaggagtgctgtctgtgaggaagcgctgccacaagcaccaggtgtttgactacccccaggtgctgcaggaggccaccttctgtgtggtgctgcggggggcccggctgggccaggccgtgctgagtgatgtgctgcaggccggctgtgtgcctgtggtgattgctgacagctacatcctgcccttcagcgaggtgctggactggaagagggcctctgtggtggtgcctgaggagaagatgtctgatgtgtacagcatcctgcagagcatcccccagaggcagatcgaggagatgcagaggcaggcccgctggttctgggaggcctacttccagagcatcaaggccatcgccctggccaccctgcagatcatcaatgaccgcatctacccctatgctgccatctcctatgaggagtggaatgaccccccagctgtgaagtggggctctgtgagcaaccccctcttcctgcccctcatccccccccagagccagggcttcaccgccatcgtgctgacctatgacagagtggagagcctcttccgggtcatcacagaggtgtccaaggtgcccagcctgagcaagctgctggtggtgtggaacaaccagaacaagaaccccccagaggacagcctgtggcccaagatccgggtgcccctgaaggtggtgaggacagctgagaacaagctgagcaaccgcttcttcccctatgatgaaattgaaacagaggccgtgctggccattgatgatgacatcatcatgctgaccagtgatgagctgcagtttggctatgaggtgtggagggagttcccagaccggctggtgggctacccaggccgcctgcacctgtgggaccacgagatgaacaagtggaagtatgaaagtgagtggaccaatgaggtgtccatggtgctgaccggggccgccttctaccacaagtacttcaactacctgtacacctacaagatgcctggggacatcaagaactgggtggatgcccacatgaactgtgaggacatcgccatgaacttcctggtggccaacgtgacaggcaaggctgtgatcaaggtgacccccaggaagaagttcaagtgcccagaatgtacagccattgatggcctgagcctggaccagacccacatggtggagaggtctgagtgcatcaacaagtttgcctctgtgtttggcaccatgcccctgaaggtggtggagcacagagctgaccctgtgctgtacaaggatgacttccctgagaagctgaagagcttccccaacatcggcagcctgtag

SEQ ID NO: 19626 - DNA, 339 bp, Artificial Sequence
  Description of Artificial Sequence: Synthetic coding sequence
atgtgtgcctctgtgaagtacaacatccggggccctgccctgatccccaggatgaagaccaagcaccgcatctactacatcaccctcttcagcatcgtgctgctgggcctcatcgccaccggcatgttccagttctggccccacagcattgagagcagcaatgactggaatgtggagaagaggagcatcagagatgtgcctgtggtgcggctgcctgctgacagccccatccctgagcggggggacctgagctgcaggatgcacacctgctttgatgtgtaccgctgtggcttcaaccccaagaacaagatcaaggtgtacatctatgccctgaagtag

SEQ ID NO: 19627 - DNA, 150 bp, Artificial Sequence
  Description of Artificial Sequence: Synthetic coding sequence
atgtgtgcctctgtgaagtacaacatccggggccctgccctgatccccaggatgaagaccaagcaccgcatctactacatcaccctcttcagcatcgtgctgctgggcctcatcgccaccggcatgttccagttctggccccacagctag

SEQ ID NO: 19628 - DNA, 2157 bp, Artificial Sequence; identical to SEQ ID NO: 19623
  Description of Artificial Sequence: Synthetic coding sequence

SEQ ID NO: 19629 - DNA, 1761 bp, Artificial Sequence
  Description of Artificial Sequence: Synthetic coding sequence
atgcccaagcccatcaacgtgcgggtgaccaccatggatgctgagctggagtttgccatccagcccaacaccaccgggaagcagctgtttgaccaggtggtgaagaccatcggcctgcgggaggtgtggtacttcggcctgcactacgtggacaacaagggcttccccacctggctgaagctggacaagaaggtgtctgcccaggaggtgaggaaagaaaaccccctgcagttcaagttccgggccaagttctacccagaagatgtggccgaggagctgatccaggacatcacccagaagctgttcttcctgcaggtgaaggagggcatcctgagtgatgagatctactgccccccagagacagctgtgctgctgggcagctatgctgtgcaggccaagtttggagactacaacaaggaggtgcacaagagcggctacctgagcagcgagcggctcatcccccagagggtgatggaccagcacaagctgacccgggaccagtgggaggaccgcatccaggtgtggcatgctgagcaccggggcatgctgaaggacaatgccatgctggagtacctgaagatcgcccaggacctggagatgtatggcatcaactactttgagatcaagaacaagaagggcacagacctgtggctgggcgtggatgccctgggcctgaacatctatgagaaggatgacaagctgacccccaagattggcttcccctggagcgagatccggaacatctccttcaatgacaagaagtttgtgatcaagcccatcgacaagaaggccccagactttgtgttctacgccccccggctgcgcatcaacaagaggatcctgcagctgtgcatgggcaaccacgagctgtacatgagaagaaggaagccagacaccatcgaggtgcagcagatgaaggcccaggcccgggaggagaagcaccagaagcagctggagcggcagcagctggagacagagaagaagagaagagagaccgtggagcgggagaaggagcagatgatgagggagaaggaggagctgatgctgcggctgcaggactatgaggagaagaccaagaaggccgagcgggagctgtctgagcagatccagagggccctgcagctggaggaggagaggaagagggcccaggaggaggccgagcggctggaggccgacaggatggccgccctgcgggccaaggaggagctggagcggcaggccgtggaccagatcaagagccaggagcagctggccgctgagctggccgagtacacagccaagatcgccctgctggaggaggcccggcggaggaaagaagatgaggtggaggagtggcagcaccgggccaaggaggcccaggatgacctggtgaagaccaaggaggagctgcacctggtgatgacagcccctcctcctcctcctcctcctgtgtatgagcctgtgtcctaccacgtgcaggagagcctgcaggatgaaggagctgagcccaccggctacagcgctgagctgagcagcgagggcatcagagatgacagaaatgaggagaagaggatcacagaagctgagaagaatgaaagagtgcagaggcagctgctgaccctgagcagcgagctgagccaggccagagatgagaacaagaggacccacaatgacatcatccacaatgaaaacatgaggcagggccgggacaagtacaagaccctgcggcagatccggcagggcaacaccaagcagagaattgatgaatttgaggccctgtag

SEQ ID NO: 19630 - DNA, 1761 bp, Artificial Sequence; identical to SEQ ID NO: 19629
  Description of Artificial Sequence: Synthetic coding sequence

SEQ ID NO: 19631 - DNA, 1665 bp, Artificial Sequence
  Description of Artificial Sequence: Synthetic coding sequence
atgcccaagcccatcaacgtgcgggtgaccaccatggatgctgagctggagtttgccatccagcccaacaccaccgggaagcagctgtttgaccaggtgtctgcccaggaggtgaggaaagaaaaccccctgcagttcaagttccgggccaagttctacccagaagatgtggccgaggagctgatccaggacatcacccagaagctgttcttcctgcaggtgaaggagggcatcctgagtgatgagatctactgccccccagagacagctgtgctgctgggcagctatgctgtgcaggccaagtttggagactacaacaaggaggtgcacaagagcggctacctgagcagcgagcggctcatcccccagagggtgatggaccagcacaagctgacccgggaccagtgggaggaccgcatccaggtgtggcatgctgagcaccggggcatgctgaaggacaatgccatgctggagtacctgaagatcgcccaggacctggagatgtatggcatcaactactttgagatcaagaacaagaagggcacagacctgtggctgggcgtggatgccctgggcctgaacatctatgagaaggatgacaagctgacccccaagattggcttcccctggagcgagatccggaacatctccttcaatgacaagaagtttgtgatcaagcccatcgacaagaaggccccagactttgtgttctacgccccccggctgcgcatcaacaagaggatcctgcagctgtgcatgggcaaccacgagctgtacatgagaagaaggaagccagacaccatcgaggtgcagcagatgaaggcccaggcccgggaggagaagcaccagaagcagctggagcggcagcagctggagacagagaagaagagaagagagaccgtggagcgggagaaggagcagatgatgagggagaaggaggagctgatgctgcggctgcaggactatgaggagaagaccaagaaggccgagcgggagctgtctgagcagatccagagggccctgcagctggaggaggagaggaagagggcccaggaggaggccgagcggctggaggccgacaggatggccgccctgcgggccaaggaggagctggagcggcaggccgtggaccagatcaagagccaggagcagctggccgctgagctggccgagtacacagccaagatcgccctgctggaggaggcccggcggaggaaagaagatgaggtggaggagtggcagcaccgggccaaggaggcccaggatgacctggtgaagaccaaggaggagctgcacctggtgatgacagcccctcctcctcctcctcctcctgtgtatgagcctgtgtcctaccacgtgcaggagagcctgcaggatgaaggagctgagcccaccggctacagcgctgagctgagcagcgagggcatcagagatgacagaaatgaggagaagaggatcacagaagctgagaagaatgaaagagtgcagaggcagctgctgaccctgagcagcgagctgagccaggccagagatgagaacaagaggacccacaatgacatcatccacaatgaaaacatgaggcagggccgggacaagtacaagaccctgcggcagatccggcagggcaacaccaagcagagaattgatgaatttgaggccctgtag

SEQ ID NO: 19632 - DNA, 900 bp, Artificial Sequence
  Description of Artificial Sequence: Synthetic coding sequence
atgggcaccaaggcccaggtggagaggaagctgctgtgcctcttcatcctggccatcctgctgtgcagcctggccctgggctctgtgacagtgcacagcagcgagcctgaggtgcgcatccctgagaacaaccctgtgaagctgagctgtgcctacagcggcttcagcagcccccgggtggagtggaagtttgaccagggcgacaccacccggctggtgtgctacaacaacaagatcacagccagctatgaggacagagtgaccttcctgcccaccggcatcaccttcaagtctgtgacccgggaggacaccggcacctacacctgcatggtgtctgaggagggcggcaacagctatggagaggtgaaggtgaagctgattgtgctggtgccccccagcaagcccaccgtgaacatccccagcagcgccaccatcggcaacagagctgtgctgacctgcagcgagcaggacggcagcccccccagcgagtacacctggttcaaggatggcatcgtgatgcccaccaaccccaagagcacccgggccttcagcaacagcagctatgtgctgaaccccaccaccggggagctggtgtttgaccccctgagcgccagtgacacaggagagtacagctgtgaggccagaaatggctacggcacccccatgaccagcaatgctgtgaggatggaggccgtggagagaaatgtgggcgtgattgtggccgctgtgctggtgaccctcatcctgctgggcatcctggtgtttggcatctggtttgcctacagccggggccactttgacaggaccaagaagggcaccagcagcaagaaggtgatctacagccagcccagcgcccggtctgagggggagttcaagcagaccagcagcttcctggtgtag

SEQ ID NO: 19633 - DNA, 900 bp, Artificial Sequence; identical to SEQ ID NO: 19632
  Description of Artificial Sequence: Synthetic coding sequence

SEQ ID NO: 19634 - DNA, 900 bp, Artificial Sequence; identical to SEQ ID NO: 19632
  Description of Artificial Sequence: Synthetic coding sequence

SEQ ID NO: 19635 - DNA, 912 bp, Artificial Sequence
  Description of Artificial Sequence: Synthetic coding sequence
atgctgcaggccccccggggccgggcccgggccgccctgcggcggctggccgtggccaccaggaccatggccggcggcagcctggccctgggctctgtgacagtgcacagcagcgagcctgaggtgcgcatccctgagaacaaccctgtgaagctgagctgtgcctacagcggcttcagcagcccccgggtggagtggaagtttgaccagggcgacaccacccggctggtgtgctacaacaacaagatcacagccagctatgaggacagagtgaccttcctgcccaccggcatcaccttcaagtctgtgacccgggaggacaccggcacctacacctgcatggtgtctgaggagggcggcaacagctatggagaggtgaaggtgaagctgattgtgctggtgccccccagcaagcccaccgtgaacatccccagcagcgccaccatcggcaacagagctgtgctgacctgcagcgagcaggacggcagcccccccagcgagtacacctggttcaaggatggcatcgtgatgcccaccaaccccaagagcacccgggccttcagcaacagcagctatgtgctgaaccccaccaccggggagctggtgtttgaccccctgagcgccagtgacacaggagagtacagctgtgaggccagaaatggctacggcacccccatgaccagcaatgctgtgaggatggaggccgtggagagaaatgtgggcgtgattgtggccgctgtgctggtgaccctcatcctgctgggcatcctggtgtttggcatctggtttgcctacagccggggccactttgacaggaccaagaagggcaccagcagcaagaaggtgatctacagccagcccagcgcccggtctgagggggagttcaagcagaccagcagcttcctggtgtag

SEQ ID NO: 19636 - DNA, 753 bp, Artificial Sequence
  Description of Artificial Sequence: Synthetic coding sequence
atgggcaccaaggcccaggtggagaggaagctgctgtgcctcttcatcctggccatcctgctgtgcagcctggccctgggctctgtgacagtgcacagcagcgagcctgaggtgcgcatccctgagaacaaccctgtgaagctgagctgtgcctacagcggcttcagcagcccccgggtggagtggaagtttgaccagggcgacaccacccggctggtgtgctacaacaacaagatcaccgtgccccccagcaagcccaccgtgaacatccccagcagcgccaccatcggcaacagagctgtgctgacctgcagcgagcaggacggcagccccccatctgagtacacctggttcaaggatggcatcgtgatgcccaccaaccccaagagcacccgggccttcagcaacagcagctatgtgctgaaccccaccactggagagctggtgtttgaccccctgagcgccagtgacaccggggagtacagctgtgaggccagaaatggctacggcacccccatgaccagcaatgctgtgaggatggaggccgtggagagaaatgtgggcgtcatcgtggccgctgtgctggtgaccctcatcctgctgggcatcctggtgtttggcatctggtttgcctacagccggggccactttgacaggaccaagaagggcaccagcagcaagaaggtgatctacagccagcccagcgcccggtctgagggggagttcaagcagaccagcagcttcctggtgtag

SEQ ID NO: 19637 - DNA, 3357 bp, Artificial Sequence
  Description of Artificial Sequence: Synthetic coding sequence
atgggcgtgcagggcttccaggactacatcgagaagcactgccccagcgctgtggtgcctgtggagctgcagaagctggcccggggcagcctggtgggcggcggccggcagaggcctccccagacccccctgcggctgctggtggatgctgacaactgcctgcaccggctgtatggaggcttctacacagactgggtgtctgggggccagtggaaccacatgctgggctacctggccgccctggccaaggcctgcttcggcggcaacatcgagctgtttgtgttcttcaatggagccctggagaaggcccggctgcacgagtgggtgaagaggcagggcaatgaaaggcagacagcccagcagatcgtgagccacgtgcagaacaagggcaccccaccacccaaggtgtggttcctgccccctgtgtgcatggcccactgcatccggctggccctgatccgcttccacgtgaaggtggcccagagcattgaggaccaccaccaggaggtgattggcttctgccgggagaatggcttccacggcctggtggcctatgacagcgactatgccctgtgcaacatcccctactacttcagcgcccacgccctgaagctgagcagaaatggcaagagcctgaccaccagccagtacctgatgcatgaggtggccaagcagctggacctgaaccccaaccgcttccccatctttgctgccctgctgggcaaccacatcctgcctgatgaggacctggccagcttccactggagcctgctgggccctgagcaccccctggccagcctgaaggtgcgggcccaccagctggtgctgcccccctgtgatgtggtgatcaaggctgtggccgactatgtgaggaacatccaggacaccagtgacctggatgccatcgccaaggatgtgttccagcacagccagagcaggacagatgacaaggtgatccgcttcaagagggccatcggctactacagcgccaccagcaagcccatgtccttccaccccccccactacctggccgcccggcccggccccttcggcatgcctggcatggtgccccctcatgtgcccccccagatgctgaacatcccccagaccagcctgcaggccaagcctgtggccccccaggtgcccagccctgggggcgcccctggccagggcccctacccctacagcctgtctgagcccgcccccctgaccctggacaccagcggcaagaacctgacagagcagaacagctacagcaacatcccccatgagggcaagcacacccccctgtatgaaagaagcagccccatcaacccagcccagagcggcagccccaaccacgtggacagcgcctacttccctggcagcagcaccagcagcagcagtgacaatgatgagggcagcggcggggccaccaaccacatcagcggcaacaagattggctgggagaagacaggcagccacagcgagccccaggcccggggggaccccggggaccagaccaaggccgagggcagcagcacagccagcagcggcagccagctggccgagggcaagggcagccagatgggcaccgtgcagcccatcccctgcctgctgtccatgcccaccaggaaccacatggacatcaccaccccacccctgccccctgtggcccctgaggtgctgcgggtggccgagcaccgccacaagaagggcctgatgtacccctacatcttccacgtgctgaccaagggggagatcaagattgctgtgtccattgaagatgaggccaacaaggacctgcccccagctgccctgctgtacagacctgtgcggcagtatgtgtatggagtgctcttcagcctggccgagagcaggaagaagacagagcggctggccttcaggaagaaccggctgcccccagagttcagccctgtgatcatcaaggagtgggccgcctacaagggcaagagcccccagaccccagagctggtggaggccctggccttccgggagtggacctgccccaacctgaagaggctgtggctgggcaaggctgtggaggacaagaacagaaggatgagggccttcctggcctgcatgagaagtgacaccccagccatgctgaacccagccaacgtgcccacccacctgatggtgctgtgctgcgtgctgcgctacatggtgcagtggccaggggcccgcatcctgcggcggcaggagctggatgccttcctggcccaggccctgagccccaagctgtatgagccagaccagctgcaggagctgaagattgagaacctggacccccggggcatccagctgagcgccctcttcatgtctggagtggacatggccctgtttgccaatgatgcctgtggccagcccatcccctgggagcactgctgcccctggatgtactttgatggcaagctgttccagagcaagctgctgaaggccagccgggagaagacccccctgattgacctgtgtgatggccaggccgaccaggccgccaaggtggagaagatgaggcagagcgtgctggagggcctgtccttcagccggcagagccacaccctgcccttccccccacctccagccctgcccttctacccagccagcgcctaccccaggcactttggacctgtgccccccagccagggccggggccggggctttgctggggtgtgtggctttggaggcccctacggggagaccgtggccaccggcccctaccgggccttccgggtggccgccgccagcggccactgtggggccttcagcggcagtgacagcagcaggaccagcaagagccagggcggcgtgcagcccatccccagccagggcggcaagctggagattgctggcaccgtggtgggccactgggccggcagcagaagaggccggggcggccggggccccttccccctgcaggtggtgtctgtgggcggccctgcccggggccggccccggggcgtcatcagcacccctgtgatccgcaccttcggccggggcggccgctactacggccggggctacaagaaccaggccgccatccagggccggcccccctatgctgccagcgctgaggaggtggccaaggagctgaagagcaagtctggagagagcaagagcagcgccatgagcagtgatggcagcctggctgaaaatggagtgatggccgaggagaagccagccccccagatgaatggcagcactggagatgcccgggcccccagccacagcgagagcgccctgaacaatgacagcaagacctgcaacaccaacccccacctgaatgccctgagcacagattctgcctgccggcgggaggccgccctggaggccgctgtgctgaacaaggaggagtag

SEQ ID NO: 19638 - DNA, 3441 bp, Artificial Sequence
  Description of Artificial Sequence: Synthetic coding sequence
atgggcgtgcagggcttccaggactacatcgagaagcactgccccagcgctgtggtgcctgtggagctgcagaagctggcccggggcagcctggtgggcggcggccggcagaggcctccccagacccccctgcggctgctggtggatgctgacaactgcctgcaccggctgtatggaggcttctacacagactgggtgtctgggggccagtggaaccacatgctgggctacctggccgccctggccaaggcctgcttcggcggcaacatcgagctgtttgtgttcttcaatggagccctggagaaggcccggctgcacgagtgggtgaagaggcagggcaatgaaaggcagacagcccagcagatcgtgagccacgtgcagaacaagggcaccccaccacccaaggtgtggttcctgccccctgtgtgcatggcccactgcatccggctggccctgatccgcttccacgtgaaggtggcccagagcattgaggaccaccaccaggaggtgattggcttctgccgggagaatggcttccacggcctggtggcctatgacagcgactatgccctgtgcaacatcccctactacttcagcgcccacgccctgaagctgagcagaaatggcaagagcctgaccaccagccagtacctgatgcatgaggtggccaagcagctggacctgaaccccaaccgcttccccatctttgctgccctgctgggcaaccacatcctgcctgatgaggacctggccagcttccactggagcctgctgggccctgagcaccccctggccagcctgaaggtgcgggcccaccagctggtgctgcccccctgtgatgtggtgatcaaggctgtggccgactatgtgaggaacatccaggacaccagtgacctggatgccatcgccaaggatgtgttccagcacagccagagcaggacagatgacaaggtgatccgcttcaagagggccatcggctactacagcgccaccagcaagcccatgtccttccaccccccccactacctggccgcccggcccggccccttcggcatgcctggcatggtgccccctcatgtgcccccccagatgctgaacatcccccagaccagcctgcaggccaagcctgtggccccccaggtgcccagccctgggggcgcccctggccagggcccctacccctacagcctgtctgagcccgcccccctgaccctggacaccagcggcaagaacctgacagagcagaacagctacagcaacatcccccatgagggcaagcacacccccctgtatgaaagaagcagccccatcaacccagcccagagcggcagccccaaccacgtggacagcgcctacttccctggcagcagcaccagcagcagcagtgacaatgatgagggcagcggcggggccaccaagcccttccagctgtacctgcagaagaactttgtgttccacaaggagaacagcatcgtgctgtgcagccgcatcctgcggcacggccacatcagcggcaacaagattggctgggagaagacaggcagccacagcgagccccaggcccggggggaccccggggaccagaccaaggccgagggcagcagcacagccagcagcggcagccagctggccgagggcaagggcagccagatgggcaccgtgcagcccatcccctgcctgctgtccatgcccaccaggaaccacatggacatcaccaccccacccctgccccctgtggcccctgaggtgctgcgggtggccgagcaccgccacaagaagggcctgatgtacccctacatcttccacgtgctgaccaagggggagatcaagattgctgtgtccattgaagatgaggccaacaaggacctgcccccagctgccctgctgtacagacctgtgcggcagtatgtgtatggagtgctcttcagcctggccgagagcaggaagaagacagagcggctggccttcaggaagaaccggctgcccccagagttcagccctgtgatcatcaaggagtgggccgcctacaagggcaagagcccccagaccccagagctggtggaggccctggccttccgggagtggacctgccccaacctgaagaggctgtggctgggcaaggctgtggaggacaagaacagaaggatgagggccttcctggcctgcatgagaagtgacaccccagccatgctgaacccagccaacgtgcccacccacctgatggtgctgtgctgcgtgctgcgctacatggtgcagtggccaggggcccgcatcctgcggcggcaggagctggatgccttcctggcccaggccctgagccccaagctgtatgagccagaccagctgcaggagctgaagattgagaacctggacccccggggcatccagctgagcgccctcttcatgtctggagtggacatggccctgtttgccaatgatgcctgtggccagcccatcccctgggagcactgctgcccctggatgtactttgatggcaagctgttccagagcaagctgctgaaggccagccgggagaagacccccctgattgacctgtgtgatggccaggccgaccaggccgccaaggtggagaagatgaggcagagcgtgctggagggcctgtccttcagccggcagagccacaccctgcccttccccccacctccagccctgcccttctacccagccagcgcctaccccaggcactttggacctgtgccccccagccagggccggggccggggctttgctggggtgtgtggctttggaggcccctacggggagaccgtggccaccggcccctaccgggccttccgggtggccgccgccagcggccactgtggggccttcagcggcagtgacagcagcaggaccagcaagagccagggcggcgtgcagcccatccccagccagggcggcaagctggagattgctggcaccgtggtgggccactgggccggcagcagaagaggccggggcggccggggccccttccccctgcaggtggtgtctgtgggcggccctgcccggggccggccccggggcgtcatcagcacccctgtgatccgcaccttcggccggggcggccgctactacggccggggctacaagaaccaggccgccatccagggccggcccccctatgctgccagcgctgaggaggtggccaaggagctgaagagcaagtctggagagagcaagagcagcgccatgagcagtgatggcagcctggctgaaaatggagtgatggccgaggagaagccagccccccagatgaatggcagcactggagatgcccgggcccccagccacagcgagagcgccctgaacaatgacagcaagacctgcaacaccaacccccacctgaatgccctgagcacagattctgcctgccggcgggaggccgccctggaggccgctgtgctgaacaaggaggagtag

SEQ ID NO: 19639 - DNA, 3219 bp, Artificial Sequence
  Description of Artificial Sequence: Synthetic coding sequence
atgggcgtgcagggcttccaggactacatcgagaagcactgccccagcgctgtggtgcctgtggagctgcagaagctggcccggggcagcctggtgggcggcggccggcagaggcctccccagacccccctgcggctgctggtggatgctgacaactgcctgcaccggctgtatggaggcttctacacagactgggtgtctgggggccagtggaaccacatgctgggctacctggccgccctggccaaggcctgcttcggcggcaacatcgagctgtttgtgttcttcaatggagccctggagaaggcccggctgcacgagtgggtgaagaggcagggcaatgaaaggcagacagcccagcagatcgtgagccacgtgcagaacaagggcaccccaccacccaaggtgtggttcctgccccctgtgtgcatggcccactgcatccggctggccctgatccgcttccacgtgaaggtggcccagagcattgaggaccaccaccaggaggtgattggcttctgccgggagaatggcttccacggcctggtggcctatgacagcgactatgccctgtgcaacatcccctactacttcagcgcccacgccctgaagctgagcagaaatggcaagagcctgaccaccagccagtacctgatgcatgaggtggccaagcagctggacctgaaccccaaccgcttccccatctttgctgccctgctgggcaaccacatcctgcctgatgaggacctggccagcttccactggagcctgctgggccctgagcaccccctggccagcctgaaggtgcgggcccaccagctggtgctgcccccctgtgatgtggtgatcaaggctgtggccgactatgtgaggaacatccaggacaccagtgacctggatgccatcgccaaggatgtgttccagcacagccagagcaggacagatgacaaggtgatccgcttcaagagggccatcggctactacagcgccaccagcaagcccatgtccttccaccccccccactacctggccgcccggcccggccccttcggcatgcctggcatggtgccccctcatgtgcccccccagatgctgaacatcccccagaccagcctgcaggccaagcctgtggccccccaggtgcccagccctgggggcgcccctggccagggcccctacccctacagcctgtctgagcccgcccccctgaccctggacaccagcggcaagaacctgacagagcagaacagctacagcaacatcccccatgagggcaagcacacccccctgtatgaaagaagcagccccatcaacccagcccagagcggcagccccaaccacgtggacagcgcctacttccctggcagcagcaccagcagcagcagtgacaatgatgagggcagcggcggggccaccaaccacatcagcggcaacaagattggctgggagaagacaggcagccacagcgagccccaggcccggggggaccccggggaccagaccaaggccgagggcagcagcacagccagcagcggcagccagctggccgagggcaagggcagccagatgggcaccgtgcagcccatcccctgcctgctgtccatgcccaccaggaaccacatggacatcaccaccccacccctgccccctgtggcccctgaggtgctgcgggtggccgagcaccgccacaagaagggcctgatgtacccctacatcttccacgtgctgaccaagggggagatcaagattgctgtgtccattgaagatgaggccaacaaggacctgcccccagctgccctgctgtacagacctgtgcggcagtatgtgtatggagtgctcttcagcctggccgagagcaggaagaagacagagcggctggccttcaggaagaaccggctgcccccagagttcagccctgtgatcatcaaggagtgggccgcctacaagggcaagagcccccagaccccagagctggtggaggccctggccttccgggagtggacctgccccaacctgaagaggctgtggctgggcaaggctgtggaggacaagaacagaaggatgagggccttcctggcctgcatgagaagtgacaccccagccatgctgaacccagccaacgtgcccacccacctgatggtgctgtgctgcgtgctgcgctacatggtgcagtggccaggggcccgcatcctgcggcggcaggagctggatgccttcctggcccaggccctgagccccaagctgtatgagccagaccagctgcaggagctgaagattgagaacctggacccccggggcatccagctgagcgccctcttcatgtctggagtggacatggccctgtttgccaatgatgcctgtggccagcccatcccctgggagcactgctgcccctggatgtactttgatggcaagctgttccagagcaagctgctgaaggccagccgggagaagacccccctgattgacctgtgtgatggccaggccgaccaggccgccaaggtggagaagatgaggcagagcgtgctggagggcctgtccttcagccggcagagccacaccctgcccttccccccacctccagccctgcccttctacccagccagcgcctaccccaggcactttggacctgtgccccccagccagggccggggccggggctttgctggggtgcagcccatccccagccagggcggcaagctggagattgctggcaccgtggtgggccactgggccggcagcagaagaggccggggcggccggggccccttccccctgcaggtggtgtctgtgggcggccctgcccggggccggccccggggcgtcatcagcacccctgtgatccgcaccttcggccggggcggccgctactacggccggggctacaagaaccaggccgccatccagggccggcccccctatgctgccagcgctgaggaggtggccaaggagctgaagagcaagtctggagagagcaagagcagcgccatgagcagtgatggcagcctggctgaaaatggagtgatggccgaggagaagccagccccccagatgaatggcagcactggagatgcccgggcccccagccacagcgagagcgccctgaacaatgacagcaagacctgcaacaccaacccccacctgaatgccctgagcacagattctgcctgccggcgggaggccgccctggaggccgctgtgctgaacaaggaggagtag

SEQ ID NO: 19640 - DNA, 1887 bp, Artificial Sequence
  Description of Artificial Sequence: Synthetic coding sequence
atgggcgtgcagggcttccaggactacatcgagaagcactgccccagcgctgtggtgcctgtggagctgcagaagctggcccggggcagcctggtgggcggcggccggcagaggcctccccagacccccctgcggctgctggtggatgctgacaactgcctgcaccggctgtatggaggcttctacacagactgggtgtctgggggccagtggaaccacatgctgggctacctggccgccctggccaaggcctgcttcggcggcaacatcgagctgtttgtgttcttcaatggagccctggagaaggcccggctgcacgagtgggtgaagaggcagggcaatgaaaggcagacagcccagcagatcgtgagccacgtgcagaacaagggcaccccaccacccaaggtgtggttcctgccccctgtgtgcatggcccactgcatccggctggccctgatccgcttccacgtgaaggtggcccagagcattgaggaccaccaccaggaggtgattggcttctgccgggagaatggcttccacggcctggtggcctatgacagcgactatgccctgtgcaacatcccctactacttcagcgcccacgccctgaagctgagcagaaatggcaagagcctgaccaccagccagtacctgatgcatgaggtggccaagcagctggacctgaaccccaaccgcttccccatctttgctgccctgctgggcaaccacatcctgcctgatgaggacctggccagcttccactggagcctgctgggccctgagcaccccctggccagcctgaaggtgcgggcccaccagctggtgctgcccccctgtgatgtggtgatcaaggctgtggccgactatgtgaggaacatccaggacaccagtgacctggatgccatcgccaaggatgtgttccagcacagccagagcaggacagatgacaaggtgatccgcttcaagagggccatcggctactacagcgccaccagcaagcccatgtccttccaccccccccactacctggccgcccggcccggccccttcggcatgcctggcatggtgccccctcatgtgcccccccagatgctgaacatcccccagaccagcctgcaggccaagcctgtggccccccaggtgcccagccctgggggcgcccctggccagggcccctacccctacagcctgtctgagcccgcccccctgaccctggacaccagcggcaagaacctgacagagcagaacagctacagcaacatcccccatgagggcaagcacacccccctgtatgaaagaagcagccccatcaacccagcccagagcggcagccccaaccacgtggacagcgcctacttccctggcagcagcaccagcagcagcagtgacaatgatgagggcagcggcggggccaccaaccacatcagcggcaacaagattggctgggagaagacaggcagccacagcgagccccaggcccggggggaccccggggaccagaccaaggccgagggcagcagcacagccagcagcggcagccagctggccgagggcaagggcagccagatgggcaccgtgcagcccatcccctgcctgctgtccatgcccaccaggaaccacatggacatcaccaccccacccctgccccctgtggcccctgaggtgctgcgggtggccgagcaccgccacaagaagggcctgatgtacccctacatcttccacgtgctgaccaaggtgctgagcaagggcccctggagcggcttctgctacctgatgagcggccacagctatggctgctttgtgctgctgtccttctttgagcccttcttctgcctgaccaacctgctggagaccaagttcaccttccccttcctgaacattgaatag

SEQ ID NO: 19641 - DNA, 1485 bp, Artificial Sequence
  Description of Artificial Sequence: Synthetic coding sequence
ggggagatcaagattgctgtgtccattgaagatgaggccaacaaggacctgcccccagctgccctgctgtacagacctgtgcggcagtatgtgtatggagtgctcttcagcctggccgagagcaggaagaagacagagcggctggccttcaggaagaaccggctgcccccagagttcagccctgtgatcatcaaggagtgggccgcctacaagggcaagagcccccagaccccagagctggtggaggccctggccttccgggagtggacctgccccaacctgaagaggctgtggctgggcaaggctgtggaggacaagaacagaaggatgagggccttcctggcctgcatgagaagtgacaccccagccatgctgaacccagccaacgtgcccacccacctgatggtgctgtgctgcgtgctgcgctacatggtgcagtggccaggggcccgcatcctgcggcggcaggagctggatgccttcctggcccaggccctgagccccaagctgtatgagccagaccagctgcaggagctgaagattgagaacctggacccccggggcatccagctgagcgccctcttcatgtctggagtggacatggccctgtttgccaatgatgcctgtggccagcccatcccctgggagcactgctgcccctggatgtactttgatggcaagctgttccagagcaagctgctgaaggccagccgggagaagacccccctgattgacctgtgtgatggccaggccgaccaggccgccaaggtggagaagatgaggcagagcgtgctggagggcctgtccttcagccggcagagccacaccctgcccttccccccacctccagccctgcccttctacccagccagcgcctaccccaggcactttggacctgtgccccccagccagggccggggccggggctttgctggggtgcagcccatccccagccagggcggcaagctggagattgctggcaccgtggtgggccactgggccggcagcagaagaggccggggcggccggggccccttccccctgcaggtggtgtctgtgggcggccctgcccggggccggccccggggcgtcatcagcacccctgtgatccgcaccttcggccggggcggccgctactacggccggggctacaagaaccaggccgccatccagggccggcccccctatgctgccagcgctgaggaggtggccaaggagctgaagagcaagtctggagagagcaagagcagcgccatgagcagtgatggcagcctggctgaaaatggagtgatggccgaggagaagccagccccccagatgaatggcagcactggagatgcccgggcccccagccacagcgagagcgccctgaacaatgacagcaagacctgcaacaccaacccccacctgaatgccctgagcacagattctgcctgccggcgggaggccgccctggaggccgctgtgctgaacaaggaggagtag

SEQ ID NO: 19642 - DNA, 1485 bp, Artificial Sequence
  Description of Artificial Sequence: Synthetic coding sequence
tgagtggcccagagcattgaggaccaccaccaggaggtgattggcttctgcagagaaaatggcttccacggcctggtggcctatgacagcgactatgccctgtgcaacatcccctactacttcagcgcccacgccctgaagctgagcagaaatggcaagagcctgaccaccagccagtacctgatgcatgaggtggccaagcagctggacctgaaccccaaccgcttccccatctttgctgccctgctgggcaaccacatcctgcctgatgaggacctggccagcttccactggagcctgctgggccctgagcaccccctggccagcctgaaggtgcgggcccaccagctggtgctgcccccctgtgatgtggtgatcaaggctgtggccgactatgtgaggaacatccaggacaccagtgacctggatgccatcgccaaggatgtgttccagcacagccagagcaggacagatgacaaggtgatccgcttcaagagggccatcggctactacagcgccaccagcaagcccatgtccttccaccccccccactacctggccgcccggcccggccccttcggcatgcctggcatggtgcccccccacgtgcccccccagatgctgaacatcccccagaccagcctgcaggccaagcctgtggccccccaggtgcccagccctggaggagcccctggccagggcccctacccctacagcctgtctgagcccgcccccctgaccctggacaccagcggcaagaacctgacagagcagaacagctacagcaacatcccccatgagggcaagcacacccccctgtatgaaagaagcagccccatcaacccagcccagagcggcagccccaaccacgtggacagcgcctacttccctggcagcagcaccagcagcagcagtgacaatgatgagggcagcggcggggccaccaaccacatcagcggcaacaagattggctgggagaagacaggcagccacagcgagccccaggcccggggggaccccggggaccagaccaaggccgagggcagcagcacagccagcagcggcagccagctggccgagggcaagggcagccagatgggcaccgtgcagcccatcccctgcctgctgtccatgcccaccaggaaccacatggacatcaccaccccacccctgccccctgtggcccctgaggtgctgcgggtggccgagcaccgccacaagaagggcctgatgtacccctacatcttccacgtgctgaccaagggggagatcaagattgctgtgtccattgaagatgaggccaacaaggacctgcccccagctgccctgctgtacagacctgtgcggcagtatgtgtatggagtgctcttcagcctggccgagagcaggaagaagacagagcggctggccttcaggaagaaccggctgcccccagagtgcatgtactgcaacaaccccctgtttgtgttcctgggcaccagctag

SEQ ID NO: 19643 - DNA, 969 bp, Artificial Sequence
  Description of Artificial Sequence: Synthetic coding sequence
atggtggccgacctggagctgcagcaggacctgattgtgcccctgggccacacccccagccaggagcacttcctgtttgagatcttcagaagaaggctgcaggccctgaccagcggctggagcgtggccgccagcctgcagaggcagcgggagctgctgatgtacaagaggatcctgctgcggctgcccagctctgtgctgtgtggcagcagcttccaggccgagcagcccatcacagcccgctgtgagcagttcttccacctggtgaacagcgagatgaggaacttctgcagccatggaggagccctgacccaggacatcacagcccacttcttccggggcctgctgaatgcctgcctgcggagccgggaccccagcctgatggtggacttcatcctggccaagtgccagaccaagtgccccctcatcctgaccagcgccctggtgtggtggcccagcctggagcctgtgctgctgtgccgctggaggaggcactgccagagccccctgccccgggagctgcagaagctgcaggagggccggcagtttgccagtgacttcctgagccctgaggccgccagccctgcccccaacccagactggctgtctgctgctgccctgcactttgccatccagcaggtgcgggaggagaacatcaggaagcagctgaagaagctggactgtgagcgggaggagctgctggtgttcctgttcttcttcagcctgatgggcctgctgagcagccacctgaccagcaacagcaccacagacctgcccaaggccttccacgtgtgtgccgccatcctggagtgcctggagaagaggaagatctcctggctggccctcttccagctgacagagagcggcaagaagcatgctgctgaggcccagatgagaagagctgccctcttccggggcatcctgcagatggtgaagaatgagcccagcctgcgcttcctggccaagtag

SEQ ID NO: 19644 - DNA, 4368 bp, Artificial Sequence
  Description of Artificial Sequence: Synthetic coding sequence
atgtctgacagctgggtgcccaacagcgccagcggccaggaccccggcggcagaagaagagcctgggccgagctgctggccggccgggtgaagcgggagaagtacaaccctgagcgggcccagaagctgaaggagagcgctgtgcggctgctgcggagccaccaggacctgaatgccctgctgctggaggtggagggccccctgtgcaagaagctgagcctgagcaaggtgattgactgtgacagcagcgaggcctatgccaaccacagcagcagcttcatcggcagcgccctgcaggaccaggccagccggctgggcgtgcctgtgggcatcctgtctgctggcatggtggccagctctgtgggccagatctgcacagccccagctgagaccagccaccctgtgctgctgactgtggagcagaggaagaagctgagcagcctgctggagtttgcccagtacctgctggcccacagcatgttcagccggctgtccttctgccaggagctgtggaagatccagagcagcctgctgctggaggccgtgtggcacctgcacgtgcagggcatcgtgtccctgcaggagctgctggagagccacccagacatgcatgctgtgggctcctggctgttcaggaacctgtgctgcctgtgtgagcagatggaggccagctgccagcacgcagatgtggcccgggccatgctgagtgactttgtgcagatgtttgtgctgcggggcttccagaagaacagcgacctgcggaggacagtggagcctgagaagatgccccaggtgacagtggatgtgctgcagaggatgctgatctttgccctggatgccctggccgccggcgtgcaggaggagagcagcacccacaagatcgtgcgctgctggtttggagtcttcagcggccacaccctgggcagcgtcatcagcacagaccccctgaagcgcttcttcagccacaccctgacccagatcctgacccacagccctgtgctgaaggccagtgatgctgtgcagatgcagcgggagtggagctttgcccggacccaccccctgctgaccagcctgtaccgccgcctgtttgtgatgctgtctgctgaggagctggtgggccacctgcaggaggtgctggagacccaggaggtgcactggcagagggtgctgagctttgtgtctgccctggtggtgtgcttccctgaggcccagcagctgctggaggactgggtggcccggctgatggcccaggcctttgagagctgccagctggacagcatggtgacagccttcctggtggtgcggcaggccgccctggagggccccagcgccttcctgtcctatgctgactggttcaaggccagctttggcagcacccggggctaccacggctgcagcaagaaggccctggtgttcctgttcaccttcctgtctgagctggtgccctttgagagcccccgctacctgcaggtgcacatcctgcacccccccctggtgcctgggaagtaccgcagcctgctgacagactacatcagcctggccaagacccggctggccgacctgaaggtgtccattgagaacatgggcctgtatgaggacctgagcagcgctggggacatcacagagccccacagccaggccctgcaggatgtggagaaggccatcatggtgtttgagcacactggaaacatccctgtgacagtgatggaggccagcatcttcagaagaccctactacgtgagccacttcctgcctgccctgctgaccccccgggtgctgcccaaggtgcctgacagccgggtggccttcatcgagagcctgaagagagctgacaagatcccccccagcctgtacagcacctactgccaggcctgcagcgctgctgaggagaagccagaagatgctgccctgggcgtgcgggcagagcccaacagcgctgaggagcccctgggccagctgacagctgccctgggggagctgcgggcctccatgacagaccccagccagagagatgtgatcagcgcccaggtggccgtcatcagcgagcggctgcgggctgtgctgggccacaatgaagatgacagctctgtggagatcagcaagatccagctgagcatcaacaccccccggctggagccccgggagcacatggctgtggacctgctgctgaccagcttctgccagaacctgatggccgccagctctgtggcccctcctgagcggcagggcccctgggccgccctgtttgtgaggaccatgtgtggccgggtgctgcctgctgtgctgacccggctgtgccagctgctgcggcaccagggccccagcctgagcgccccccacgtgctgggcctggccgccctggccgtgcacctgggggagagccgcagcgccctgcctgaggtggatgtgggccccccagcccctggggccggcctgcctgtgcctgccctgtttgacagcctgctgacctgcaggacccgggacagcctcttcttctgcctgaagttctgcacagctgccatctcctacagcctgtgcaagttcagcagccagagccgggacaccctgtgcagctgcctgagccctggcctcatcaagaagttccagttcctgatgttccgcctcttcagcgaggcccggcagcccctgtctgaggaggatgtggccagcctgtcctggaggcccctgcacctgcccagcgctgactggcagagagctgccctgagcctgtggacccacaggaccttccgggaggtgctgaaggaggaggatgtgcacctgacctaccaggactggctgcacctggagctggagatccagcctgaggctgatgccctgagtgacacagagcggcaggacttccaccagtgggccatccacgagcacttcctgcctgagagcagcgccagcggcggctgtgatggagacctgcaggccgcctgcaccatcctggtgaatgccctgatggacttccaccagagcagccgctcctatgaccacagcgagaacagcgacctggtgtttggaggccgcactggaaatgaagacatcatcagccggctgcaggagatggtggccgacctggagctgcagcaggacctgattgtgcccctgggccacacccccagccaggagcacttcctgtttgagatcttcagaagaaggctgcaggccctgaccagcggctggagcgtggccgccagcctgcagaggcagcgggagctgctgatgtacaagaggatcctgctgcggctgcccagctctgtgctgtgtggcagcagcttccaggccgagcagcccatcacagcccgctgtgagcagttcttccacctggtgaacagcgagatgaggaacttctgcagccacggcggggccctgacccaggacatcacagcccacttcttccggggcctgctgaatgcctgcctgcggagccgggaccccagcctgatggtggacttcatcctggccaagtgccagaccaagtgccccctcatcctgaccagcgccctggtgtggtggcccagcctggagcctgtgctgctgtgccgctggaggaggcactgccagagccccctgccccgggagctgcagaagctgcaggagggccggcagtttgccagtgacttcctgagccctgaggccgccagccctgcccccaacccagactggctgtctgctgctgccctgcactttgccatccagcaggtgcgggaggagaacatcaggaagcagctgaagaagctggactgtgagcgggaggagctgctggtgttcctgttcttcttcagcctgatgggcctgctgagcagccacctgaccagcaacagcaccacagacctgcccaaggccttccacgtgtgtgccgccatcctggagtgcctggagaagaggaagatctcctggctggccctcttccagctgacagaaagtgacctgcggctgggccgcctgctgctgcgggtggccccagaccagcacacccggctgctgccctttgccttctacagcctgctgagctacttccatgaagatgctgccatccgggaggaggccttcctgcacgtggccgtggacatgtacctgaagctggtgcagctgtttgtggccggggacaccagcacagtgagccccccagctggccgcagcctggagctgaagggccagggcaaccctgtggagctgatcaccaaggcccggctcttcctgctgcagctgatcccccgctgccccaagaagagcttcagccacgtggccgagctgctggccgacagaggagactgtgaccctgaggtgtctgctgccctgcagagccggcagcaggccgccccagatgctgacctgagccaggagccccacctgttctag

SEQ ID NO: 19645 - DNA, 894 bp, Artificial Sequence
  Description of Artificial Sequence: Synthetic coding sequence
atgtctgacagctgggtgcccaacagcgccagcggccaggaccccggcggcagaagaagagcctgggccgagctgctggccggccgggtgaagcgggagaagtacaaccctgagcgggcccagaagctgaaggagagcgctgtgcggctgctgcggagccaccaggacctgaatgccctgctgctggaggtggagggccccctgtgcaagaagctgagcctgagcaaggtgattgactgtgacagcagcgaggcctatgccaaccacagcagcagcttcatcggcagcgccctgcaggaccaggccagccggctgggcgtgcctgtgggcatcctgtctgctggcatggtggccagctctgtgggccagatctgcacagccccagctgagaccagccaccctgtgctgctgactgtggagcagaggaagaagctgagcagcctgctggagtttgcccagtacctgctggcccacagcatgttcagccggctgtccttctgccaggagctgtggaagatccagagcagcctgctgctggaggccgtgtggcacctgcacgtgcagggcatcgtgtccctgcaggagctgctggagagccacccagacatgcatgctgtgggctcctggctgttcaggaacctgtgctgcctgtgtgagcagatggaggccagctgccagcacgcagatgtggcccgggccatgctgagtgactttgtgcagatgtttgtgctgcggggcttccagaagaacagcgacctgcggaggacagtggagcctgagaagatgccccaggtgacagtggatgtgctgcagaggatgctgatctttgccctggatgccctggccgccggcgtgcaggaggagagcagcacccacaagatcgtgcgctgctag

SEQ ID NO: 19646 - DNA, 909 bp, Artificial Sequence
  Description of Artificial Sequence: Synthetic coding sequence
atgtctgacagctgggtgcccaacagcgccagcggccaggaccccggcggcagaagaagagcctgggccgagctgctggccggccgggtgaagcgggagaagtacaaccctgagcgggcccagaagctgaaggagagcgctgtgcggctgctgcggagccaccaggacctgaatgccctgctgctggaggtggagggccccctgtgcaagaagctgagcctgagcaaggtgattgactgtgacagcagcgaggcctatgccaaccacagcagcagcttcatcggcagcgccctgcaggaccaggccagccggctgggcgtgcctgtgggcatcctgtctgctggcatggtggccagctctgtgggccagatctgcacagccccagctgagaccagccaccctgtgctgctgactgtggagcagaggaagaagctgagcagcctgctggagtttgcccagtacctgctggcccacagcatgttcagccggctgtccttctgccaggagctgtggaagatccagagcagcctgctgctggaggccgtgtggcacctgcacgtgcagggcatcgtgtccctgcaggagctgctggagagccacccagacatgcatgctgtgggctcctggctgttcaggaacctgtgctgcctgtgtgagcagatggaggccagctgccagcacgcagatgtggcccgggccatgctgagtgactttgtgcagatgtttgtgctgcggggcttccagaagaacagcgacctgcggaggacagtggagcctgagaagatgccccaggtgacagtggatgtgctgcagaggatgctgatctttgccctggatgccctggccgccggcgtgcaggaggagagcagcacccacaagatcgtgcgggccagcgctgcccggagctag

SEQ ID NO: 19647 - DNA, 798 bp, Artificial Sequence
  Description of Artificial Sequence: Synthetic coding sequence
atgtctgacagctgggtgcccaacagcgccagcggccaggaccccggcggcagaagaagagcctgggccgagctgctggccggccgggtgaagcgggagaagtacaaccctgagcgggcccagaagctgaaggagagcgctgtgcggctgctgcggagccaccaggacctgaatgccctgctgctggaggtggagggccccctgtgcaagaagctgagcctgagcaaggtgattgactgtgacagcagcgaggcctatgccaaccacagcagcagcttcatcggcagcgccctgcaggaccaggccagccggctgggcgtgcctgtgggcatcctgtctgctggcatggtggccagctctgtgggccagatctgcacagccccagctgagaccagccaccctgtgctgctgactgtggagcagaggagcagcctgctgctggaggccgtgtggcacctgcacgtgcagggcatcgtgtccctgcaggagctgctggagagccacccagacatgcatgctgtgggctcctggctgttcaggaacctgtgctgcctgtgtgagcagatggaggccagctgccagcacgcagatgtggcccgggccatgctgagtgactttgtgcagatgtttgtgctgcggggcttccagaagaacagcgacctgcggaggacagtggagcctgagaagatgccccaggtgacagtggatgtgctgcagaggatgctgatctttgccctggatgccctggccgccggcgtgcaggaggagagcagcacccacaagatcgtgcgctgctag

SEQ ID NO: 19648 - DNA, 1869 bp, Artificial Sequence
  Description of Artificial Sequence: Synthetic coding sequence
atgagccggcagaccacctctgtgggcagcagctgcctggacctgtggagggagaagaatgaccggctggtgcggcaggccaaggtggcccagaacagcggcctgaccctgcggcggcagcagctggcccaggatgccctggagggcctgcggggcctgctgcacagcctgcagggcctgcctgctgctgtgcctgtgctgcccctggagctgactgtgacctgcaacttcatcatcctgcgggccagcctggcccagggcttcacagaggaccaggcccaggacatccagaggagcctggagcgggtgctggagacccaggagcagcagggcccccggctggagcagggcctgcgggagctgtgggacagcgtgctgcgggccagctgcctgctgcctgagctgctgagcgccctgcaccggctggtgggcctgcaggccgccctgtggctgtctgctgaccggctgggggacctggccctgctgctggagaccctgaatggcagccagagcggggccagcaaggacctgctgctgctgctgaagacctggagccccccagctgaggagctggatgcccccctgaccctgcaggatgcccagggcctgaaggatgtgctgctgacagcctttgcctaccggcagggcctgcaggagctgatcaccggcaacccagacaaggccctgagcagcctgcatgaagctgccagcggcctgtgccccaggcctgtgctggtgcaggtgtacacagccctgggcagctgccacaggaagatgggcaacccccagagggccctgctgtacctggtggccgccctgaaggagggcagcgcctggggcccccccctgctggaggccagccggctgtaccagcagctgggggacaccacagctgagctggagagcctggagctgctggtggaggccctgaatgtgccctgcagcagcaaggccccccagttcctgattgaggtggagctgctgctgcccccaccagacctggccagccccctgcactgcggcacccagagccagaccaagcacatcctggccagccgctgcctgcagacaggccgggctggagatgctgctgagcactacctggacctgctggccctgctgctggacagcagcgagccccgcttcagccccccacccagccccccaggcccctgcatgcctgaggtgttcctggaggccgctgtggccctgatccaggccggccgggcccaggatgccctgaccctgtgtgaggagctgctgagcaggaccagcagcctgctgcccaagatgagccggctgtgggaggatgccaggaagggcaccaaggagctgccctactgccccctgtgggtgtctgccacccacctgctgcagggccaggcctgggtgcagctgggcgcccagaaggtggccatcagcgagttcagccgctgcctggagctgctcttccgggccaccccagaggagaaggagcagggcgccgccttcaactgtgagcagggctgcaagagtgatgctgccctgcagcagctgcgggctgctgccctgatcagccggggcctggagtgggtggccagcggccaggacaccaaggccctgcaggacttcctgctgtctgtgcagatgtgccccggcaacagagacacctacttccacctgctgcagaccctgaagaggctggacagaagagatgaggccacagccctgtggtggaggctggaggcccagaccaagggcagccatgaagatgccctgtggagcctgcccctgtacctggagagctacctgtcctggatccggcccagcgacagagatgccttcctggaggagttccgcaccagcctgcccaagagctgtgacctgtag

SEQ ID NO: 19649 - DNA, 648 bp, Artificial Sequence
  Description of Artificial Sequence: Synthetic coding sequence
atgagccggcagaccacctctgtgggcagcagctgcctggacctgtggagggagaagaatgaccggctggtgcggcaggccaaggtggcccagaacagcggcctgaccctgcggcggcagcagctggcccaggatgccctggagggcctgcggggcctgctgcacagcctgcagggcctgcctgctgctgtgcctgtgctgcccctggagctgactgtgacctgcaacttcatcatcctgcgggccagcctggcccagggcttcacagaggaccaggcccaggacatccagaggagcctggagcgggtgctggagacccaggagcagcagggcccccggctggagcagggcctgcgggagctgtgggacagcgtgctgcgggccagctgcctgctgcctgagctgctgagcgccctgcaccggctggtgggcctgcaggccgccctgtggctgtctgctgaccggctgggggacctggccctgctgctggagaccctgaatggcagccagagcggggccagcaaggacctgctgctgctgctgaagacctggagccccccagctgaggagctggatgcccccctgaccctgcaggatgcccagggcctgaaggatgtgctgctgacagcctttgcctaccggcagtag

SEQ ID NO: 19650 - DNA, 1347 bp, Artificial Sequence
  Description of Artificial Sequence: Synthetic coding sequence
atgagccggcagaccacctctgtgggcagcagctgcctggacctgtggagggagaagaatgaccggctggtgcggcaggccaaggtggcccagaacagcggcctgaccctgcggcggcagcagctggcccaggatgccctggagggcctgcggggcctgctgcacagcctgcagggcctgcctgctgctgtgcctgtgctgcccctggagctgactgtgacctgcaacttcatcatcctgcgggccagcctggcccagggcttcacagaggaccaggcccaggacatccagaggagcctggagcgggtgctggagacccaggagcagcagggcccccggctggagcagggcctgcgggagctgtgggacagcgtgctgcgggccagctgcctgctgcctgagctgctgagcgccctgcaccggctggtgggcctgcaggccgccctgtggctgtctgctgaccggctgggggacctggccctgctgctggagaccctgaatggcagccagagcggggccagcaaggacctgctgctgctgctgaagacctggagccccccagctgaggagctggatgcccccctgaccctgcaggatgcccagggcctgaaggatgtgctgctgacagcctttgcctaccggcagggcctgcaggagctgatcaccggcaacccagacaaggccctgagcagcctgcatgaagctgccagcggcctgtgccccaggcctgtgctggtgcaggtgtacacagccctgggcagctgccacaggaagatgggcaacccccagagggccctgctgtacctggtggccgccctgaaggagggcagcgcctggggcccccccctgctggaggccagccggctgtaccagcagctgggggacaccacagctgagctggagagcctggagctgctggtggaggccctgaatgtgccctgcagcagcaaggccccccagttcctgattgaggtggagctgctgctgcccccaccagacctggccagccccctgcactgcggcacccagagccagaccaagcacatcctggccagccgctgcctgcagacaggccgggctggagatgctgctgagcactacctggacctgctggccctgctgctggacagcagcgagccccgcttcagccccccacccagccccccaggcccctgcatgcctgaggtgttcctggaggccgctgtggccctgatccaggccggccgggcccaggatgccctgaccctgtgtgaggagctgctgagcaggaccagcagcctgctgcccaagatgagccggctgtgggaggatgccaggaagaggacccggggcagcttccagctgtag

SEQ ID NO: 19651 - DNA, 663 bp, Artificial Sequence
  Description of Artificial Sequence: Synthetic coding sequence
atgctgggcatctggaccctgctgcccctggtgctgacctctgtggcccggctgagcagcaagtctgtgaatgcccaggtgacagacatcaacagcaagggcctggagctgaggaagacagtgaccaccgtggagacccagaacctggagggcctgcaccatgatggccagttctgccacaagccctgccccccaggagagaggaaggcccgggactgcaccgtgaatggagatgagccagactgtgtgccctgccaggagggcaaggagtacacagacaaggcccacttcagcagcaagtgccgccgctgccgcctgtgtgatgagggccacggcctggaggtggagatcaactgcaccaggacccagaacaccaagtgccgctgcaagcccaacttcttctgcaacagcacagtgtgtgagcactgtgacccctgcaccaagtgtgaacatggcatcatcaaggagtgcaccctgaccagcaacaccaagtgcaaggaggagggcagccgcagcaacctgggctggctgtgcctgctgctgctgcccatccccctgattgtgtgggtgaagaggaaggaggtgcagaagacctgcaggaagcacaggaaagaaaaccagggcagccatgagagccccaccctgaaccccatgctgacctag

SEQ ID NO: 19652 - DNA, 1008 bp, Artificial Sequence
  Description of Artificial Sequence: Synthetic coding sequence
atgctgggcatctggaccctgctgcccctggtgctgacctctgtggcccggctgagcagcaagtctgtgaatgcccaggtgacagacatcaacagcaagggcctggagctgaggaagacagtgaccaccgtggagacccagaacctggagggcctgcaccatgatggccagttctgccacaagccctgccccccaggagagaggaaggcccgggactgcaccgtgaatggagatgagccagactgtgtgccctgccaggagggcaaggagtacacagacaaggcccacttcagcagcaagtgccgccgctgccgcctgtgtgatgagggccacggcctggaggtggagatcaactgcaccaggacccagaacaccaagtgccgctgcaagcccaacttcttctgcaacagcacagtgtgtgagcactgtgacccctgcaccaagtgtgaacatggcatcatcaaggagtgcaccctgaccagcaacaccaagtgcaaggaggagggcagccgcagcaacctgggctggctgtgcctgctgctgctgcccatccccctgattgtgtgggtgaagaggaaggaggtgcagaagacctgcaggaagcacaggaaagaaaaccagggcagccatgagagccccaccctgaaccctgagaccgtggccatcaacctgagtgatgtggacctgagcaagtacatcaccaccatcgccggcgtgatgaccctgagccaggtgaagggctttgtgaggaagaatggagtgaatgaggccaagattgatgagatcaagaatgacaacgtgcaggacacagctgagcagaaggtgcagctgctgaggaactggcaccagctgcacggcaagaaggaggcctatgacaccctcatcaaggacctgaagaaggccaacctgtgcaccctggccgagaagatccagaccatcatcctgaaggacatcaccagtgacagcgagaacagcaacttcagaaatgagatccagagcctggtgtag

SEQ ID NO: 19653 - DNA, 945 bp, Artificial Sequence
  Description of Artificial Sequence: Synthetic coding sequence
atgctgggcatctggaccctgctgcccctggtgctgacctctgtggcccggctgagcagcaagtctgtgaatgcccaggtgacagacatcaacagcaagggcctggagctgaggaagacagtgaccaccgtggagacccagaacctggagggcctgcaccatgatggccagttctgccacaagccctgccccccaggagagaggaaggcccgggactgcaccgtgaatggagatgagccagactgtgtgccctgccaggagggcaaggagtacacagacaaggcccacttcagcagcaagtgccgccgctgccgcctgtgtgatgagggccacggcctggaggtggagatcaactgcaccaggacccagaacaccaagtgccgctgcaagcccaacttcttctgcaacagcacagtgtgtgagcactgtgacccctgcaccaagtgtgaacatggcatcatcaaggagtgcaccctgaccagcaacaccaagtgcaaggaggaggtgaagaggaaggaggtgcagaagacctgcaggaagcacaggaaggagaaccagggcagccatgagagccccaccctgaaccctgagaccgtggccatcaacctgagtgatgtggacctgagcaagtacatcaccaccatcgccggcgtgatgaccctgagccaggtgaagggctttgtgaggaagaatggagtgaatgaggccaagattgatgagatcaagaatgacaacgtgcaggacacagctgagcagaaggtgcagctgctgaggaactggcaccagctgcacggcaagaaggaggcctatgacaccctcatcaaggacctgaagaaggccaacctgtgcaccctggccgagaagatccagaccatcatcctgaaggacatcaccagtgacagcgagaacagcaacttcagaaatgagatccagagcctggtgtag

SEQ ID NO: 19654 - DNA, 735 bp, Artificial Sequence
  Description of Artificial Sequence: Synthetic coding sequence
atgctgggcatctggaccctgctgcccctggtgctgacctctgtggcccggctgagcagcaagtctgtgaatgcccaggtgacagacatcaacagcaagggcctggagctgaggaagacagtgaccaccgtggagacccagaacctggagggcctgcaccatgatggccagttctgccacaagccctgccccccaggagagaggaaggcccgggactgcaccgtgaatggagatgagccagactgtgtgccctgccaggagggcaaggagtacacagacaaggcccacttcagcagcaagtgccgccgctgccgcctgtgtgatgagggccacggcctggaggtggagatcaactgcaccaggacccagaacaccaagtgccgctgcaagcccaacttcttctgcaacagcacagtgtgtgagcactgtgacccctgcaccaagtgtgaacatggcatcatcaaggagtgcaccctgaccagcaacaccaagtgcaaggaggagggcagccgcagcaacctgggctggctgtgcctgctgctgctgcccatccccctgattgtgtgggtgaagaggaaggaggtgcagaagacctgcaggaagcacaggaaagaaaaccagggcagccatgagagccccaccctgaaccctgagaccgtggccatcaacctgagtgatgtggacctgagcaagtaccaccactactgctggagccatgacaccaagagcagctag

SEQ ID NO: 19655 - DNA, 1089 bp, Artificial Sequence
  Description of Artificial Sequence: Synthetic coding sequence
atgctgcgggtgtgtgcccagggctggcacgcccagggcctgccccacggcaccaacagcctgctgaagggcggcacagagaccagcctgagcacccccacccggctggtggtgctgacctctgtggcccggctgagcagcaagtctgtgaatgcccaggtgacagacatcaacagcaagggcctggagctgaggaagacagtgaccaccgtggagacccagaacctggagggcctgcaccatgatggccagttctgccacaagccctgccccccaggagagaggaaggcccgggactgcaccgtgaatggagatgagccagactgtgtgccctgccaggagggcaaggagtacacagacaaggcccacttcagcagcaaatgtcgccgctgccgcctgtgtgatgagggccacggcctggaggtggagatcaactgcaccaggacccagaacaccaagtgccgctgcaagcccaacttcttctgcaacagcacagtgtgtgagcactgtgacccctgcaccaagtgtgagcacggcatcatcaaggaatgtaccctgaccagcaacaccaagtgcaaggaggagggcagccgcagcaacctgggctggctgtgcctgctgctgctgcccatccccctcatcgtgtgggtgaagaggaaggaggtgcagaagacctgcaggaagcacaggaaggagaaccagggcagccatgagagccccaccctgaaccctgtgggcattgaaattgacttcagtgatgtggacctgagcaagtacatcaccaccatcgccggcgtgatgaccctgagccaggtgaagggctttgtgaggaagaatggagtgaatgaggccaagattgatgagatcaagaatgacaacgtgcaggacacagctgagcagaaggtgcagctgctgaggaactggcaccagctgcacggcaagaaggaggcctatgacaccctcatcaaggacctgaagaaggccaacctgtgcaccctggccgagaagatccagaccatcatcctgaaggacatcaccagtgacagcgagaacagcaacttcagaaatgagatccagagcctggtgtag

SEQ ID NO: 19656 - DNA, 627 bp, Artificial Sequence
  Description of Artificial Sequence: Synthetic coding sequence
atggaccccttcctggtgctgctgcacagcgtgagcagcagcctgagcagcagcgagctgacagagctgaagttcctgtgcctgggccgggtgggcaagaggaagctggagcgggtgcagagcggcctggacctcttctccatgctgctggagcagaatgacctggagcccggccacacagagctgctgcgggagctgctggccagcctgcggagacatgacctgctgcggcgggtggatgactttgaggccggggctgctgctggggccgcccctggagaggaggacctgtgtgccgccttcaacgtcatctgtgacaacgtgggcaaggactggaggcggctggcccggcagctgaaggtgtctgacaccaagattgacagcattgaggaccgctaccccaggaacctgacagagcgggtgcgggagagcctgcgcatctggaagaacacagagaaggaaaatgccaccgtggcccacctggtgggcgccctgcggagctgccagatgaacctggtggccgacctggtgcaggaggtgcagcaggcccgggacctgcagaacagaagtggggccatgagccccatgtcctggaacagtgatgccagcaccagcgaggccagctag

SEQ ID NO: 19657 - DNA, 384 bp, Artificial Sequence
  Description of Artificial Sequence: Synthetic coding sequence
atgcagcagcccttcaactacccctacccccagatctactgggtggacagcagcgccagcagcccctgggcccctcctggcaccgtgctgccctgccccacctctgtgccccggcggcccggccagaggaggcctcctcctcctcctcctcctccacccctgcccccacctcctcctcctccacccctgccccccctgcccctgccccccctgaagaagaggggcaaccacagcacaggcctgtgcctgctggtgatgttcttcatggtgctggtggccctggtgggcctgggcctgggcatgttccagctgttccacctgcagaaggagctggccgagctgcgggaggccacccctgtgcaccccctgaagaagaggagctag

SEQ ID NO: 19658 - DNA, 846 bp, Artificial Sequence
  Description of Artificial Sequence: Synthetic coding sequence
atgcagcagcccttcaactacccctacccccagatctactgggtggacagcagcgccagcagcccctgggcccctcctggcaccgtgctgccctgccccacctctgtgccccggcggcccggccagaggaggcctcctcctcctcctcctcctccacccctgcccccacctcctcctcctccacccctgccccccctgcccctgccccccctgaagaagaggggcaaccacagcacaggcctgtgcctgctggtgatgttcttcatggtgctggtggccctggtgggcctgggcctgggcatgttccagctgttccacctgcagaaggagctggccgagctgcgggagagcaccagccagatgcacacagccagcagcctggagaagcagatcggccaccccagccccccacctgagaagaaggagctgaggaaggtggcccacctgaccgggaagagcaacagccgctccatgcccctggagtgggaggacacctacggcatcgtgctgctgagcggcgtgaagtacaagaagggcggcctggtgatcaatgagaccggcctgtactttgtgtacagcaaggtgtacttccggggccagagctgcaacaacctgcccctgagccacaaggtgtacatgaggaacagcaagtacccccaggacctggtgatgatggagggcaagatgatgagctactgcaccaccggccagatgtgggcccggagcagctacctgggcgctgtgttcaacctgaccagcgctgaccacctgtatgtgaatgtgtctgagctgagcctggtgaactttgaggagagccagaccttcttcggcctgtacaagctgtag

SEQ ID NO: 19659 - DNA, 13773 bp, Artificial Sequence
  Description of Artificial Sequence: Synthetic coding sequence
atgggccgccacctggccctgctgctgctgctgctgctgctcttccagcactttggagacagtgatggcagccagaggctggagcagacccccctgcagttcacccacctggagtacaacgtgacagtgcaggagaacagcgctgccaagacctacgtgggccaccctgtgaagatgggcgtgtacatcacccacccagcctgggaggtgcgctacaagatcgtgtctggggacagcgagaacctcttcaaggccgaggagtacatcctgggggacttctgcttcctgcgcatccgcaccaagggcggcaacacagccatcctgaaccgggaggtgaaggaccactacaccctgattgtgaaggccctggagaagaacaccaacgtggaggcccggaccaaggtgcgggtgcaggtgctggacaccaatgacctgcggcccctcttcagccccaccagctacagcgtgtccctgcctgagaacacagccatccgcaccagcatcgcccgggtgtctgccacagatgctgacatcggcaccaatggagagttctactacagcttcaaggacagaacagacatgtttgccatccaccccaccagcggggtcatcgtgctgaccggccgcctggactacctggagaccaagctgtatgagatggagatcctggccgctgaccggggcatgaagctgtatggcagcagcggcatcagctccatggccaagctgactgtgcacatcgagcaggccaatgaatgtgcccctgtgatcacagctgtgaccctgagccccagcgagctggaccgggaccctgcctatgccatcgtgacagtggatgactgtgaccagggcgccaacggggacatcgccagcctgagcatcgtggccggggacctgctgcagcagttcagaacagtgcgctccttccctggcagcaaggagtacaaggtgaaggccatcggcggcatcgactgggacagccaccccttcggctacaacctgaccctgcaggccaaggacaagggcaccccaccccagttcagctctgtgaaggtgatccacgtgaccagcccccagttcaaggccggccctgtgaagtttgagaaggatgtgtacagagctgagatcagcgagtttgccccacccaacacccctgtggtgatggtgaaggccatcccagcctacagccacctgcgctacgtgttcaagagcacccctgggaaggccaagttcagcctgaactacaacacaggcctcatcagcatcctggagcctgtgaagaggcagcaggccgcccactttgagctggaggtgaccaccagtgacaggaaggccagcaccaaggtgctggtgaaggtgctgggcgccaacagcaaccccccagagttcacccagacagcctacaaggccgcctttgatgaaaatgtgcccatcggcaccaccgtgatgagcctgtctgctgtggaccctgatgaaggagaaaatggctacgtgacctacagcatcgccaacctgaaccacgtgccctttgccatcgaccacttcaccggggctgtgtccaccagcgagaacctggactatgagctgatgccccgggtgtacaccctgcgcatccgggccagtgactggggcctgccctaccgccgggaggtggaggtgctggccaccatcaccctgaacaacctgaatgacaacacccccctgtttgagaagatcaactgtgagggcaccatcccccgggacctgggcgtgggggagcagatcaccaccgtgtctgccattgatgctgatgagctgcagctggtgcagtaccagatcgaggccggaaatgagctggacttcttcagcctgaaccccaacagcggcgtgctgagcctgaagaggagcctgatggatggcctgggcgccaaggtgtccttccacagcctgcgcatcacagccacagatggagaaaattttgccacccccctgtacatcaacatcaccgtggccgccagccacaagctggtgaacctgcagtgtgaggagactggagtggccaagatgctggccgagaagctgctgcaggccaacaagctgcacaaccagggcgaggtggaggacatcttctttgacagccacagcgtgaatgcccacatcccccagttccgcagcaccctgcccaccggcatccaggtgaaggagaaccagcctgtgggcagcagcgtcatcttcatgaacagcacagacctggacaccggcttcaacgggaagctggtgtatgctgtgtctggaggaaatgaagacagctgcttcatgattgacatggagaccggcatgctgaagatcctgagccccctggaccgggagaccacagacaagtacaccctgaacatcaccgtgtatgacctgggcatcccccagaaggccgcctggaggctgctgcacgtggtggtggtggatgccaatgacaaccccccagagttcctgcaggagagctactttgtggaggtgtctgaggacaaggaggtgcacagcgagatcatccaggtggaggccacagacaaggacctgggccccaacggccacgtgacctacagcatcgtgacagacacagacaccttcagcattgacagcgtgactggagtggtgaacatcgcccggcccctggaccgggagctgcagcacgagcacagcctgaagattgaggcccgggaccaggcccgggaggagccccagctgttcagcacagtggtggtgaaggtgtccctggaggatgtgaatgacaacccccccaccttcatcccccccaactacagagtgaaggtgcgggaggacctgcctgagggcaccgtcatcatgtggctggaggcccatgaccctgacctgggccagagcggccaggtgcgctacagcctgctggaccatggagagggcaactttgatgtggacaagctgagcggggctgtgagaattgtgcagcagctggactttgagaagaagcaggtgtacaacctgactgtgcgggccaaggacaagggcaagcctgtgtccctgagcagcacctgctacgtggaggtggaggtggtggatgtgaatgaaaacctgcacccccctgtgttcagcagctttgtggagaagggcaccgtgaaggaggatgcccctgtgggcagcctggtgatgacagtgtctgcccatgatgaagatgccaggagagatggagagatccgctacagcatcagagatggcagcggcgtgggcgtcttcaagatcggggaggagaccggggtgattgagaccagtgaccggctggaccgggagagcaccagccactactggctgactgtgtttgccacagaccagggcgtggtgcccctgagcagcttcatcgagatctacatcgaggtggaggatgtgaatgacaatgccccccagaccagcgagcctgtgtactacccagagatcatggagaacagccccaaggatgtgtctgtggtgcagatcgaggcctttgatcctgacagcagcagcaatgacaagctgatgtacaagatcaccagcggcaacccccagggcttcttcagcatccaccccaagacaggcctcatcaccaccaccagcaggaagctggaccgggagcagcaggatgagcacatcctggaggtgacagtgacagacaatggcagcccccccaagagcaccatcgcccgggtcatcgtgaagatcctggatgaaaatgacaacaagccccagttcctgcagaagttctacaagatccggctgcctgagcgggagaagccagaccgggagagaaatgcccggcgggagcccctgtaccacgtgattgccacagacaaggatgagggccccaatgctgagatctcctacagcattgaagatggaaatgaacatggcaagttcttcatcgagcccaagacaggagtggtgagcagcaagcgcttctctgctgctggggagtatgacatcctgagcatcaaggctgtggacaatggccggccccagaagagcagcaccacccggctgcacatcgagtggatcagcaagcccaagcccagcctggagcccatcagctttgaggagagcttcttcaccttcaccgtgatggagagtgaccctgtggcccacatgattggagtcatctctgtggagcccccaggcatccccctgtggtttgacatcaccggcggcaactatgacagccactttgatgtggacaagggcaccggcaccatcatcgtggccaagcccctggatgctgagcagaagagcaactacaacctgactgtggaggccacagatggcaccaccaccatcctgacccaggtgttcatcaaggtgattgacaccaatgaccaccggccccagttcagcaccagcaaatatgaggtggtgattcctgaggacacagcccctgagacagagatcctgcagatctctgctgtggaccaggatgagaagaacaagctgatctacaccctgcagagcagccgggaccccctgagcctgaagaagttccggctggaccctgccaccggcagcctgtacaccagcgagaagctggaccacgaggccgtgcctgcccacctgactgtgatggtgcgggaccaggatgtgcctgtgaagaggaactttgccagaattgtggtgaatgtgtctgacaccaatgaccacgccccctggttcaccgccagcagctacaagggccgggtgtatgaatctgctgctgtgggctctgtggtgctgcaggtgacagccctggacaaggacaagggcaagaatgctgaggtgctgtacagcattgagagcggcacctttggaaacatcggcaacagcttcatgattgatcctgtgctgggcagcatcaagacagccaaggagctggacaggagcaaccaggccgagtatgacctgatggtgaaggccacagacaagggcagcccccccatgtctgagatcacctctgtgcgcatctttgtgaccatcgctgacaatgccagccccaagttcaccagcaaggagtacagcgtggagctgtctgaaacagtgtccatcggcagctttgtgggcatggtgacagcccacagccagagctctgtggtgtatgagatcaaggatggcaacacaggagatgcctttgacatcaacccccacagcggcaccatcatcacccagaaggccctggactttgagaccctgcccatctacaccctcatcatccagggcaccaacatggccggcctgagcaccaacaccaccgtgctggtgcacctgcaggatgaaaatgacaatgcccctgtgttcatgcaggccgagtacacaggcctcatcagcgagagcgccagcatcaacagcgtggtgctgacagacagaaatgtgcccctggtgatccgggctgctgatgctgacaaggacagcaatgccctgctggtgtaccacatcgtggagcccagcgtgcacacctactttgccatcgacagcagcactggagccatccacacagtgctgagcctggactatgaggagaccagcatcttccacttcaccgtgcaggtgcatgacatgggcaccccccggctgtttgctgaatatgctgccaacgtgacagtgcacgtgattgacatcaatgactgcccccctgtgtttgccaagcccctgtatgaggccagcctgctgctgcccacctacaagggcgtgaaggtgatcaccgtgaatgccacagatgctgacagcagcgccttcagccagctgatctacagcatcacagagggcaacattggagagaagttctccatggactacaagacaggagccctgactgtgcagaacaccacccagctgcggagccgctatgagctgactgtgcgggccagtgatggccgctttgctggcctgacctctgtgaagatcaacgtgaaggagagcaaggagagccacctgaagttcacccaggatgtgtacagcgctgtggtgaaggagaacagcacagaagctgagaccctggccgtcatcacagccatcggcaaccccatcaatgagcccctcttctaccacatcctgaacccagaccggcgcttcaagatcagcaggaccagcggcgtgctgagcaccaccggcaccccatttgaccgggagcagcaggaggcctttgatgtggtggtggaggtgacagaggagcacaagcccagcgctgtggcccacgtggtggtgaaggtgattgtggaggaccagaatgacaatgcccctgtgtttgtgaacctgccctactatgctgtggtgaaggtggacacagaggtgggccacgtgatccgctacgtgacagctgtggaccgggacagcggcagaaatggagaggtgcactactacctgaaggagcaccacgagcacttccagatcggccccctgggggagatcagcctgaagaagcagtttgagctggacaccctgaacaaggagtacctggtgacagtggtggccaaggatggcggcaacccagccttctctgctgaggtgattgtgcccatcaccgtgatgaacaaggccatgcctgtgtttgagaagcccttctacagcgctgagattgctgagagcatccaggtgcacagccctgtggtgcacgtgcaggccaacagccctgagggcctgaaggtgttctacagcatcacagatggagaccccttcagccagttcaccatcaacttcaacacaggagtcatcaacgtgattgcccccctggactttgaggcccacccagcctacaagctgagcatccgggccacagacagcctgactggagcccatgctgaggtgtttgtggacatcatcgtggatgacatcaatgacaacccccctgtgtttgcccagcagagctatgctgtgaccctgtctgaggccagcgtcatcggcacctctgtggtgcaggtgcgggccacagacagcgacagcgagcccaacagaggcatctcctaccagatgtttggaaaccacagcaagagccatgaccacttccacgtggacagcagcacaggcctcatcagcctgctgcggaccctggactatgagcagagccggcagcacaccatctttgtgcgggctgtggatggcggcatgcccaccctgagcagtgatgtgattgtgacagtggatgtgacagacctgaatgacaacccccccctgtttgagcagcagatctatgaggcccgcatcagcgagcacgcccctcatggccactttgtgacctgtgtgaaggcctatgatgctgacagcagtgacatcgacaagctgcagtacagcatcctgtctggaaatgaccacaagcacttcgtcatcgacagcgccaccggcatcatcaccctgagcaacctgcacagacatgccctgaagcccttctacagcctgaacctgtctgtgtctgatggagtcttccgcagcagcacccaggtgcacgtgacagtgattggaggcaacctgcacagccctgccttcctgcagaatgaatatgaggtggagctggctgaaaatgcccccctgcacaccctggtgatggaggtgaagaccacagatggagacagcggcatctacggccacgtgacctaccacatcgtgaatgactttgccaaggaccgcttctacatcaatgaaagaggccagatcttcaccctggagaagctggaccgggagaccccagctgagaaggtgatctctgtgcggctgatggccaaggatgctgggggcaaggtggccttctgcaccgtgaatgtcatcctgacagatgacaatgacaatgccccccagttccgggccaccaagtatgaggtgaacatcggcagcagcgctgccaagggcacctctgtggtgaaggtgctggccagtgatgctgatgagggcagcaatgctgacatcacctacgccattgaagctgacagcgagagcgtgaaggagaacctggagatcaacaagctgagcggggtcatcaccaccaaggagagcctcatcggcctggagaatgagttcttcaccttctttgtgcgggctgtggacaatggcagccccagcaaggagagcgtggtgctggtgtatgtgaagatcctgcccccagagatgcagctgcccaagttcagcgagcccttctacaccttcaccgtgtctgaagatgtgcccatcggcacagaaattgacctgatccgggcagagcacagcggcaccgtgctgtacagcctggtgaagggcaacaccccagagagcaacagagatgagagctttgtgattgaccggcagagcggccgcctgaagctggagaagagcctggaccacgagaccaccaagtggtaccagttcagcatcctggcccgctgcacccaggatgaccacgagatggtggcctctgtggatgtgtccatccaggtgaaggatgccaatgacaacagccctgtgtttgagagcagcccctatgaggccttcatcgtggagaacctgcccggcggcagcagggtcatccagatccgggccagtgatgctgacagcggcaccaacggccaggtgatgtacagcctggaccagagccagagcgtggaggtgattgagagctttgccatcaacatggagaccggctggatcaccaccctgaaggagctggaccacgagaagagggacaactaccagatcaaggtggtggccagtgaccacggggagaagatccagctgagcagcacagccatcgtggatgtgacagtgacagatgtgaatgacagccccccacgcttcaccgctgagatctacaagggcaccgtgtctgaagatgacccccagggcggcgtgattgccatcctgagcaccacagatgctgacagcgaggagatcaaccggcaggtgacctacttcatcactggaggagaccccctgggccagtttgctgtggagaccatccagaatgagtggaaggtgtatgtgaagaagcccctggaccgggagaagagggacaactacctgctgaccatcacagccacagatggcaccttcagcagcaaggccatcgtggaggtgaaggtgctggatgccaatgacaacagccctgtgtgtgagaagaccctgtacagcgacaccatcccagaagatgtgctgcccgggaagctgatcatgcagatcagcgccacagatgctgacatccgcagcaatgctgagatcacctacaccctgctgggcagcggggctgagaagttcaagctgaacccagacaccggggagctgaagaccagcacccccctggaccgggaggagcaggccgtgtaccacctgctggtgcgggccacagatggcggcggccgcttctgccaggccagcatcgtgctgaccctggaggatgtgaatgacaatgcccctgagttctctgctgacccctatgccatcaccgtgtttgagaacacagagcccggcaccctgctgaccagggtgcaggccacagatgctgatgctggcctgaacaggaagatcctgtacagcctgattgattctgcagatggccagttcagcatcaatgagctgagcggcatcatccagctggagaagcccctggaccgggagctgcaggccgtgtacaccctgagcctgaaggctgtggaccagggcctgccccggcggctgacagccactggaacagtgattgtgtctgtgctggacatcaatgacaacccccctgtgtttgagtaccgggagtatggagccaccgtgtctgaggacatcctggtgggcacagaggtgctgcaggtgtatgctgccagccgggacatcgaggccaatgctgagatcacctacagcatcatctctggaaatgaacatggcaagttcagcattgacagcaagacaggagctgtgttcatcatcgagaacctggactatgagagcagccatgagtactacctgactgtggaggccacagatggcggcacccccagcctgagtgatgtggccaccgtgaatgtgaatgtgacagacatcaatgacaacacccctgtgttcagccaggacacctacaccaccgtcatcagtgaagatgctgtgctggagcagagcgtcatcaccgtgatggctgatgatgctgatggccccagcaacagccacatccactacagcatcattgatggcaaccagggcagcagcttcaccattgatcctgtgcggggggaggtgaaggtgaccaagctgctggaccgggagaccatcagcggctacaccctgactgtgcaggccagtgacaatggcagccccccccgggtgaacaccaccaccgtgaacattgatgtgtctgatgtgaatgacaatgcccctgtgttcagccggggcaactacagcgtcatcatccaggagaacaagcctgtgggcttctctgtgctgcagctggtggtgacagatgaggacagcagccacaacggcccccccttcttcttcaccatcgtgactggaaatgatgagaaggcctttgaggtgaacccccagggcgtgctgctgaccagcagcgccatcaagaggaaggagaaggaccactacctgctgcaggtgaaggtggccgacaacgggaagccccagctgagcagcctgacctacatcgacatccgggtcatcgaggagagcatctaccccccagccatcctgcccctggagatcttcatcaccagcagtggagaggagtacagcggcggcgtcatcggcaagatccacgccacagaccaggatgtgtatgacaccctgacctacagcctggacccccagatggacaacctcttctctgtgagcagcactggaggcaagctgattgcccacaagaagctggacatcggccagtacctgctgaatgtgtctgtgacagatggcaagttcaccaccgtggccgacatcaccgtgcacatccggcaggtgacccaggagatgctgaaccacaccatcgccatccgctttgccaacctgaccccagaggagtttgtgggggactactggaggaacttccagagggccctgaggaacatcctgggcgtgagaagaaatgacatccagatcgtgtccctgcagagcagcgagccccacccccacctggatgtgctgctgtttgtggagaagccaggcagcgcccagatcagcaccaagcagctgctgcacaagatcaacagctctgtgacagacatcgaggagatcatcggcgtgcgcatcctgaatgtgttccagaagctgtgtgccggcctggactgcccctggaagttctgtgatgagaaggtgtctgtggatgaatctgtgatgagcacccacagcacagcccggctgagctttgtgacccccaggcaccacagagctgctgtgtgcctgtgcaaggagggccgctgcccccctgtgcaccacggctgtgaagatgacccctgcccagagggctctgaatgtgtgtctgacccctgggaggagaagcacacctgtgtgtgccccagcggccgcttcggccagtgccccggcagcagctccatgaccctgactggaaacagctatgtgaagtaccgcctgacagaaaatgaaaacaagctggagatgaagctgaccatgaggctgcggacctacagcacccatgctgtggtgatgtatgcccggggcacagactacagcatcctggagatccaccacggccgcctgcagtacaagtttgactgtggcagcggccctggcatcgtgtctgtgcagagcatccaggtgaatgatggccagtggcatgctgtggccctggaggtgaatggaaattatgcccggctggtgctggaccaggtgcacacagccagcggcacagcccctggcaccctgaagaccctgaacctggacaactacgtgttcttcggcggccacatccggcagcagggcaccaggcatggccgcagcccccaggtgggcaatggcttccggggctgcatggacagcatctacctgaatggccaggagctgcccctgaacagcaagcccaggagctatgcccacatcgaggagagcgtggatgtgtccccaggctgcttcctgacagccacagaggactgtgccagcaacccctgccagaatggaggagtgtgcaaccccagccctgctgggggctactactgcaagtgcagcgccctgtacatcggcacccactgtgagatctctgtgaacccctgcagcagcaagccctgcctgtatggaggcacctgtgtggtggacaatggaggctttgtgtgccagtgccggggcctgtacacaggccagcgctgccagctgagcccctactgcaaggatgagccctgcaagaatggaggcacctgctttgacagcctggatggagctgtgtgccagtgtgacagcggcttccggggggagcgctgccagagcgacattgatgagtgcagcggcaacccctgcctgcacggggccctgtgtgagaacacccacggcagctaccactgcaactgcagccatgagtaccggggccgccactgtgaagatgctgcccccaaccagtatgtgtccaccccctggaacatcggcctggccgagggcattggaattgtggtgtttgtggccggcatcttcctgctggtggtggtgtttgtgctgtgcaggaagatgatcagcaggaagaagaagcaccaggccgagcccaaggacaagcacctgggccctgccacagccttcctgcagaggccctactttgacagcaagctgaacaagaacatctacagcgacatccccccccaggtgcctgtgcggcccatctcctacacccccagcatccccagcgacagcaggaacaacctggacaggaacagctttgagggcagcgccatccctgagcaccctgagttcagcaccttcaaccctgagagcgtgcacggccacaggaaggctgtggccgtgtgcagcgtggcccccaacctgcccccacctccacccagcaacagccccagcgacagcgacagcatccagaagcccagctgggactttgattatgacaccaaggtggtggacctggacccctgcctgagcaagaagcccctggaggagaagcccagccagccctacagcgcccgggagagcctgtctgaggtgcagagcctgagcagcttccagagcgagagctgtgatgacaatggctaccactgggacaccagtgactggatgcccagcgtgcccctgcctgacatccaggagttccccaactatgaggtgattgatgagcagacccccctgtacagcgctgaccccaatgccatcgacacagactactacccaggcggctatgacattgaaagtgacttccccccacctcctgaggacttccctgctgctgatgagctgccccccctgcccccagagttcagcaaccagtttgagagcatccaccccccccgggacatgcctgctgctggcagcctgggcagcagcagcaggaaccggcagcgcttcaacctgaaccagtacctgcccaacttctaccccctggacatgtctgagccccagaccaagggcaccggggagaacagcacctgccgggagccccacgccccctacccacctggctaccagaggcactttgaggccccagctgtggagagcatgcccatgtctgtgtatgccagcacagccagctgcagtgatgtgtctgcctgctgtgaggtggagagcgaggtgatgatgtctgactatgagagcggagatgatggccactttgaggaggtgaccatcccccccctggacagccagcagcacacagaggtgtag

SEQ ID NO: 19660 - DNA, 13767 bp, Artificial Sequence
  Description of Artificial Sequence: Synthetic coding sequence
atgggccgccacctggccctgctgctgctgctgctgctgctcttccagcactttggagacagtgatggcagccagaggctggagcagacccccctgcagttcacccacctggagtacaacgtgacagtgcaggagaacagcgctgccaagacctacgtgggccaccctgtgaagatgggcgtgtacatcacccacccagcctgggaggtgcgctacaagatcgtgtctggggacagcgagaacctcttcaaggccgaggagtacatcctgggggacttctgcttcctgcgcatccgcaccaagggcggcaacacagccatcctgaaccgggaggtgaaggaccactacaccctgattgtgaaggccctggagaagaacaccaacgtggaggcccggaccaaggtgcgggtgcaggtgctggacaccaatgacctgcggcccctcttcagccccaccagctacagcgtgtccctgcctgagaacacagccatccgcaccagcatcgcccgggtgtctgccacagatgctgacatcggcaccaatggagagttctactacagcttcaaggacagaacagacatgtttgccatccaccccaccagcggggtcatcgtgctgaccggccgcctggactacctggagaccaagctgtatgagatggagatcctggccgctgaccggggcatgaagctgtatggcagcagcggcatcagctccatggccaagctgactgtgcacatcgagcaggccaatgaatgtgcccctgtgatcacagctgtgaccctgagccccagcgagctggaccgggaccctgcctatgccatcgtgacagtggatgactgtgaccagggcgccaacggggacatcgccagcctgagcatcgtggccggggacctgctgcagcagttcagaacagtgcgctccttccctggcagcaaggagtacaaggtgaaggccatcggcggcatcgactgggacagccaccccttcggctacaacctgaccctgcaggccaaggacaagggcaccccaccccagttcagctctgtgaaggtgatccacgtgaccagcccccagttcaaggccggccctgtgaagtttgagaaggatgtgtacagagctgagatcagcgagtttgccccacccaacacccctgtggtgatggtgaaggccatcccagcctacagccacctgcgctacgtgttcaagagcacccctgggaaggccaagttcagcctgaactacaacacaggcctcatcagcatcctggagcctgtgaagaggcagcaggccgcccactttgagctggaggtgaccaccagtgacaggaaggccagcaccaaggtgctggtgaaggtgctgggcgccaacagcaaccccccagagttcacccagacagcctacaaggccgcctttgatgaaaatgtgcccatcggcaccaccgtgatgagcctgtctgctgtggaccctgatgaaggagaaaatggctacgtgacctacagcatcgccaacctgaaccacgtgccctttgccatcgaccacttcaccggggctgtgtccaccagcgagaacctggactatgagctgatgccccgggtgtacaccctgcgcatccgggccagtgactggggcctgccctaccgccgggaggtggaggtgctggccaccatcaccctgaacaacctgaatgacaacacccccctgtttgagaagatcaactgtgagggcaccatcccccgggacctgggcgtgggggagcagatcaccaccgtgtctgccattgatgctgatgagctgcagctggtgcagtaccagatcgaggccggaaatgagctggacttcttcagcctgaaccccaacagcggcgtgctgagcctgaagaggagcctgatggatggcctgggcgccaaggtgtccttccacagcctgcgcatcacagccacagatggagaaaattttgccacccccctgtacatcaacatcaccgtggccgccagccacaagctggtgaacctgcagtgtgaggagactggagtggccaagatgctggccgagaagctgctgcaggccaacaagctgcacaaccagggcgaggtggaggacatcttctttgacagccacagcgtgaatgcccacatcccccagttccgcagcaccctgcccaccggcatccaggtgaaggagaaccagcctgtgggcagcagcgtcatcttcatgaacagcacagacctggacaccggcttcaacgggaagctggtgtatgctgtgtctggaggaaatgaagacagctgcttcatgattgacatggagaccggcatgctgaagatcctgagccccctggaccgggagaccacagacaagtacaccctgaacatcaccgtgtatgacctgggcatcccccagaaggccgcctggaggctgctgcacgtggtggtggtggatgccaatgacaaccccccagagttcctgcaggagagctactttgtggaggtgtctgaggacaaggaggtgcacagcgagatcatccaggtggaggccacagacaaggacctgggccccaacggccacgtgacctacagcatcgtgacagacacagacaccttcagcattgacagcgtgactggagtggtgaacatcgcccggcccctggaccgggagctgcagcacgagcacagcctgaagattgaggcccgggaccaggcccgggaggagccccagctgttcagcacagtggtggtgaaggtgtccctggaggatgtgaatgacaacccccccaccttcatcccccccaactacagagtgaaggtgcgggaggacctgcctgagggcaccgtcatcatgtggctggaggcccatgaccctgacctgggccagagcggccaggtgcgctacagcctgctggaccatggagagggcaactttgatgtggacaagctgagcggggctgtgagaattgtgcagcagctggactttgagaagaagcaggtgtacaacctgactgtgcgggccaaggacaagggcaagcctgtgtccctgagcagcacctgctacgtggaggtggaggtggtggatgtgaatgaaaacctgcacccccctgtgttcagcagctttgtggagaagggcaccgtgaaggaggatgcccctgtgggcagcctggtgatgacagtgtctgcccatgatgaagatgccaggagagatggagagatccgctacagcatcagagatggcagcggcgtgggcgtcttcaagatcggggaggagaccggggtgattgagaccagtgaccggctggaccgggagagcaccagccactactggctgactgtgtttgccacagaccagggcgtggtgcccctgagcagcttcatcgagatctacatcgaggtggaggatgtgaatgacaatgccccccagaccagcgagcctgtgtactacccagagatcatggagaacagccccaaggatgtgtctgtggtgcagatcgaggcctttgatcctgacagcagcagcaatgacaagctgatgtacaagatcaccagcggcaacccccagggcttcttcagcatccaccccaagacaggcctcatcaccaccaccagcaggaagctggaccgggagcagcaggatgagcacatcctggaggtgacagtgacagacaatggcagcccccccaagagcaccatcgcccgggtcatcgtgaagatcctggatgaaaatgacaacaagccccagttcctgcagaagttctacaagatccggctgcctgagcgggagaagccagaccgggagagaaatgcccggcgggagcccctgtaccacgtgattgccacagacaaggatgagggccccaatgctgagatctcctacagcattgaagatggaaatgaacatggcaagttcttcatcgagcccaagacaggagtggtgagcagcaagcgcttctctgctgctggggagtatgacatcctgagcatcaaggctgtggacaatggccggccccagaagagcagcaccacccggctgcacatcgagtggatcagcaagcccaagcccagcctggagcccatcagctttgaggagagcttcttcaccttcaccgtgatggagagtgaccctgtggcccacatgattggagtcatctctgtggagcccccaggcatccccctgtggtttgacatcaccggcggcaactatgacagccactttgatgtggacaagggcaccggcaccatcatcgtggccaagcccctggatgctgagcagaagagcaactacaacctgactgtggaggccacagatggcaccaccaccatcctgacccaggtgttcatcaaggtgattgacaccaatgaccaccggccccagttcagcaccagcaaatatgaggtggtgattcctgaggacacagcccctgagacagagatcctgcagatctctgctgtggaccaggatgagaagaacaagctgatctacaccctgcagagcagccgggaccccctgagcctgaagaagttccggctggaccctgccaccggcagcctgtacaccagcgagaagctggaccacgaggccgtgcaccagcacaccctgactgtgatggtgcgggaccaggatgtgcctgtgaagaggaactttgcccgcatcgtggtgaatgtgtctgacaccaatgaccacgccccctggttcaccgccagcagctacaagggccgggtgtatgagagcgctgctgtgggctctgtggtgctgcaggtgacagccctggacaaggacaagggcaagaatgctgaggtgctgtacagcattgaaagtggcaacatcggcaacagcttcatgattgatcctgtgctgggcagcatcaagacagccaaggagctggacaggagcaaccaggccgagtatgacctgatggtgaaggccacagacaagggcagcccccccatgtctgagatcacctctgtgcgcatctttgtgaccatcgctgacaatgccagccccaagttcaccagcaaggagtacagcgtggagctgtctgaaacagtgtccatcggcagctttgtgggcatggtgacagcccacagccagagctctgtggtgtatgagatcaaggatggcaacacaggagatgcctttgacatcaacccccacagcggcaccatcatcacccagaaggccctggactttgagaccctgcccatctacaccctcatcatccagggcaccaacatggccggcctgagcaccaacaccaccgtgctggtgcacctgcaggatgaaaatgacaatgcccctgtgttcatgcaggccgagtacacaggcctcatcagcgagagcgccagcatcaacagcgtggtgctgacagacagaaatgtgcccctggtgatccgggctgctgatgctgacaaggacagcaatgccctgctggtgtaccacatcgtggagcccagcgtgcacacctactttgccatcgacagcagcactggagccatccacacagtgctgagcctggactatgaggagaccagcatcttccacttcaccgtgcaggtgcatgacatgggcaccccccggctgtttgctgaatatgctgccaacgtgacagtgcacgtgattgacatcaatgactgcccccctgtgtttgccaagcccctgtatgaggccagcctgctgctgcccacctacaagggcgtgaaggtgatcaccgtgaatgccacagatgctgacagcagcgccttcagccagctgatctacagcatcacagagggcaacattggagagaagttctccatggactacaagacaggagccctgactgtgcagaacaccacccagctgcggagccgctatgagctgactgtgcgggccagtgatggccgctttgctggcctgacctctgtgaagatcaacgtgaaggagagcaaggagagccacctgaagttcacccaggatgtgtacagcgctgtggtgaaggagaacagcacagaagctgagaccctggccgtcatcacagccatcggcaaccccatcaatgagcccctcttctaccacatcctgaacccagaccggcgcttcaagatcagcaggaccagcggcgtgctgagcaccaccggcaccccatttgaccgggagcagcaggaggcctttgatgtggtggtggaggtgacagaggagcacaagcccagcgctgtggcccacgtggtggtgaaggtgattgtggaggaccagaatgacaatgcccctgtgtttgtgaacctgccctactatgctgtggtgaaggtggacacagaggtgggccacgtgatccgctacgtgacagctgtggaccgggacagcggcagaaatggagaggtgcactactacctgaaggagcaccacgagcacttccagatcggccccctgggggagatcagcctgaagaagcagtttgagctggacaccctgaacaaggagtacctggtgacagtggtggccaaggatggcggcaacccagccttctctgctgaggtgattgtgcccatcaccgtgatgaacaaggccatgcctgtgtttgagaagcccttctacagcgctgagattgctgagagcatccaggtgcacagccctgtggtgcacgtgcaggccaacagccctgagggcctgaaggtgttctacagcatcacagatggagaccccttcagccagttcaccatcaacttcaacacaggagtcatcaacgtgattgcccccctggactttgaggcccacccagcctacaagctgagcatccgggccacagacagcctgactggagcccatgctgaggtgtttgtggacatcatcgtggatgacatcaatgacaacccccctgtgtttgcccagcagagctatgctgtgaccctgtctgaggccagcgtcatcggcacctctgtggtgcaggtgcgggccacagacagcgacagcgagcccaacagaggcatctcctaccagatgtttggaaaccacagcaagagccatgaccacttccacgtggacagcagcacaggcctcatcagcctgctgcggaccctggactatgagcagagccggcagcacaccatctttgtgcgggctgtggatggcggcatgcccaccctgagcagtgatgtgattgtgacagtggatgtgacagacctgaatgacaacccccccctgtttgagcagcagatctatgaggcccgcatcagcgagcacgcccctcatggccactttgtgacctgtgtgaaggcctatgatgctgacagcagtgacatcgacaagctgcagtacagcatcctgtctggaaatgaccacaagcacttcgtcatcgacagcgccaccggcatcatcaccctgagcaacctgcacagacatgccctgaagcccttctacagcctgaacctgtctgtgtctgatggagtcttccgcagcagcacccaggtgcacgtgacagtgattggaggcaacctgcacagccctgccttcctgcagaatgaatatgaggtggagctggctgaaaatgcccccctgcacaccctggtgatggaggtgaagaccacagatggagacagcggcatctacggccacgtgacctaccacatcgtgaatgactttgccaaggaccgcttctacatcaatgaaagaggccagatcttcaccctggagaagctggaccgggagaccccagctgagaaggtgatctctgtgcggctgatggccaaggatgctgggggcaaggtggccttctgcaccgtgaatgtcatcctgacagatgacaatgacaatgccccccagttccgggccaccaagtatgaggtgaacatcggcagcagcgctgccaagggcacctctgtggtgaaggtgctggccagtgatgctgatgagggcagcaatgctgacatcacctacgccattgaagctgacagcgagagcgtgaaggagaacctggagatcaacaagctgagcggggtcatcaccaccaaggagagcctcatcggcctggagaatgagttcttcaccttctttgtgcgggctgtggacaatggcagccccagcaaggagagcgtggtgctggtgtatgtgaagatcctgcccccagagatgcagctgcccaagttcagcgagcccttctacaccttcaccgtgtctgaagatgtgcccatcggcacagaaattgacctgatccgggcagagcacagcggcaccgtgctgtacagcctggtgaagggcaacaccccagagagcaacagagatgagagctttgtgattgaccggcagagcggccgcctgaagctggagaagagcctggaccacgagaccaccaagtggtaccagttcagcatcctggcccgctgcacccaggatgaccacgagatggtggcctctgtggatgtgtccatccaggtgaaggatgccaatgacaacagccctgtgtttgagagcagcccctatgaggccttcatcgtggagaacctgcccggcggcagcagggtcatccagatccgggccagtgatgctgacagcggcaccaacggccaggtgatgtacagcctggaccagagccagagcgtggaggtgattgagagctttgccatcaacatggagaccggctggatcaccaccctgaaggagctggaccacgagaagagggacaactaccagatcaaggtggtggccagtgaccacggggagaagatccagctgagcagcacagccatcgtggatgtgacagtgacagatgtgaatgacagccccccacgcttcaccgctgagatctacaagggcaccgtgtctgaagatgacccccagggcggcgtgattgccatcctgagcaccacagatgctgacagcgaggagatcaaccggcaggtgacctacttcatcactggaggagaccccctgggccagtttgctgtggagaccatccagaatgagtggaaggtgtatgtgaagaagcccctggaccgggagaagagggacaactacctgctgaccatcacagccacagatggcaccttcagcagcaaggccatcgtggaggtgaaggtgctggatgccaatgacaacagccctgtgtgtgagaagaccctgtacagcgacaccatcccagaagatgtgctgcccgggaagctgatcatgcagatcagcgccacagatgctgacatccgcagcaatgctgagatcacctacaccctgctgggcagcggggctgagaagttcaagctgaacccagacaccggggagctgaagaccagcacccccctggaccgggaggagcaggccgtgtaccacctgctggtgcgggccacagatggcggcggccgcttctgccaggccagcatcgtgctgaccctggaggatgtgaatgacaatgcccctgagttctctgctgacccctatgccatcaccgtgtttgagaacacagagcccggcaccctgctgaccagggtgcaggccacagatgctgatgctggcctgaacaggaagatcctgtacagcctgattgattctgcagatggccagttcagcatcaatgagctgagcggcatcatccagctggagaagcccctggaccgggagctgcaggccgtgtacaccctgagcctgaaggctgtggaccagggcctgccccggcggctgacagccactggaacagtgattgtgtctgtgctggacatcaatgacaacccccctgtgtttgagtaccgggagtatggagccaccgtgtctgaggacatcctggtgggcacagaggtgctgcaggtgtatgctgccagccgggacatcgaggccaatgctgagatcacctacagcatcatctctggaaatgaacatggcaagttcagcattgacagcaagacaggagctgtgttcatcatcgagaacctggactatgagagcagccatgagtactacctgactgtggaggccacagatggcggcacccccagcctgagtgatgtggccaccgtgaatgtgaatgtgacagacatcaatgacaacacccctgtgttcagccaggacacctacaccaccgtcatcagtgaagatgctgtgctggagcagagcgtcatcaccgtgatggctgatgatgctgatggccccagcaacagccacatccactacagcatcattgatggcaaccagggcagcagcttcaccattgatcctgtgcggggggaggtgaaggtgaccaagctgctggaccgggagaccatcagcggctacaccctgactgtgcaggccagtgacaatggcagccccccccgggtgaacaccaccaccgtgaacattgatgtgtctgatgtgaatgacaatgcccctgtgttcagccggggcaactacagcgtcatcatccaggagaacaagcctgtgggcttctctgtgctgcagctggtggtgacagatgaggacagcagccacaacggcccccccttcttcttcaccatcgtgactggaaatgatgagaaggcctttgaggtgaacccccagggcgtgctgctgaccagcagcgccatcaagaggaaggagaaggaccactacctgctgcaggtgaaggtggccgacaacgggaagccccagctgagcagcctgacctacatcgacatccgggtcatcgaggagagcatctaccccccagccatcctgcccctggagatcttcatcaccagcagtggagaggagtacagcggcggcgtcatcggcaagatccacgccacagaccaggatgtgtatgacaccctgacctacagcctggacccccagatggacaacctcttctctgtgagcagcactggaggcaagctgattgcccacaagaagctggacatcggccagtacctgctgaatgtgtctgtgacagatggcaagttcaccaccgtggccgacatcaccgtgcacatccggcaggtgacccaggagatgctgaaccacaccatcgccatccgctttgccaacctgaccccagaggagtttgtgggggactactggaggaacttccagagggccctgaggaacatcctgggcgtgagaagaaatgacatccagatcgtgtccctgcagagcagcgagccccacccccacctggatgtgctgctgtttgtggagaagccaggcagcgcccagatcagcaccaagcagctgctgcacaagatcaacagctctgtgacagacatcgaggagatcatcggcgtgcgcatcctgaatgtgttccagaagctgtgtgccggcctggactgcccctggaagttctgtgatgagaaggtgtctgtggatgaatctgtgatgagcacccacagcacagcccggctgagctttgtgacccccaggcaccacagagctgctgtgtgcctgtgcaaggagggccgctgcccccctgtgcaccacggctgtgaagatgacccctgcccagagggctctgaatgtgtgtctgacccctgggaggagaagcacacctgtgtgtgccccagcggccgcttcggccagtgccccggcagcagctccatgaccctgactggaaacagctatgtgaagtaccgcctgacagaaaatgaaaacaagctggagatgaagctgaccatgaggctgcggacctacagcacccatgctgtggtgatgtatgcccggggcacagactacagcatcctggagatccaccacggccgcctgcagtacaagtttgactgtggcagcggccctggcatcgtgtctgtgcagagcatccaggtgaatgatggccagtggcatgctgtggccctggaggtgaatggaaattatgcccggctggtgctggaccaggtgcacacagccagcggcacagcccctggcaccctgaagaccctgaacctggacaactacgtgttcttcggcggccacatccggcagcagggcaccaggcatggccgcagcccccaggtgggcaatggcttccggggctgcatggacagcatctacctgaatggccaggagctgcccctgaacagcaagcccaggagctatgcccacatcgaggagagcgtggatgtgtccccaggctgcttcctgacagccacagaggactgtgccagcaacccctgccagaatggaggagtgtgcaaccccagccctgctgggggctactactgcaagtgcagcgccctgtacatcggcacccactgtgagatctctgtgaacccctgcagcagcaagccctgcctgtatggaggcacctgtgtggtggacaatggaggctttgtgtgccagtgccggggcctgtacacaggccagcgctgccagctgagcccctactgcaaggatgagccctgcaagaatggaggcacctgctttgacagcctggatggagctgtgtgccagtgtgacagcggcttccggggggagcgctgccagagcgacattgatgagtgcagcggcaacccctgcctgcacggggccctgtgtgagaacacccacggcagctaccactgcaactgcagccatgagtaccggggccgccactgtgaagatgctgcccccaaccagtatgtgtccaccccctggaacatcggcctggccgagggcattggaattgtggtgtttgtggccggcatcttcctgctggtggtggtgtttgtgctgtgcaggaagatgatcagcaggaagaagaagcaccaggccgagcccaaggacaagcacctgggccctgccacagccttcctgcagaggccctactttgacagcaagctgaacaagaacatctacagcgacatccccccccaggtgcctgtgcggcccatctcctacacccccagcatccccagcgacagcaggaacaacctggacaggaacagctttgagggcagcgccatccctgagcaccctgagttcagcaccttcaaccctgagagcgtgcacggccacaggaaggctgtggccgtgtgcagcgtggcccccaacctgcccccacctccacccagcaacagccccagcgacagcgacagcatccagaagcccagctgggactttgattatgacaccaaggtggtggacctggacccctgcctgagcaagaagcccctggaggagaagcccagccagccctacagcgcccgggagagcctgtctgaggtgcagagcctgagcagcttccagagcgagagctgtgatgacaatggctaccactgggacaccagtgactggatgcccagcgtgcccctgcctgacatccaggagttccccaactatgaggtgattgatgagcagacccccctgtacagcgctgaccccaatgccatcgacacagactactacccaggcggctatgacattgaaagtgacttccccccacctcctgaggacttccctgctgctgatgagctgccccccctgcccccagagttcagcaaccagtttgagagcatccaccccccccgggacatgcctgctgctggcagcctgggcagcagcagcaggaaccggcagcgcttcaacctgaaccagtacctgcccaacttctaccccctggacatgtctgagccccagaccaagggcaccggggagaacagcacctgccgggagccccacgccccctacccacctggctaccagaggcactttgaggccccagctgtggagagcatgcccatgtctgtgtatgccagcacagccagctgcagtgatgtgtctgcctgctgtgaggtggagagcgaggtgatgatgtctgactatgagagcggagatgatggccactttgaggaggtgaccatcccccccctggacagccagcagcacacagaggtgtag

SEQ ID NO: 19661 - DNA, 1467 bp, Artificial Sequence
  Description of Artificial Sequence: Synthetic coding sequence
atgggccgccacctggccctgctgctgctgctgctgctgctcttccagcactttggagacagtgatggcagccagaggctggagcagacccccctgcagttcacccacctggagtacaacgtgacagtgcaggagaacagcgctgccaagacctacgtgggccaccctgtgaagatgggcgtgtacatcacccacccagcctgggaggtgcgctacaagatcgtgtctggggacagcgagaacctcttcaaggccgaggagtacatcctgggggacttctgcttcctgcgcatccgcaccaagggcggcaacacagccatcctgaaccgggaggtgaaggaccactacaccctgattgtgaaggccctggagaagaacaccaacgtggaggcccggaccaaggtgcgggtgcaggtgctggacaccaatgacctgcggcccctcttcagccccaccagctacagcgtgtccctgcctgagaacacagccatccgcaccagcatcgcccgggtgtctgccacagatgctgacatcggcaccaatggagagttctactacagcttcaaggacagaacagacatgtttgccatccaccccaccagcggggtcatcgtgctgaccggccgcctggactacctggagaccaagctgtatgagatggagatcctggccgctgaccggggcatgaagctgtatggcagcagcggcatcagctccatggccaagctgactgtgcacatcgagcaggccaatgaatgtgcccctgtgatcacagctgtgaccctgagccccagcgagctggaccgggaccctgcctatgccatcgtgacagtggatgactgtgaccagggcgccaacggggacatcgccagcctgagcatcgtggccggggacctgctgcagcagttcagaacagtgcgctccttccctggcagcaaggagtacaaggtgaaggccatcggcggcatcgactgggacagccaccccttcggctacaacctgaccctgcaggccaaggacaagggcaccccaccccagttcagctctgtgaaggtgatccacgtgaccagcccccagttcaaggccggccctgtgaagtttgagaaggatgtgtacagagctgagatcagcgagtttgccccacccaacacccctgtggtgatggtgaaggccatcccagcctacagccacctgcgctacgtgttcaagagcacccctgggaaggccaagttcagcctgaactacaacacaggcctcatcagcatcctggagcctgtgaagaggcagcaggccgcccactttgagctggaggtgaccaccagtgacaggaaggccagcaccaaggtgctggtgaaggtgctgggcgccaacagcaaccccccagagttcacccagacagcctacaaggccgcctttgatgaaaatgtgcccatcggcaccaccgtgatgagcctgtctgctgtgtag

SEQ ID NO: 19662 - DNA, 399 bp, Artificial Sequence
  Description of Artificial Sequence: Synthetic coding sequence
atgtgtgatgcctttgtgggcacctggaagctggtgtccagtgaaaattttgatgactacatgaaggaggtgggcgtgggctttgccaccaggaaggtggccggcatggccaagcccaacatgatcatctctgtgaatggagatgtgatcaccatcaagtctgagagcaccttcaagaacacagagatctccttcatcctgggccaggagtttgatgaggtgacagcagatgacaggaaggtgaagagcaccatcaccctggatggcggcgtgctggtgcacgtgcagaagtgggatggcaagagcaccaccatcaagaggaagcgggaggatgacaagctggtggtggagtgtgtgatgaagggcgtgaccagcaccagggtgtatgagcgggcctag

SEQ ID NO: 19663 - DNA, 7536 bp, Artificial Sequence
  Description of Artificial Sequence: Synthetic coding sequence
atggaggaggtggtgattgctggcatgtctgggaagctgcctgagagcgagaacctgcaggagttctgggacaacctgattggaggagtggacatggtgacagatgatgaccggcgctggaaggccggcctgtatggcctgcccaggagaagtggcaagctgaaggacctgagcagatttgatgccagcttctttggagtgcaccccaagcaggcccacaccatggacccccagctgcggctgctgctggaggtgacctatgaggccatcgtggatggcggcatcaacccagacagcctgcggggcacccacactggagtgtgggtgggcgtgtctggcagcgagaccagcgaggccctgagccgggaccctgagaccctggtgggctacagcatggtgggctgccagagggccatgatggccaaccggctgtccttcttctttgacttccggggccccagcatcgccctggacacagcctgcagcagcagcctgatggccctgcagaatgcctaccaggccatccacagcggccagtgcccagctgccatcgtgggcggcatcaacgtgctgctgaagcccaacacctctgtgcagttcctgcggctgggcatgctgagccctgagggcacctgcaaggcctttgacacagctggaaatggctactgccgctcagaaggagtggtggccgtgctgctgaccaagaagagcctggcccggcgggtgtatgccaccatcctgaatgccggcaccaacacagatggcttcaaggagcagggcgtgaccttccccagcggggacatccaggagcagctgatccgcagcctgtaccagagcgctggggtggcccctgagagctttgagtacatcgaggcccatggaacaggcaccaaggtgggggacccccaggagctgaatggcatcacccgggccctgtgtgccacccggcaggagcccctgctgattggcagcaccaagagcaacatgggccaccctgagcccgccagcggcctggccgccctggccaaggtgctgctgagcctggagcacggcctgtgggcccccaacctgcacttccacagccccaaccctgagatcccagccctgctggatggccgcctgcaggtggtggaccagcccctgcctgtgcggggcggcaatgtgggcatcaacagctttggatttggaggcagcaatgtgcacatcatcctgcggcccaacacccagcccccaccagccccagcccctcatgccaccctgccccggctgctgcgggccagcggccgcaccccagaggccgtgcagaagctgctggagcagggcctgcggcacagccaggacctggccttcctgtccatgctgaatgacattgctgctgtgcctgccacagccatgcccttccggggctatgctgtgctgggcggggagcggggcggccctgaggtgcagcaggtgcctgctggggagcggcccctgtggttcatctgcagcggcatgggcacccagtggaggggcatgggcctgagcctgatgaggctggaccgcttccgggacagcatcctgcggagtgatgaggccgtgaagcccttcggcctgaaggtgtcccagctgctgctgagcacagatgagagcacctttgatgacatcgtgcacagctttgtgtccctgacagccatccagatcggcctgattgacctgctgagctgcatgggcctgcggccagatggcatcgtgggccacagcctgggggaggtggcctgtggctatgcagatggctgcctgagccaggaggaggccgtgctggccgcctactggaggggccagtgcatcaaggaggcccacctgcccccaggggccatggctgctgtgggcctgtcctgggaggagtgcaagcagcgctgccccccaggagtggtgcctgcctgccacaacagcaaggacacagtgaccatcagcggcccccaggcccctgtgtttgaatttgtggagcagctgaggaaggagggcgtgtttgccaaggaggtgaggactggaggcatggccttccacagctacttcatggaggccatcgccccacccctgctgcaggagctgaagaaggtgatccgggagcccaagcccaggtctgcccgctggctgagcaccagcatccctgaggcccagtggcacagcagcctggcccggaccagcagcgctgagtacaacgtgaacaacctggtgtcccctgtgctcttccaggaggccctgtggcacgtgcctgagcacgctgtggtgctggagatcgccccccacgccctgctgcaggccgtgctgaagaggggcctgaagcccagctgcaccatcatccccctgatgaagaaggaccaccgggacaacctggagttcttcctggccggcatcggccgcctgcacctgagcggcattgatgccaaccccaatgccctcttcccccctgtggagttccctgccccccggggcacccccctcatcagccccctcatcaagtgggaccacagcctggcctgggatgtgcctgctgctgaggacttccccaacggcagcggcagccccagcgctgccatctacaacatcgacaccagcagcgagagcccagaccactacctggtggaccacaccctggatggccgggtgctcttccctgccaccggctacctgagcatcgtgtggaagaccctggcccgggccctgggcctgggcgtggagcagctgcctgtggtgtttgaagatgtggtgctgcaccaggccaccatcctgcccaagacaggcaccgtgtccctggaggtgcggctgctggaggccagccgggcctttgaggtgtctgaaaatggaaacctggtggtgtctgggaaggtgtaccagtgggatgatcctgacccccggctgtttgaccaccctgagagccccacccccaaccccacagagcccctcttcctggcccaggccgaggtgtacaaggagctgcggctgcggggctatgactatggcccccacttccagggcatcctggaggccagcctggagggggacagcggccgcctgctgtggaaggacaactgggtgtccttcatggacaccatgctgcagatgagcatcctgggcagcgccaagcacggcctgtacctgcccaccagggtgacagccatccacattgatcctgccacccaccggcagaagctgtacaccctgcaggacaaggcccaggtggctgatgtggtggtgagccgctggctgcgggtgacagtggccggcggcgtgcacatcagcggcctgcacacagaaagtgccccccggcggcagcaggagcagcaggtgcccatcctggagaagttctgcttcaccccccacacagaggagggctgcctgtctgagcgggccgccctgcaggaggagctgcagctgtgcaagggcctggtgcaggccctgcagaccaaggtgacccagcagggcctgaagatggtggtgcccggcctggatggagcccagatcccccgggaccccagccagcaggagctgccccggctgctgtctgctgcctgccgcctgcagctgaatggaaacctgcagctggagctggcccaggtgctggcccaggagcggcccaagctgcctgaggaccccctgctgagcggcctgctggacagccctgccctgaaggcctgcctggacacagctgtggagaacatgcccagcctgaagatgaaggtggtggaggtgctggccggccacggccacctgtacagccgcatccctggcctgctgagcccccaccccctgctgcagctgagctacacagccacagacagacacccccaggccctggaggccgcccaggccgagctgcagcagcatgatgtggcccagggccagtgggaccctgctgaccctgcccccagcgccctgggcagcgctgacctgctggtgtgcaactgtgctgtggccgccctgggggaccctgccagcgccctgagcaacatggtggccgccctgcgggagggcggcttcctgctgctgcacaccctgctgcggggccaccccctgggggacatcgtggccttcctgaccagcacagagccccagtatggccagggcatcctgagccaggatgcctgggagagcctcttcagccgggtgtccctgcggctggtgggcctgaagaagagcttctacggcagcaccctcttcctgtgccggcggcccaccccccaggacagccccatcttcctgcctgtggatgacaccagcttccgctgggtggagagcctgaagggcatcctggctgatgaggacagcagcaggcctgtgtggctgaaggccatcaactgtgccaccagcggcgtggtgggcctggtgaactgcctgcggcgggagcccggcggcaaccggctgcgctgtgtgctgctgagcaacctgagcagcaccagccacgtgcctgaggtggaccccggcagcgctgagctgcagaaggtgctgcagggcgacctggtgatgaatgtgtacagagatggagcctggggcgccttccgccacttcctgctggaggaggacaagccagaggagcccacagcccacgcctttgtgtccaccctgaccaggggggacctgagcagcatccgctgggtgtgcagcagcctgcggcatgcccagcccacctgccctggggcccagctgtgcaccgtgtactatgccagcctgaacttccgggacatcatgctggccaccgggaagctgagcccagatgccatccctgggaagtggaccagccaggacagcctgctgggcatggagttcagcggcagagatgccagcggcaagagggtgatgggcctggtgcctgccaagggcctggccacctctgtgctgctgagcccagacttcctgtgggatgtgcccagcaactggaccctggaggaggccgcctctgtgcctgtggtgtacagcacagcctactatgccctggtggtgcggggccgggtgcggcctggagagaccctgctgatccacagcggcagcggaggagtgggccaggccgccatcgccatcgccctgagcctgggctgcagggtcttcaccaccgtgggcagcgctgagaagagggcctacctgcaggcccgcttcccccagctggacagcaccagctttgccaacagccgggacaccagctttgagcagcacgtgctgtggcacactggaggaaaaggagtggacctggtgctgaacagcctggccgaggagaagctgcaggcctctgtgcgctgcctggccacccacggccgcttcctggagatcggcaagtttgacctgagccagaaccaccccctgggcatggccatcttcctgaagaatgtgaccttccacggcgtgctgctggatgccttcttcaatgaaagcagcgctgactggagggaggtgtgggccctggtgcaggccggcatcagagatggagtggtgcggcccctgaagtgcaccgtcttccacggggcccaggtggaggatgccttccgctacatggcccagggcaagcacatcggcaaggtggtggtgcaggtgctggccgaggagcctgaggccgtgctgaagggggccaagcccaagctgatgtctgccatcagcaagaccttctgcccagcccacaagagctacatcatcgccggcggcctgggcggcttcggcctggagctggcccagtggctgatccagaggggcgtgcagaagctggtgctgaccagccgcagcggcatcagaacaggctaccaggccaagcaggtgcggcgctggaggcggcagggcgtgcaggtgcaggtgtccaccagcaacatcagcagcctggagggcgcccggggcctgattgctgaggccgcccagctgggccctgtgggcggcgtcttcaacctggccgtggtgctgagagatggcctgctggagaaccagaccccagagttcttccaggatgtgtgcaagcccaagtacagcggcaccctgaacctggacagagtgacccgggaggcctgcccagagctggactactttgtggtgttcagctctgtgtcctgtggcagaggaaatgccggccagagcaactacggctttgccaacagcgccatggagcgcatctgtgagaagagaagacatgagggcctgcccggcctggccgtgcagtggggcgccatcggagatgtgggcatcctggtggagaccatgagcaccaatgacaccatcgtgtctggcaccctgccccagaggatggccagctgcctggaggtgctggacctcttcctgaaccagccccacatggtgctgagcagctttgtgctggccgagaaggccgccgcctacagagaccgggacagccagagggacctggtggaggccgtggcccacatcctgggcatccgggacctggccgctgtgaacctggacagcagcctggccgacctgggcctggacagcctgatgtctgtggaggtgcggcagaccctggagcgggagctgaacctggtgctgtctgtgcgggaggtgcggcagctgaccctgaggaagctgcaggagctgagcagcaaggcagatgaggccagcgagctggcctgccccacccccaaggaggatggcctggcccagcagcagacccagctgaacctgcggagcctgctggtgaaccctgagggccccaccctgatgaggctgaacagcgtgcagagcagcgagcggcccctcttcctggtgcaccccatcgagggcagcaccaccgtcttccacagcctggccagccggctgagcatccccacctacggcctgcagtgcacccgggccgcccccctggacagcatccacagcctggccgcctactacatcgactgcatccggcaggtgcagcctgagggcccctacagagtggccggctacagctatggagcctgtgtggcctttgagatgtgcagccagctgcaggcccagcagagccctgcccccacccacaacagcctcttcctgtttgatggcagccccacctacgtgctggcctacacccagagctaccgggccaagctgaccccaggctgtgaggccgaggccgagacagaggccatctgcttctttgtgcagcagttcacagacatggagcacaacagagtgctggaggccctgctgcccctgaagggcctggaggagcgggtggccgctgctgtggacctgatcatcaagagccaccagggcctggaccggcaggagctgagctttgctgcccggagcttctactacaagctgcgggctgctgagcagtacacccccaaggccaagtaccacggcaatgtgatgctgctgcgggccaagacaggaggagcctacggggaggacctgggcgctgactacaacctgagccaggtgtgtgatggcaaggtgtctgtgcacgtgattgaaggagaccacaggaccctgctggagggcagcggcctggagagcatcatcagcatcatccacagcagcctggccgagccccgggtgtctgtgcgggagggctag

SEQ ID NO: 19664 - DNA, 2502 bp, Artificial Sequence
  Description of Artificial Sequence: Synthetic coding sequence
atgagcatcctgggcagcgccaagcacggcctgtacctgcccaccagggtgacagccatccacatcgaccctgccacccaccggcagaagctgtacaccctgcaggacaaggcccaggtggctgatgtggtggtgagccgctggctgcgggtgacagtggccggcggcgtgcacatcagcggcctgcacacagagagcgccccccggcggcagcaggagcagcaggtgcccatcctggagaagttctgcttcaccccccacacagaggagggctgcctgtctgaaagagctgccctgcaggaggagctgcagctgtgcaagggcctggtgcaggccctgcagaccaaggtgacccagcagggcctgaagatggtggtgcccggcctggatggagcccagatcccccgggaccccagccagcaggagctgccccggctgctgtctgctgcctgccgcctgcagctgaatggaaacctgcagctggagctggcccaggtgctggcccaggagcggcccaagctgcctgaggaccccctgctgagcggcctgctggacagccctgccctgaaggcctgcctggacacagctgtggagaacatgcccagcctgaagatgaaggtggtggaggtgctggccggccacggccacctgtacagccgcatccctggcctgctgagcccccaccccctgctgcagctgagctacacagccacagacagacacccccaggccctggaggccgcccaggccgagctgcagcagcatgatgtggcccagggccagtgggaccctgctgaccctgcccccagcgccctgggcagcgctgacctgctggtgtgcaactgtgctgtggccgccctgggggaccctgccagcgccctgagcaacatggtggccgccctgcgggagggcggcttcctgctgctgcacaccctgctgcggggccaccccctgggggacatcgtggccttcctgaccagcacagagccccagtatggccagggcatcctgagccaggatgcctgggagagcctcttcagccgggtgtccctgcggctggtgggcctgaagaagagcttctacggcagcaccctcttcctgtgcagaagacccaccccccaggacagccccatcttcctgcctgtggatgacaccagcttccgctgggtggagagcctgaagggcatcctggctgatgaggacagcagcaggcctgtgtggctgaaggccatcaactgtgccaccagcggcgtggtgggcctggtgaactgcctgcggcgggagcccggcggcaaccggctgcgctgtgtgctgctgagcaacctgagcagcaccagccacgtgcctgaggtggaccccggcagcgctgagctgcagaaggtgctgcagggcgacctggtgatgaatgtgtacagagatggagcctggggcgccttccgccacttcctgctggaggaggacaagccagaggagcccacagcccacgcctttgtgtccaccctgaccaggggggacctgagcagcatccgctgggtgtgcagcagcctgcggcatgcccagcccacctgccctggggcccagctgtgcaccgtgtactatgccagcctgaacttccgggacatcatgctggccaccgggaagctgagcccagatgccatccctgggaagtggaccagccaggacagcctgctgggcatggagttcagcggcagagatgccagcggcaagagggtgatgggcctggtgcctgccaagggcctggccacctctgtgctgctgagcccagacttcctgtgggatgtgcccagcaactggaccctggaggaggccgcctctgtgcctgtggtgtacagcacagcctactatgccctggtggtgcggggccgggtgcggcctggagagaccctgctgatccacagcggcagcggcggcgtgggccaggccgccatcgccatcgccctgagcctgggctgcagggtcttcaccaccgtgggcagcgctgagaagagggcctacctgcaggcccgcttcccccagctggacagcaccagctttgccaacagccgggacaccagctttgagcagcacgtgctgtggcacactggaggcaagggcgtggacctggtgctgaacagcctggccgaggagaagctgcaggcctctgtgcgctgcctggccacccacggccgcttcctggagatcggcaagtttgacctgagccagaaccaccccctgggcatggccatcttcctgaagaatgtgaccttccatggagtgctgctggatgccttcttcaatgaatcttctgctgactggagggaggtgtgggccctggtgcaggccggcatcagagatggagtggtgcggcccctgaagtgcaccgtcttccatggagcccaggtggaggatgccttccgctacatggcccaggccaaggccagccaggcctggccctgcagcggggcccccagcgccacctgggccttctggtggaggaggtag

SEQ ID NO: 19665 - DNA, 1143 bp, Artificial Sequence
  Description of Artificial Sequence: Synthetic coding sequence
atgatgttcagcggcttcaatgctgactatgaggccagcagcagccgctgcagcagcgccagccctgctggggacagcctgagctactaccacagccctgctgacagcttcagctccatgggcagccctgtgaatgcccaggacttctgcacagacctggccgtgtcctctgccaacttcatccccaccgtgacagccatcagcaccagcccagacctgcagtggctggtgcagcctgccctggtgtcctctgtggcccccagccagacccgggccccccaccccttcggcgtgcctgcccccagcgctggggcctacagcagagctggggtggtgaagaccatgactggaggccgggcccagagcattggaagaagaggcaaggtggagcagctgagccctgaggaggaggagaagaggcgcatcagaagagagaggaacaagatggctgctgccaagtgcaggaacagaagaagagagctgacagacaccctgcaggccgagacagaccagctggaggatgagaagagcgccctgcagacagaaattgccaacctgctgaaggagaaggagaagctggagttcatcctggccgcccacaggcctgcctgcaagatcccagatgacctgggcttccctgaggagatgtctgtggccagcctggacctgaccggcggcctgcctgaggtggccaccccagagagcgaggaggccttcaccctgcccctgctgaatgaccctgagcccaagcccagcgtggagcctgtgaagagcatcagctccatggagctgaagacagagccctttgatgacttcctgtttcctgccagcagccggcccagcggcagcgagacagcccggtctgtgcctgacatggacctgagcggcagcttctacgccgctgactgggagcccctgcacagcggcagcctgggcatgggccccatggccacagagctggagcccctgtgcacccctgtggtgacctgcacccccagctgcacagcctacaccagcagctttgtgttcacctacccagaggccgacagcttccccagctgtgccgccgcccacaggaagggcagcagcagcaatgagcccagcagtgacagcctgagcagccccaccctgctggccctgtag

SEQ ID NO: 19666 - DNA, 966 bp, Artificial Sequence
  Description of Artificial Sequence: Synthetic coding sequence
atggaggagggccagtacagcgagattgaggagctgccccggcggcgctgctgcagaagaggcacccagatcgtgctgctgggcctggtgacagctgccctgtgggccggcctgctgaccctgctgctgctgtggcactgggacaccacccagagcctgaagcagctggaggagcgggccgccagaaatgtgtcccaggtgtccaagaacctggagagccaccacggggaccagatggcccagaagagccagagcacccagatcagccaggagctggaggagctgcgggcagagcagcagaggctgaagagccaggacctggagctgtcctggaacctgaatggcctgcaggccgacctgagcagcttcaagagccaggagctgaatgaaagaaatgaggccagtgacctgctggagcggctgcgggaggaggtgaccaagctgaggatggagctgcaggtgagcagcggctttgtgtgcaacacctgcccagagaagtggatcaacttccagaggaagtgctactactttgggaagggcaccaagcagtgggtgcacgcccgctatgcctgtgatgacatggagggccagctggtgtccatccacagccctgaggagcaggacttcctgaccaagcacgccagccacacaggctcctggattggcctgaggaacctggacctgaagggggagttcatctgggtggatggcagccacgtggactacagcaactgggcccctggagagcccaccagccgcagccagggcgaggactgtgtgatgatgaggggcagcggccgctggaatgatgccttctgtgacaggaagctgggcgcctgggtgtgtgaccggctggccacctgcaccccaccagccagcgagggcagcgctgagagcatgggccctgacagcaggccagaccctgatggccgcctgcccacccccagcgcccccctgcacagctag

SEQ ID NO: 19667 - DNA, 963 bp, Artificial Sequence
  Description of Artificial Sequence: Synthetic coding sequence
atgaacccccccagccaggagattgaggagctgccccggcggcgctgctgccggcggggcacccagatcgtgctgctgggcctggtgacagctgccctgtgggccggcctgctgaccctgctgctgctgtggcactgggacaccacccagagcctgaagcagctggaggagagagctgccagaaatgtgtcccaggtgtccaagaacctggagagccaccacggggaccagatggcccagaagagccagagcacccagatcagccaggagctggaggagctgcgggcagagcagcagaggctgaagagccaggacctggagctgtcctggaacctgaatggcctgcaggccgacctgagcagcttcaagagccaggagctgaatgaaagaaatgaggccagtgacctgctggagcggctgcgggaggaggtgaccaagctgaggatggagctgcaggtgagcagcggctttgtgtgcaacacctgcccagagaagtggatcaacttccagaggaagtgctactactttgggaagggcaccaagcagtgggtgcacgcccgctatgcctgtgatgacatggagggccagctggtgtccatccacagccctgaggagcaggacttcctgaccaagcacgccagccacacaggctcctggattggcctgaggaacctggacctgaagggggagttcatctgggtggatggcagccacgtggactacagcaactgggcccctggagagcccaccagccgcagccagggcgaggactgtgtgatgatgaggggcagcggccgctggaatgatgccttctgtgacaggaagctgggcgcctgggtgtgtgaccggctggccacctgcaccccaccagccagcgagggcagcgctgagagcatgggccctgacagcaggccagaccctgatggccgcctgcccaccccatctgcccccctgcacagctag

SEQ ID NO: 19668 - DNA, 1125 bp, Artificial Sequence
  Description of Artificial Sequence: Synthetic coding sequence
atgtggttcctgaccaccctgctgctgtgggtgcctgtggatggccaggtggacaccaccaaggccgtcatcaccctgcagcccccctgggtgtctgtgttccaggaggagaccgtgaccctgcactgtgaggtgctgcacctgcccggcagcagcagcacccagtggttcctgaatggaacagccacccagaccagcacccccagctaccgcatcaccagcgcctctgtgaatgacagcggggagtaccgctgccagaggggcctgagcggccgcagtgaccccatccagctggagatccaccggggctggctgctgctgcaggtgagcagcagggtcttcacagaaggagagcccctggccctgcgctgccacgcctggaaggacaagctggtgtacaacgtgctgtactacagaaatggcaaggccttcaagttcttccactggaacagcaacctgaccatcctgaagaccaacatcagccacaacggcacctaccactgcagcggcatgggcaagcaccgctacaccagcgctggcatctctgtgacagtgaaggagctgtttcctgcccctgtgctgaatgcctctgtgaccagccccctgctggagggcaacctggtgaccctgagctgtgagaccaagctgctgctgcagaggcctggcctgcagctgtacttctccttctacatgggcagcaagaccctgcggggcaggaacaccagcagcgagtaccagatcctgacagccaggagagaagattctggcctgtactggtgtgaggccgccacagaagatggaaatgtgctgaagaggagccctgagctggagctgcaggtgctgggcctgcagctgcccacccctgtgtggttccacgtgctcttctacctggccgtgggcatcatgttcctggtgaacacagtgctgtgggtgaccatcaggaaggagctgaagaggaagaagaagtgggacctggagatcagcctggacagcggccacgagaagaaggtgatcagcagcctgcaggaggacagacacctggaggaggagctgaagtgccaggagcagaaggaggagcagctgcaggagggcgtgcacaggaaggagccccagggcgccacctag

SEQ ID NO: 19669 - DNA, 723 bp, Artificial Sequence
  Description of Artificial Sequence: Synthetic coding sequence
atgtggttcctgaccaccctgctgctgtggggctggctgctgctgcaggtgagcagcagggtcttcacagaaggagagcccctggccctgcgctgccacgcctggaaggacaagctggtgtacaacgtgctgtactacagaaatggcaaggccttcaagttcttccactggaacagcaacctgaccatcctgaagaccaacatcagccacaacggcacctaccactgcagcggcatgggcaagcaccgctacaccagcgctggcatctctgtgacagtgaaggagctgtttcctgcccctgtgctgaatgcctctgtgaccagccccctgctggagggcaacctggtgaccctgagctgtgagaccaagctgctgctgcagaggcctggcctgcagctgtacttctccttctacatgggcagcaagaccctgcggggcaggaacaccagcagcgagtaccagatcctgacagccaggagagaagattctggcctgtactggtgtgaggccgccacagaagatggaaatgtgctgaagaggagccctgagctggagctgcaggtgctgggcctgcagctgcccacccctgtgtggttccacgtgctcttctacctggccgtgggcatcatgttcctggtgaacacagtgctgtgggtgaccatcaggaaggagctgaagaggaagaagaagtgggacctggagatcagcctggacagcggctag

SEQ ID NO: 19670 - DNA, 2469 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagagctgggccgagatcaccagccagacagagggcctgagccggctgctgcggcagcacgccgaggacctgaacagcggccccctgagcaagctgagcctgctgatccgggagcggcagcagctgaggaagacctacagcgagcagtggcagcagctgcagcaggagctgaccaagacccacagccaggacatcgagaagctgaagagccagtaccgggccctggcccgggacagcgcccaggccaagaggaagtaccaggaggccagcaaggacaaggaccgggacaaggccaaggacaagtatgtgcgcagcctgtggaagctgtttgcccaccacaaccgctacgtgctgggcgtgcgggccgcccagctgcaccaccagcaccaccaccagctgctgctgcccggcctgctgcggagcctgcaggacctgcacgaggagatggcctgcatcctgaaggagatcctgcaggagtacctggagatcagcagcctggtgcaggatgaggtggtggccatccaccgggagatggctgctgctgctgcccgcatccagcctgaggccgagtaccagggcttcctgcggcagtatggcagcgccccagatgtgcccccctgtgtgacctttgatgagagcctgctggaggagggggagcccctggagcctggagagctgcagctgaatgagctgactgtggagagcgtgcagcacaccctgacctctgtgacagatgagctggccgtggccacagagatggtgttccggcggcaggagatggtgacccagctgcagcaggagctgagaaatgaggaggagaacacccacccccgggagcgggtgcagctgctgggcaagaggcaggtgctgcaggaggccctgcagggcctgcaggtggccctgtgcagccaggccaagctgcaggcccagcaggagctgctgcagaccaagctggagcacctgggccctggagagcccccacctgtgctgctgctgcaggatgacagacacagcaccagcagcagcgagcaggagcgggagggcggccgcacccccaccctggagatcctgaagagccacatcagcggcatcttccggcccaagttcagcctgcccccacccctgcagctgatccctgaggtgcagaagcccctgcacgagcagctgtggtaccacggggccatccccagggctgaggtggccgagctgctggtgcacagcggggacttcctggtgcgggagagccagggcaagcaggagtatgtgctgtctgtgctgtgggatggcctgcccaggcacttcatcatccagagcctggacaacctgtaccgcctggagggggagggcttccccagcatccccctgctgattgaccacctgctgagcacccagcagcccctgaccaagaagtctggagtggtgctgcacagagctgtgcccaaggacaagtgggtgctgaaccacgaggacctggtgctgggggagcagatcggccggggcaactttggagaggtgttttctggccgcctgcgggctgacaacaccctggtggccgtgaagagctgccgggagaccctgcccccagacctgaaggccaagttcctgcaggaggcccgcatcctgaagcagtacagccaccccaacatcgtgcggctgattggagtgtgcacccagaagcagcccatctacatcgtgatggagctggtgcagggcggggacttcctgaccttcctgaggacagagggcgcccggctgcgggtgaagaccctgctgcagatggtgggagatgctgctgctggcatggagtacctggagagcaagtgctgcatccaccgggacctggccgccaggaactgcctggtgacagagaagaatgtgctgaagatcagtgactttggcatgagccgggaggaggctgatggagtgtatgctgccagcggcggcctgcggcaggtgcctgtgaagtggacagcccctgaggccctgaactacggccgctacagcagcgagagtgatgtgtggagctttggcatcctgctgtgggagaccttcagcctgggcgccagcccctaccccaacctgagcaaccagcagacccgggagtttgtggagaagggcggccgcctgccctgcccagagctgtgcccagatgctgtgttccggctgatggagcagtgctgggcctatgagcccggccagaggcccagcttcagcaccatctaccaggagctgcagagcatcaggaagaggcacaggtag

SEQ ID NO: 19671 - DNA, 2295 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagacccacagccaggacatcgagaagctgaagagccagtaccgggccctggcccgggacagcgcccaggccaagaggaagtaccaggaggccagcaaggacaaggaccgggacaaggccaaggacaagtatgtgcgcagcctgtggaagctgtttgcccaccacaaccgctacgtgctgggcgtgcgggccgcccagctgcaccaccagcaccaccaccagctgctgctgcccggcctgctgcggagcctgcaggacctgcacgaggagatggcctgcatcctgaaggagatcctgcaggagtacctggagatcagcagcctggtgcaggatgaggtggtggccatccaccgggagatggctgctgctgctgcccgcatccagcctgaggccgagtaccagggcttcctgcggcagtatggcagcgccccagatgtgcccccctgtgtgacctttgatgagagcctgctggaggagggggagcccctggagcctggagagctgcagctgaatgagctgactgtggagagcgtgcagcacaccctgacctctgtgacagatgagctggccgtggccacagagatggtgttccggcggcaggagatggtgacccagctgcagcaggagctgagaaatgaggaggagaacacccacccccgggagcgggtgcagctgctgggcaagaggcaggtgctgcaggaggccctgcagggcctgcaggtggccctgtgcagccaggccaagctgcaggcccagcaggagctgctgcagaccaagctggagcacctgggccctggagagcccccacctgtgctgctgctgcaggatgacagacacagcaccagcagcagcgagcaggagcgggagggcggccgcacccccaccctggagatcctgaagagccacatcagcggcatcttccggcccaagttcagcctgcccccacccctgcagctgatccctgaggtgcagaagcccctgcacgagcagctgtggtaccacggggccatccccagggctgaggtggccgagctgctggtgcacagcggggacttcctggtgcgggagagccagggcaagcaggagtatgtgctgtctgtgctgtgggatggcctgcccaggcacttcatcatccagagcctggacaacctgtaccgcctggagggggagggcttccccagcatccccctgctgattgaccacctgctgagcacccagcagcccctgaccaagaagtctggagtggtgctgcacagagctgtgcccaaggacaagtgggtgctgaaccacgaggacctggtgctgggggagcagatcggccggggcaactttggagaggtgttttctggccgcctgcgggctgacaacaccctggtggccgtgaagagctgccgggagaccctgcccccagacctgaaggccaagttcctgcaggaggcccgcatcctgaagcagtacagccaccccaacatcgtgcggctgattggagtgtgcacccagaagcagcccatctacatcgtgatggagctggtgcagggcggggacttcctgaccttcctgaggacagagggcgcccggctgcgggtgaagaccctgctgcagatggtgggagatgctgctgctggcatggagtacctggagagcaagtgctgcatccaccgggacctggccgccaggaactgcctggtgacagagaagaatgtgctgaagatcagtgactttggcatgagccgggaggaggctgatggagtgtatgctgccagcggcggcctgcggcaggtgcctgtgaagtggacagcccctgaggccctgaactacggccgctacagcagcgagagtgatgtgtggagctttggcatcctgctgtgggagaccttcagcctgggcgccagcccctaccccaacctgagcaaccagcagacccgggagtttgtggagaagggcggccgcctgccctgcccagagctgtgcccagatgctgtgttccggctgatggagcagtgctgggcctatgagcccggccagaggcccagcttcagcaccatctaccaggagctgcagagcatcaggaagaggcacaggtag

SEQ ID NO: 19672 - DNA, 2046 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagacccacagccaggacatcgagaagctgaagagccagtaccgggccctggcccgggacagcgcccaggccaagaggaagtaccaggaggccagcaaggacaaggaccgggacaaggccaaggacaagtatgtgcgcagcctgtggaagctgtttgcccaccacaaccgctacgtgctgggcgtgcgggccgcccagctgcaccaccagcaccaccaccagctgctgctgcccggcctgctgcggagcctgcaggacctgcacgaggagatggcctgcatcctgaaggagatcctgcaggagtacctggagatcagcagcctggtgcaggatgaggtggtggccatccaccgggagatggctgctgctgctgcccgcatccagcctgaggccgagtaccagggcttcctgcggcagtatggcagcgccccagatgtgcccccctgtgtgacctttgatgagagcctgctggaggagggggagcccctggagcctggagagctgcagctgaatgagctgactgtggagagcgtgcagcacaccctgacctctgtgacagatgagctggccgtggccacagagatggtgttccggcggcaggagatggtgacccagctgcagcaggagctgagaaatgaggaggagaacacccacccccgggagcgggtgcagctgctgggcaagaggcaggtgctgcaggaggccctgcagggcctgcaggtggccctgtgcagccaggccaagctgcaggcccagcaggagctgctgcagaccaagctggagcacctgggccctggagagcccccacctgtgctgctgctgcaggatgacagacacagcaccagcagcagcgagcaggagcgggagggcggccgcacccccaccctggagatcctgaagagccacatcagcggcatcttccggcccaagttcagcaacctgtaccgcctggagggggagggcttccccagcatccccctgctgattgaccacctgctgagcacccagcagcccctgaccaagaagtctggagtggtgctgcacagagctgtgcccaaggacaagtgggtgctgaaccacgaggacctggtgctgggggagcagatcggccggggcaactttggagaggtgttttctggccgcctgcgggctgacaacaccctggtggccgtgaagagctgccgggagaccctgcccccagacctgaaggccaagttcctgcaggaggcccggagcagccccagcaccagctcctggagcctgtgccggggcagcagccccccagctggaggagacttcctgaccttcctgaggacagaaggagcccggctgcgggtgaagaccctgctgcagatggtgggagatgctgctgctggcatggagtacctggagagcaagtgctgcatccaccgggacctggccgccaggaactgcctggtgacagagaagaatgtgctgaagatcagtgactttggcatgagccgggaggaggctgatggagtgtatgctgccagcggcggcctgcggcaggtgcctgtgaagtggacagcccctgaggccctgaactacggccgctacagcagcgagagtgatgtgtggagctttggcatcctgctgtgggagaccttcagcctgggcgccagcccctaccccaacctgagcaaccagcagacccgggagtttgtggagaagggcggccgcctgccctgcccagagctgtgcccagatgctgtgttccggctgatggagcagtgctgggcctatgagcccggccagaggcccagcttcagcaccatctaccaggagctgcagagcatcaggaagaggcacaggtag

SEQ ID NO: 19673 - DNA, 2085 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagacccacagccaggacatcgagaagctgaagagccagtaccgggccctggcccgggacagcgcccaggccaagaggaagtaccaggaggccagcaaggacaaggaccgggacaaggccaaggacaagtatgtgcgcagcctgtggaagctgtttgcccaccacaaccgctacgtgctgggcgtgcgggccgcccagctgcaccaccagcaccaccaccagctgctgctgcccggcctgctgcggagcctgcaggacctgcacgaggagatggcctgcatcctgaaggagatcctgcaggagtacctggagatcagcagcctggtgcaggatgaggtggtggccatccaccgggagatggctgctgctgctgcccgcatccagcctgaggccgagtaccagggcttcctgcggcagtatggcagcgccccagatgtgcccccctgtgtgacctttgatgagagcctgctggaggagggggagcccctggagcctggagagctgcagctgaatgagctgactgtggagagcgtgcagcacaccctgacctctgtgacagatgagctggccgtggccacagagatggtgttccggcggcaggagatggtgacccagctgcagcaggagctgagaaatgaggaggagaacacccacccccgggagcgggtgcagctgctgggcaagaggcaggtgctgcaggaggccctgcagggcctgcaggtggccctgtgcagccaggccaagctgcaggcccagcaggagctgctgcagaccaagctggagcacctgggccctggagagcccccacctgtgctgctgctgcaggatgacagacacagcaccagcagcagcgagcaggagcgggagggcggccgcacccccaccctggagatcctgaagagccacatcagcggcatcttccggcccaagttcagcaacctgtaccgcctggagggggagggcttccccagcatccccctgctgattgaccacctgctgagcacccagcagcccctgaccaagaagtctggagtggtgctgcacagagctgtgcccaaggacaagtgggtgctgaaccacgaggacctggtgctgggggagcagatcggccggggcaactttggagaggtgttttctggccgcctgcgggctgacaacaccctggtggccgtgaagagctgccgggagaccctgcccccagacctgaaggccaagttcctgcaggaggcccgcatcctgaagcagtacagccaccccaacatcgtgcggctgattggagtgtgcacccagaagcagcccatctacatcgtgatggagctggtgcagggcggggacttcctgaccttcctgaggacagagggcgcccggctgcgggtgaagaccctgctgcagatggtgggagatgctgctgctggcatggagtacctggagagcaagtgctgcatccaccgggacctggccgccaggaactgcctggtgacagagaagaatgtgctgaagatcagtgactttggcatgagccgggaggaggctgatggagtgtatgctgccagcggcggcctgcggcaggtgcctgtgaagtggacagcccctgaggccctgaactacggccgctacagcagcgagagtgatgtgtggagctttggcatcctgctgtgggagaccttcagcctgggcgccagcccctaccccaacctgagcaaccagcagacccgggagtttgtggagaagggcggccgcctgccctgcccagagctgtgcccagatgctgtgttccggctgatggagcagtgctgggcctatgagcccggccagaggcccagcttcagcaccatctaccaggagctgcagagcatcaggaagaggcacaggtag

SEQ ID NO: 19674 - DNA, 129 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgacagatag

SEQ ID NO: 19675 - DNA, 348 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagagctgggccgagatcaccagccagacagagggcctgagccggctgctgcggcagcacgccgaggacctgaacagcggccccctgagcaagctgagcctgctgatccgggagcggcagcagctgaggaagacctag

SEQ ID NO: 19676 - DNA, 2259 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagagctgggccgagatcaccagccagacagagggcctgagccggctgctgcggcagcacgccgaggacctgaacagcggccccctgagcaagctgagcctgctgatccgggagcggcagcagctgaggaagacctacagcgagcagtggcagcagctgcagcaggagctgaccaagacccacagccaggacatcgagaagctgaagagccagtaccgggccctggcccgggacagcgcccaggccaagaggaagtaccaggaggccagcaaggacaaggaccgggacaaggccaaggacaagtatgtgcgcagcctgtggaagctgtttgcccaccacaaccgctacgtgctgggcgtgcgggccgcccagctgcaccaccagcaccaccaccagctgctgctgcccggcctgctgcggagcctgcaggacctgcacgaggagatggcctgcatcctgaaggagatcctgcaggagtacctggagatcagcagcctggtgcaggatgaggtggtggccatccaccgggagatggctgctgctgctgcccgcatccagcctgaggccgagtaccagggcttcctgcggcagtatggcagcgccccagatgtgcccccctgtgtgacctttgatgagagcctgctggaggagggggagcccctggagcctggagagctgcagctgaatgagctgactgtggagagcgtgcagcacaccctgacctctgtgacagatgagctggccgtggccacagagatggtgttccggcggcaggagatggtgacccagctgcagcaggagctgagaaatgaggaggagaacacccacccccgggagcgggtgcagctgctgggcaagaggcaggtgctgcaggaggccctgcagggcctgcaggtggccctgtgcagccaggccaagctgcaggcccagcaggagctgctgcagaccaagctggagcacctgggccctggagagcccccacctgtgctgctgctgcaggatgacagacacagcaccagcagcagcgagcaggagcgggagggcggccgcacccccaccctggagatcctgaagagccacatcagcggcatcttccggcccaagttcagcaacctgtaccgcctggagggggagggcttccccagcatccccctgctgattgaccacctgctgagcacccagcagcccctgaccaagaagtctggagtggtgctgcacagagctgtgcccaaggacaagtgggtgctgaaccacgaggacctggtgctgggggagcagatcggccggggcaactttggagaggtgttttctggccgcctgcgggctgacaacaccctggtggccgtgaagagctgccgggagaccctgcccccagacctgaaggccaagttcctgcaggaggcccgcatcctgaagcagtacagccaccccaacatcgtgcggctgattggagtgtgcacccagaagcagcccatctacatcgtgatggagctggtgcagggcggggacttcctgaccttcctgaggacagagggcgcccggctgcgggtgaagaccctgctgcagatggtgggagatgctgctgctggcatggagtacctggagagcaagtgctgcatccaccgggacctggccgccaggaactgcctggtgacagagaagaatgtgctgaagatcagtgactttggcatgagccgggaggaggctgatggagtgtatgctgccagcggcggcctgcggcaggtgcctgtgaagtggacagcccctgaggccctgaactacggccgctacagcagcgagagtgatgtgtggagctttggcatcctgctgtgggagaccttcagcctgggcgccagcccctaccccaacctgagcaaccagcagacccgggagtttgtggagaagggcggccgcctgccctgcccagagctgtgcccagatgctgtgttccggctgatggagcagtgctgggcctatgagcccggccagaggcccagcttcagcaccatctaccaggagctgcagagcatcaggaagaggcacaggtag

SEQ ID NO: 19677 - DNA, 2085 bp, Artificial Sequence; identical to SEQ ID NO: 19673
  Description of Artificial Sequence: Synthetic coding sequence

SEQ ID NO: 19678 - DNA, 444 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagagctgggccgagatcaccagccagacagagggcctgagccggctgctgcggcagcacgccgaggacctgaacagcggccccctgagcaagctgagcctgctgatccgggagcggcagcagctgaggaagacctacagcgagcagtggcagcagctgcagcaggagctgaccaagacccacagccaggacatcgagaagctgaagagccagtaccgggccctggccaggtag

SEQ ID NO: 19679 - DNA, 1638 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagagctgggccgagatcaccagccagacagagggcctgagccggctgctgcggcagcacgccgaggacctgaacagcggccccctgagcaagctgagcctgctgatccgggagcggcagcagctgaggaagacctacagcgagcagtggcagcagctgcagcaggagctgaccaagacccacagccaggacatcgagaagctgaagagccagtaccgggccctggcccgggacagcgcccaggccaagaggaagtaccaggaggccagcaaggacaaggaccgggacaaggccaaggacaagtatgtgcgcagcctgtggaagctgtttgcccaccacaaccgctacgtgctgggcgtgcgggccgcccagctgcaccaccagcaccaccaccagctgctgctgcccggcctgctgcggagcctgcaggacctgcacgaggagatggcctgcatcctgaaggagatcctgcaggagtacctggagatcagcagcctggtgcaggatgaggtggtggccatccaccgggagatggctgctgctgctgcccgcatccagcctgaggccgagtaccagggcttcctgcggcagtatggcagcgccccagatgtgcccccctgtgtgacctttgatgagagcctgctggaggagggggagcccctggagcctggagagctgcagctgaatgagctgactgtggagagcgtgcagcacaccctgacctctgtgacagatgagctggccgtggccacagagatggtgttccggcggcaggagatggtgacccagctgcagcaggagctgagaaatgaggaggagaacacccacccccgggagcgggtgcagctgctgggcaagaggcaggtgctgcaggaggccctgcagggcctgcaggtggccctgtgcagccaggccaagctgcaggcccagcaggagctgctgcagaccaagctggagcacctgggccctggagagcccccacctgtgctgctgctgcaggatgacagacacagcaccagcagcagcgagcaggagcgggagggcggccgcacccccaccctggagatcctgaagagccacatcagcggcatcttccggcccaagttcagcctgcccccacccctgcagctgatccctgaggtgcagaagcccctgcacgagcagctgtggtaccacggggccatccccagggctgaggtggccgagctgctggtgcacagcggggacttcctggtgcgggagagccagggcaagcaggagtatgtgctgtctgtgctgtgggatggcctgcccaggcacttcatcatccaggcccacgcccccagcgagtggaggctgctgaccccaggccccctgccctgcaggacctgcacagactggaagggcaaggccttcctggccttcctgtgcagcagcaccacctactag

SEQ ID NO: 19680 - DNA, 366 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccaggtgggcctgtatggcaccctggtgggcgccggctgcatctgcctgctgctgcccctgctgggcgccctgtggggcagcggctggaggagcggccggcccatgctgggcagccactgtgcccccctgcctgccagccccatctgtgctgtgtag

SEQ ID NO: 19681 - DNA, 510 bp, Artificial Sequence
  Description of Artificial Sequence: Synthetic coding sequence
atgggcttcagcagcgagctgtgcagcccccagggccatggagtgctgcagcagatgcaggaggccgagctgcggctgctggagggcatgaggaagtggatggcccagagggtgaagagtgaccgggagtatgccggcctgctgcaccacatgagcctgcaggacagcggcggccagagccgggccatcagcccagacagccccatcagccagagctgggccgagatcaccagccagacagagggcctgagccggctgctgcggcagcacgccgaggacctgaacagcggccccctgagcaagctgagcctgctgatccgggagcggcagcagctgaggaagacctacagcgagcagtggcagcagctgcagcaggagctgaccaagacccacagccaggacatcgagaagctgaagagccagtaccgggccctggcccgggacagcgcccaggccaagaggaagtaccaggaggccagcaaggacaaggaccgggacaaggccaagtag

SEQ ID NO: 19682 - DNA, 2283 bp, Artificial Sequence
  Description of Artificial Sequence: Synthetic coding sequence
atgaagacctgggtgaagatcgtgtttggagtggccaccagcgctgtgctggccctgctggtgatgtgcatcgtgctgcggcccagccgggtgcacaacagcgaggagaacaccatgagggccctgaccctgaaggacatcctgaatggcaccttctcctacaagaccttcttccccaactggatcagcggccaggagtacctgcaccagagcgctgacaacaacatcgtgctgtacaacattgaaacaggccagagctacaccatcctgagcaacagaaccatgaagtctgtgaatgccagcaactacggcctgagcccagaccggcagtttgtgtacctggagagtgactacagcaagctgtggagatacagctacacagccacctactacatctatgacctgagcaatggagaatttgtgagaggaaatgagctgccccggcccatccagtacctgtgctggagccctgtgggcagcaagctggcctacgtgtaccagaacaacatctacctgaagcagaggcctggggacccccccttccagatcaccttcaacggccgggagaacaagatcttcaacggcatcccagactgggtgtatgaggaggagatgctggccaccaagtatgccctgtggtggagccccaacgggaagttcctggcctatgcagagttcaatgacacagacatccctgtgattgcctacagctactatggagatgagcagtaccccaggaccatcaacatcccctaccccaaggccggggccaagaaccctgtggtgcgcatcttcatcatcgacaccacctacccagcctacgtgggcccccaggaggtgcctgtgcctgccatgattgccagcagtgactactacttctcctggctgacctgggtgacagatgagcgggtgtgcctgcagtggctgaagagggtgcagaatgtgtctgtgctgagcatctgtgacttccgggaggactggcagacctgggactgccccaagacccaggagcacatcgaggagagcaggacaggctgggccggcggcttctttgtgtccacccctgtgttctcctatgatgccatctcctactacaagatcttcagtgacaaggatggctacaagcacatccactacatcaaggacacagtggagaatgccatccagatcaccagcggcaagtgggaggccatcaacatcttccgggtgacccaggacagcctcttctacagcagcaatgaatttgaggagtacccaggaagaagaaacatctaccgcatcagcatcggcagctacccacccagcaagaagtgtgtgacctgccacctgaggaaggagcgctgccagtactacacagccagcttcagtgactatgccaagtactatgccctggtgtgctacggccctggcatccccatcagcaccctgcatgatggccgcacagaccaggagatcaagatcctggaggagaacaaggagctggagaatgccctgaagaacatccagctgcccaaggaggagatcaagaagctggaggtggatgagatcaccctgtggtacaagatgatcctgcccccccagtttgacaggagcaagaagtaccccctgctgatccaggtgtatggaggcccctgcagccagagcgtgcgctctgtgtttgctgtgaactggatctcctacctggccagcaaggagggcatggtgattgccctggtggatggccggggcacagccttccagggcgacaagctgctgtatgctgtgtacaggaagctgggcgtgtatgaggtggaggaccagatcacagctgtgaggaagttcatcgagatgggcttcattgatgagaagagaattgccatctggggctggagctatggaggctacgtgagcagcctggccctggccagcggcaccggcctcttcaagtgtggcattgctgtggcccctgtgtcctcctgggagtactatgcctctgtgtacacagagcgcttcatgggcctgcccaccaaggatgacaacctggagcactacaagaacagcacagtgatggcccgggcagagtacttcagaaatgtggactacctgctgatccacggcacagcagatgacaacgtgcacttccagaacagcgcccagatcgccaaggccctggtgaatgcccaggtggacttccaggccatgtggtacagcgaccagaaccacggcctgagcggcctgagcaccaaccacctgtacacccacatgacccacttcctgaagcagtgcttcagcctgagtgactag

SEQ ID NO: 19683 - DNA, 2208 bp, Artificial Sequence
  Description of Artificial Sequence: Synthetic coding sequence
atgaagacctgggtgaagatcgtgtttggagtggccaccagcgctgtgctggccctgctggtgatgtgcatcgtgctgcggcccagccgggtgcacaacagcgaggagaacaccatgagggccctgaccctgaaggacatcctgaatggcaccttctcctacaagaccttcttccccaactggatcagcggccaggagtacctgcaccagagcgctgacaacaacatcgtgctgtacaacattgaaacaggccagagctacaccatcctgagcaacagaaccatgctgtggagatacagctacacagccacctactacatctatgacctgagcaatggagaatttgtgagaggaaatgagctgccccggcccatccagtacctgtgctggagccctgtgggcagcaagctggcctacgtgtaccagaacaacatctacctgaagcagaggcctggggacccccccttccagatcaccttcaacggccgggagaacaagatcttcaacggcatcccagactgggtgtatgaggaggagatgctggccaccaagtatgccctgtggtggagccccaacgggaagttcctggcctatgcagagttcaatgacacagacatccctgtgattgcctacagctactatggagatgagcagtaccccaggaccatcaacatcccctaccccaaggccggggccaagaaccctgtggtgcgcatcttcatcatcgacaccacctacccagcctacgtgggcccccaggaggtgcctgtgcctgccatgattgccagcagtgactactacttctcctggctgacctgggtgacagatgagcgggtgtgcctgcagtggctgaagagggtgcagaatgtgtctgtgctgagcatctgtgacttccgggaggactggcagacctgggactgccccaagacccaggagcacatcgaggagagcaggacaggctgggccggcggcttctttgtgtccacccctgtgttctcctatgatgccatctcctactacaagatcttcagtgacaaggatggctacaagcacatccactacatcaaggacacagtggagaatgccatccagatcaccagcggcaagtgggaggccatcaacatcttccgggtgacccaggacagcctcttctacagcagcaatgaatttgaggagtacccaggaagaagaaacatctaccgcatcagcatcggcagctacccacccagcaagaagtgtgtgacctgccacctgaggaaggagcgctgccagtactacacagccagcttcagtgactatgccaagtactatgccctggtgtgctacggccctggcatccccatcagcaccctgcatgatggccgcacagaccaggagatcaagatcctggaggagaacaaggagctggagaatgccctgaagaacatccagctgcccaaggaggagatcaagaagctggaggtggatgagatcaccctgtggtacaagatgatcctgcccccccagtttgacaggagcaagaagtaccccctgctgatccaggtgtatggaggcccctgcagccagagcgtgcgctctgtgtttgctgtgaactggatctcctacctggccagcaaggagggcatggtgattgccctggtggatggccggggcacagccttccagggcgacaagctgctgtatgctgtgtacaggaagctgggcgtgtatgaggtggaggaccagatcacagctgtgaggaagttcatcgagatgggcttcattgatgagaagagaattgccatctggggctggagctatggaggctacgtgagcagcctggccctggccagcggcaccggcctcttcaagtgtggcattgctgtggcccctgtgtcctcctgggagtactatgcctctgtgtacacagagcgcttcatgggcctgcccaccaaggatgacaacctggagcactacaagaacagcacagtgatggcccgggcagagtacttcagaaatgtggactacctgctgattcatggaacagcagatgacaacgtgcacttccagaacagcgcccagatcgccaaggccctggtgaatgcccaggtggacttccaggccatgtggtacagcgaccagaaccacggcctgagcggcctgagcaccaaccacctgtacacccacatgacccacttcctgaagcagtgcttcagcctgagtgactag

SEQ ID NO: 19684 - DNA, 468 bp, Artificial Sequence
  Description of Artificial Sequence: Synthetic coding sequence
atggccgagggggagatcaccaccttcaccgccctgacagagaagttcaacctgcccccaggcaactacaagaagcccaagctgctgtactgcagcaatggaggccacttcctgcgcatcctgcctgatggcaccgtggatggcacccgggacagaagtgaccagcacatccagctgcagctgtctgctgagagcgtgggggaggtgtacatcaagagcacagagaccggccagtacctggccatggacacagatggcctgctgtatggcagccagaccccaaatgaagaatgtctcttcctggagcggctggaggagaaccactacaacacctacatcagcaagaagcacgccgagaagaactggtttgtgggcctgaagaagaatggcagctgcaagaggggccccaggacccactacggccagaaggccatcctcttcctgcccctgcctgtgtccagtgactag

SEQ ID NO: 19685 - DNA, 468 bp, Artificial Sequence; identical to SEQ ID NO: 19684
  Description of Artificial Sequence: Synthetic coding sequence

SEQ ID NO: 19686 - DNA, 468 bp, Artificial Sequence; identical to SEQ ID NO: 19684
  Description of Artificial Sequence: Synthetic coding sequence

SEQ ID NO: 19687 - DNA, 177 bp, Artificial Sequence
  Description of Artificial Sequence: Synthetic coding sequence
atggccgagggggagatcaccaccttcaccgccctgacagagaagttcaacctgcccccaggcaactacaagaagcccaagctgctgtactgcagcaatggaggccacttcctgcgcatcctgcctgatggcaccgtggatggcacccgggacagaagtgaccagcacatccagtag

SEQ ID NO: 19688 - DNA, 126 bp, Artificial Sequence
  Description of Artificial Sequence: Synthetic coding sequence
atggccgagggggagatcaccaccttcaccgccctgacagagaagttcaacctgcccccaggcaactacaagaagcccaagctgctgtactgcagcaatggaggccacttcctgcgcatcctgtag

SEQ ID NO: 19689 - DNA, 468 bp, Artificial Sequence; identical to SEQ ID NO: 19684
  Description of Artificial Sequence: Synthetic coding sequence

SEQ ID NO: 19690 - DNA, 468 bp, Artificial Sequence; identical to SEQ ID NO: 19684
  Description of Artificial Sequence: Synthetic coding sequence

SEQ ID NO: 19691 - DNA, 183 bp, Artificial Sequence
  Description of Artificial Sequence: Synthetic coding sequence
atggccgagggggagatcaccaccttcaccgccctgacagagaagttcaacctgcccccaggcaactacaagaagcccaagctgctgtactgcagcaatggaggccacttcctgcgcatcctgcctgatggcaccgtggatggcacccgggacagaagtgaccagcacacagacaccaagtag

SEQ ID NO: 19692 - DNA, 627 bp, Artificial Sequence
  Description of Artificial Sequence: Synthetic coding sequence
atgtggaagtggatcctgacccactgtgccagcgccttcccccacctgcccggctgctgctgctgctgcttcctgctgctcttcctggtgtcctctgtgcctgtgacctgccaggccctgggccaggacatggtgtccccagaggccaccaacagcagcagcagcagcttcagcagccccagcagcgctggccgccacgtgcgcagctacaaccacctgcagggagatgtgcgctggaggaagctgttctccttcaccaagtacttcctgaagattgagaagaatggcaaggtgtctggcaccaagaaggagaactgcccctacagcatcctggagatcacctctgtggagattggagtggtggccgtgaaggccatcaacagcaactactacctggccatgaacaagaagggcaagctgtatggcagcaaggagttcaacaatgactgcaagctgaaggagcgcatcgaggagaatggctacaacacctacgccagcttcaactggcagcacaacggccggcagatgtatgtggccctgaatggaaaaggagccccccggcggggccagaagaccaggaggaagaacaccagcgcccacttcctgcccatggtggtgcacagctag

SEQ ID NO: 19693 - DNA, 201 bp, Artificial Sequence
  Description of Artificial Sequence: Synthetic coding sequence
atgtggaagtggatcctgacccactgtgccagcgccttcccccacctgcccggctgctgctgctgctgcttcctgctgctcttcctggtgtcctctgtgcctgtgacctgccaggccctgggccaggacatggtgtccccagaggccaccaacagcagcagcagcagcttcagcagccccagcagcgctggccgccactag

SEQ ID NO: 19694 - DNA, 867 bp, Artificial Sequence
  Description of Artificial Sequence: Synthetic coding sequence
ctggtgggcgtgggcggcggagatgtggaggatgtgacccccaggcctgggggctgccagatcagcggccgcggggcccggggctgcaatggcatccctggagctgctgcctgggaggccgccctgcccaggagaagaccccggcggcaccccagcgtgaaccccaggagcagagctgctggcagccccaggacccggggccgcaggacagaggagcggcccagcggcagccggctgggggaccggggccggggccgggccctgcccggcggccgcctgggcggccggggccggggccgggcccctgagcgggtgggcggccggggccggggccggggcacagctgcccccagggctgccccagctgcccggggcagccggcccggccctgctggcaccatggccgccggcagcatcaccaccctgcctgccctgcctgaagatggcggcagcggggccttccccccaggccacttcaaggaccccaagaggctgtactgcaagaatggaggcttcttcctgcgcatccacccagatggccgggtggatggagtgcgggagaagagtgacccccacatcaagctgcagctgcaggccgaggagcggggcgtggtgtccatcaagggcgtgtgtgccaaccgctacctggccatgaaggaggatggccgcctgctggccagcaaatgtgtgacagatgagtgcttcttctttgagcggctggagagcaacaactacaacacctaccgcagcaggaagtacacctcctggtacgtggccctgaagaggacaggccagtacaagctgggcagcaagacaggccctggccagaaggccatcctcttcctgcccatgtctgccaagagctag

SEQ ID NO: 19695 - DNA, 585 bp, Artificial Sequence
  Description of Artificial Sequence: Synthetic coding sequence
atgcacaagtggatcctgacctggatcctgcccaccctgctgtaccgcagctgcttccacatcatctgcctggtgggcaccatcagcctggcctgcaatgacatgaccccagagcagatggccaccaacgtgaactgcagcagccctgagcggcacaccaggagctatgactacatggagggcggggacatccgggtgagaagactcttctgcaggacccagtggtacctgagaattgacaagaggggcaaggtgaagggcacccaggagatgaagaacaactacaacatcatggagatcagaacagtggccgtgggcatcgtggccatcaagggcgtggagagcgagttctacctggccatgaacaaggagggcaagctgtatgccaagaaggagtgcaatgaagactgcaacttcaaggagctgatcctggagaaccactacaacacctacgccagcgccaagtggacccacaatggaggagagatgtttgtggccctgaaccagaagggcatccctgtgcggggcaagaagaccaagaaggagcagaagacagcccacttcctgcccatggccatcacctag

SEQ ID NO: 19696 - DNA, 585 bp, Artificial Sequence; identical to SEQ ID NO: 19695
  Description of Artificial Sequence: Synthetic coding sequence

SEQ ID NO: 19697 - DNA, 705 bp, Artificial Sequence
  Description of Artificial Sequence: Synthetic coding sequence
atgaagatctgcagcctgaccctgctgtccttcctgctgctggccgcccaggtgctgctggtggagggcaagaagaaggtgaagaatggcctgcacagcaaggtggtgtctgagcagaaggacaccctgggcaacacccagatcaagcagaagagccggcccggcaacaagggcaagtttgtgaccaaggaccaggccaactgccgctgggccgccacagagcaggaggagggcatcagcctgaaggtggagtgcacccagctggaccacgagttcagctgtgtgtttgctggcaaccccaccagctgcctgaagctgaaggatgagcgggtgtactggaagcaggtggccaggaacctgcggagccagaaggacatctgccgctacagcaagacagctgtgaagaccagggtgtgcaggaaggacttccctgagagcagcctgaagctggtgagcagcaccctgtttggaaacaccaagcccaggaaggagaagacagagatgagcccccgggagcacatcaagggcaaggagaccacccccagcagcctggccgtgacccagaccatggccaccaaggccccagaatgtgtggaggaccctgacatggccaaccagaggaagacagccctggagttctgtggggagacctggagcagcctgtgcaccttcttcctgagcatcgtgcaggacaccagctgctag

SEQ ID NO: 19698 - DNA, 705 bp, Artificial Sequence; identical to SEQ ID NO: 19697
  Description of Artificial Sequence: Synthetic coding sequence

SEQ ID NO: 19699 - DNA, 2421 bp, Artificial Sequence
  Description of Artificial Sequence: Synthetic coding sequence
atgggcgccccagcctgtgccctggccctgtgtgtggccgtggccatcgtggccggggccagcagcgagagcctgggcacagagcagagggtggtgggccgggctgctgaggtgcccggccctgagcccggccagcaggagcagctggtgtttggaagtggagatgctgtggagctgagctgccccccacctgggggcggccccatgggccccaccgtgtgggtgaaggatggcaccggcctggtgcccagcgagcgggtgctggtgggcccccagaggctgcaggtgctgaatgccagccatgaggacagcggggcctacagctgccggcagaggctgacccagagggtgctgtgccacttctctgtgcgggtgacagatgcccccagcagtggagatgatgaagatggagaagatgaagctgaggacaccggggtggacaccggggccccctactggaccaggcctgagaggatggacaagaagctgctggccgtgcctgctgccaacacagtgcgcttccgctgcccagctgctggcaaccccacccccagcatctcctggctgaagaatggccgggagttccggggggagcacagaattggaggcatcaagctgcggcaccagcagtggagcctggtgatggagagcgtggtgcccagcgaccggggcaactacacctgtgtggtggagaacaagtttggcagcatccggcagacctacaccctggatgtgctggagaggagcccccaccggcccatcctgcaggccggcctgcctgccaaccagacagctgtgctgggcagtgatgtggagttccactgcaaggtgtacagtgatgcccagccccacatccagtggctgaagcacgtggaggtgaatggcagcaaggtgggcccagatggcaccccctacgtgacagtgctgaagacagctggggccaacaccacagacaaggagctggaggtgctgagcctgcacaacgtgacctttgaagatgctggggagtacacctgcctggccggcaacagcatcggcttcagccaccacagcgcctggctggtggtgctgcctgctgaggaggagctggtggaggctgatgaagctggctctgtgtatgccggcatcctgtcctatggagtgggcttcttcctgttcatcctggtggtggccgctgtgaccctgtgccgcctgcggagcccccccaagaagggcctgggcagccccaccgtgcacaagatcagccgcttccccctgaagaggcaggtgtccctggagagcaatgcctccatgagcagcaacacccccctggtgcgcatcgcccggctgagcagtggagagggccccaccctggccaacgtgtctgagctggagctgcctgctgaccccaagtgggagctgagccgggcccggctgaccctgggcaagcccctgggggagggctgcttcggccaggtggtgatggccgaggccatcggcatcgacaaggacagagctgccaagcctgtgacagtggccgtgaagatgctgaaggatgatgccacagacaaggacctgagtgacctggtgtctgagatggagatgatgaagatgattggcaagcacaagaacatcatcaacctgctgggcgcctgcacccagggcggccccctgtatgtgctggtggagtatgctgccaagggcaacctgcgggagttcctgcgggcccggcggcccccaggcctggactacagctttgacacctgcaagcccccagaggagcagctgaccttcaaggacctggtgtcctgtgcctaccaggtggcccggggcatggagtacctggccagccagaagtgcatccaccgggacctggccgccagaaatgtgctggtgacagaagataatgtgatgaagattgctgactttggcctggccagagatgtgcacaacctggactactacaagaagaccaccaacggccgcctgcctgtgaagtggatggcccctgaggccctgtttgacagagtgtacacccaccagagtgatgtgtggagctttggagtgctgctgtgggagatcttcaccctgggcggcagcccctacccaggcatccctgtggaggagctgttcaagctgctgaaggagggccacaggatggacaagccagccaactgcacccatgacctgtacatgatcatgagggagtgctggcatgctgcccccagccagaggcccaccttcaagcagctggtggaggacctggacagagtgctgactgtgaccagcacagatgagtacctggacctgagcgccccctttgagcagtacagccctgggggccaggacacccccagcagcagcagcagtggagatgattctgtgtttgcccatgacctgctgcccccagccccacccagcagcggcggcagcaggacatag

SEQ ID NO: 19700 - DNA, 513 bp, Artificial Sequence
  Description of Artificial Sequence: Synthetic coding sequence
gagtacctggacctgagcgccccctttgagcagtacagccctgggggccaggacacccccagcagcagcagcagtggagatgattctgtgtttgcccatgacctgctggccaccggcccccagcagtgtgagggcagcctggccgcccaccctgctgctggggcccagcccctgcccggcatgaggctgtctgcagatggagaaacagccacccagagctttggcctgtgtgtgtgtgtgtgtgtgtgtgtgtgctgcaccagcgcctgtgcctgtgtgcgggcccacctggccagccgctgccggggcaccctgggcgtgcctgctgctgtgcagaggagcccagactggtgctgcagcacagagggccccctcttctggggagaccctgtgcagaatgtgtctggccccacccgctgggaccccggccagggcgccggccctgacatgaggcccctgcccctgcaccacggcaccagccagggcctgggccccagccacacccagagctag

SEQ ID NO: 19701 - DNA, 2427 bp, Artificial Sequence
  Description of Artificial Sequence: Synthetic coding sequence
atgggcgccccagcctgtgccctggccctgtgtgtggccgtggccatcgtggccggggccagcagcgagagcctgggcacagagcagagggtggtgggccgggctgctgaggtgcccggccctgagcccggccagcaggagcagctggtgtttggaagtggagatgctgtggagctgagctgccccccacctgggggcggccccatgggccccaccgtgtgggtgaaggatggcaccggcctggtgcccagcgagcgggtgctggtgggcccccagaggctgcaggtgctgaatgccagccatgaggacagcggggcctacagctgccggcagaggctgacccagagggtgctgtgccacttctctgtgcgggtgacagatgcccccagcagtggagatgatgaagatggagaagatgaagctgaggacaccggggtggacaccggggccccctactggaccaggcctgagaggatggacaagaagctgctggccgtgcctgctgccaacacagtgcgcttccgctgcccagctgctggcaaccccacccccagcatctcctggctgaagaatggccgggagttccggggggagcacagaattggaggcatcaagctgcggcaccagcagtggagcctggtgatggagagcgtggtgcccagcgaccggggcaactacacctgtgtggtggagaacaagtttggcagcatccggcagacctacaccctggatgtgctggagaggagcccccaccggcccatcctgcaggccggcctgcctgccaaccagacagctgtgctgggcagtgatgtggagttccactgcaaggtgtacagtgatgcccagccccacatccagtggctgaagcacgtggaggtgaatggcagcaaggtgggcccagatggcaccccctacgtgacagtgctgaagtcctggatcagcgagagcgtggaggctgatgtgcggctgcggctggccaacgtgtctgaaagagatggaggagagtacctgtgccgggccaccaacttcatcggcgtggccgagaaggccttctggctgtctgtgcacggccccagggctgctgaggaggagctggtggaggctgatgaagctggctctgtgtatgccggcatcctgtcctatggagtgggcttcttcctgttcatcctggtggtggccgctgtgaccctgtgccgcctgcggagcccccccaagaagggcctgggcagccccaccgtgcacaagatcagccgcttccccctgaagaggcaggtgtccctggagagcaatgcctccatgagcagcaacacccccctggtgcgcatcgcccggctgagcagtggagagggccccaccctggccaacgtgtctgagctggagctgcctgctgaccccaagtgggagctgagccgggcccggctgaccctgggcaagcccctgggggagggctgcttcggccaggtggtgatggccgaggccatcggcatcgacaaggacagagctgccaagcctgtgacagtggccgtgaagatgctgaaggatgatgccacagacaaggacctgagtgacctggtgtctgagatggagatgatgaagatgattggcaagcacaagaacatcatcaacctgctgggcgcctgcacccagggcggccccctgtatgtgctggtggagtatgctgccaagggcaacctgcgggagttcctgcgggcccggcggcccccaggcctggactacagctttgacacctgcaagcccccagaggagcagctgaccttcaaggacctggtgtcctgtgcctaccaggtggcccggggcatggagtacctggccagccagaagtgcatccaccgggacctggccgccagaaatgtgctggtgacagaagataatgtgatgaagattgctgactttggcctggccagagatgtgcacaacctggactactacaagaagaccaccaacggccgcctgcctgtgaagtggatggcccctgaggccctgtttgacagagtgtacacccaccagagtgatgtgtggagctttggagtgctgctgtgggagatcttcaccctgggcggcagcccctacccaggcatccctgtggaggagctgttcaagctgctgaaggagggccacaggatggacaagccagccaactgcacccatgacctgtacatgatcatgagggagtgctggcatgctgcccccagccagaggcccaccttcaagcagctggtggaggacctggacagagtgctgactgtgaccagcacagatgagtacctggacctgagcgccccctttgagcagtacagccctgggggccaggacacccccagcagcagcagcagtggagatgattctgtgtttgcccatgacctgctgcccccagccccacccagcagcggcggcagcaggacatag

SEQ ID NO: 19702 - DNA, 2085 bp, Artificial Sequence
  Description of Artificial Sequence: Synthetic coding sequence
atgggcgccccagcctgtgccctggccctgtgtgtggccgtggccatcgtggccggggccagcagcgagagcctgggcacagagcagagggtggtgggccgggctgctgaggtgcccggccctgagcccggccagcaggagcagctggtgtttggaagtggagatgctgtggagctgagctgccccccacctgggggcggccccatgggccccaccgtgtgggtgaaggatggcaccggcctggtgcccagcgagcgggtgctggtgggcccccagaggctgcaggtgctgaatgccagccatgaggacagcggggcctacagctgccggcagaggctgacccagagggtgctgtgccacttctctgtgcgggtgacagatgcccccagcagtggagatgatgaagatggagaagatgaagctgaggacaccggggtggacaccggggccccctactggaccaggcctgagaggatggacaagaagctgctggccgtgcctgctgccaacacagtgcgcttccgctgcccagctgctggcaaccccacccccagcatctcctggctgaagaatggccgggagttccggggggagcacagaattggaggcatcaagctgcggcaccagcagtggagcctggtgatggagagcgtggtgcccagcgaccggggcaactacacctgtgtggtggagaacaagtttggcagcatccggcagacctacaccctggatgtgctggagaggagcccccaccggcccatcctgcaggccggcctgcctgccaaccagacagctgtgctgggcagtgatgtggagttccactgcaaggtgtacagtgatgcccagccccacatccagtggctgaagcacgtggaggtgaatggcagcaaggtgggcccagatggcaccccctacgtgacagtgctgaaggtgtccctggagagcaatgcctccatgagcagcaacacccccctggtgcgcatcgcccggctgagcagtggagagggccccaccctggccaacgtgtctgagctggagctgcctgctgaccccaagtgggagctgagccgggcccggctgaccctgggcaagcccctgggggagggctgcttcggccaggtggtgatggccgaggccatcggcatcgacaaggacagagctgccaagcctgtgacagtggccgtgaagatgctgaaggatgatgccacagacaaggacctgagtgacctggtgtctgagatggagatgatgaagatgattggcaagcacaagaacatcatcaacctgctgggcgcctgcacccagggcggccccctgtatgtgctggtggagtatgctgccaagggcaacctgcgggagttcctgcgggcccggcggcccccaggcctggactacagctttgacacctgcaagcccccagaggagcagctgaccttcaaggacctggtgtcctgtgcctaccaggtggcccggggcatggagtacctggccagccagaagtgcatccaccgggacctggccgccagaaatgtgctggtgacagaagataatgtgatgaagattgctgactttggcctggccagagatgtgcacaacctggactactacaagaagaccaccaacggccgcctgcctgtgaagtggatggcccctgaggccctgtttgacagagtgtacacccaccagagtgatgtgtggagctttggagtgctgctgtgggagatcttcaccctgggcggcagcccctacccaggcatccctgtggaggagctgttcaagctgctgaaggagggccacaggatggacaagccagccaactgcacccatgacctgtacatgatcatgagggagtgctggcatgctgcccccagccagaggcccaccttcaagcagctggtggaggacctggacagagtgctgactgtgaccagcacagatgagtacctggacctgagcgccccctttgagcagtacagccctgggggccaggacacccccagcagcagcagcagtggagatgattctgtgtttgcccatgacctgctgcccccagccccacccagcagcggcggcagcaggacatag

SEQ ID NO: 19703 - DNA, 2421 bp, Artificial Sequence; identical to SEQ ID NO: 19699
  Description of Artificial Sequence: Synthetic coding sequence

SEQ ID NO: 19704 - DNA, 2379 bp, Artificial Sequence
  Description of Artificial Sequence: Synthetic coding sequence
atgggcgccccagcctgtgccctggccctgtgtgtggccgtggccatcgtggccggggccagcagcgagagcctgggcacagagcagagggtggtgggccgggctgctgaggtgcccggccctgagcccggccagcaggagcagctggtgtttggaagtggagatgctgtggagctgagctgccccccacctgggggcggccccatgggccccaccgtgtgggtgaaggatggcaccggcctggtgcccagcgagcgggtgctggtgggcccccagaggctgcaggtgctgaatgccagccatgaggacagcggggcctacagctgccggcagaggctgacccagagggtgctgtgccacttctctgtgcgggtgacagatgcccccagcagtggagatgatgaagatggagaagatgaagctgaggacaccggggtggacaccggggccccctactggaccaggcctgagaggatggacaagaagctgctggccgtgcctgctgccaacacagtgcgcttccgctgcccagctgctggcaaccccacccccagcatctcctggctgaagaatggccgggagttccggggggagcacagaattggaggcatcaagctgcggcaccagcagtggagcctggtgatggagagcgtggtgcccagcgaccggggcaactacacctgtgtggtggagaacaagtttggcagcatccggcagacctacaccctggatgtgctggagaggagcccccaccggcccatcctgcaggccggcctgcctgccaaccagacagctgtgctgggcagtgatgtggagttccactgcaaggtgtacagtgatgcccagccccacatccagtggctgaagcacgtggaggtgaatggcagcaaggtgggcccagatggcaccccctacgtgacagtgctgaagacagctggggccaacaccacagacaaggagctggaggtgctgagcctgcacaacgtgacctttgaagatgctggggagtacacctgcctggccggcaacagcatcggcttcagccaccacagcgcctggctggtggtgctgcctgctgaggaggagctggtggaggctgatgaagctggctctgtgtatgccggcatcctgtcctatggagtgggcttcttcctgttcatcctggtggtggccgctgtgaccctgtgccgcctgcggagcccccccaagaagggcctgggcagccccaccgtgcacaagatcagccgcttccccctgaagaggcagcaggtgtccctggagagcaatgcctccatgagcagcaacacccccctggtgagaattgcccggctgagcagcggggagggccccaccctggccaacgtgtctgagctggagctgcctgctgaccccaagtgggagctgagccgggcccggctgaccctgggcaagcccctgggggagggctgcttcggccaggtggtgatggccgaggccatcggcatcgacaaggaccgggccgccaagcctgtgacagtggccgtgaagatgctgaaggatgatgccacagacaaggacctgagtgacctggtgtctgagatggagatgatgaagatgattggcaagcacaagaacatcatcaacctgctgggcgcctgcacccagggcggccccctgtatgtgctggtggagtatgctgccaagggcaacctgcgggagttcctgcgggcccggcggcccccaggcctggactacagctttgacacctgcaagcccccagaggagcagctgaccttcaaggacctggtgtcctgtgcctaccaggtggcccggggcatggagtacctggccagccagaagtgcatccaccgggacctggccgccagaaatgtgctggtgacagaggacaacgtgatgaagattgctgactttggcctggccagagatgtgcacaacctggactactacaagaagaccaccaacctggtgctgtggggccctgccctgggggacctgcatgctgggggcctgcctgtgcccaggcacccctgtggcggggccctgcaggccgctgagggcggccccccccacggccaggcccggcagctgcacaccaggcctgtgcatgaccatgctggggtgctggcctgccgggccctgcctgaggcccacctgcaggccgccggcggcggccctggcccctgcccctacagagatgtgcacagaagagtgcccggccctgtgggcgccttccgggctgtgctgcccggctggccaggccacccccagctgcagctgctgcggggccgcctgcgggtgtgccccaggcctgctgcccctggccccacccagcagtggggcctggctgatgtgaagggccactggagccccaccatgtag

SEQ ID NO: 19705 - DNA, 2409 bp, Artificial Sequence
  Description of Artificial Sequence: Synthetic coding sequence
atgaggctgctgctggccctgctgggcgtgctgctgtctgtgcccggcccccctgtgctgagcctggaggccagcgaggaggtggagctggagccctgcctggcccccagcctggagcagcaggagcaggagctgactgtggccctgggccagcctgtgcggctgtgctgcggccgggcagagcggggcggccactggtacaaggagggcagccggctggccccagctggccgggtgcggggctggaggggccgcctggagatcgccagcttcctgcctgaagatgctggccgctacctgtgcctggcccggggctccatgattgtgctgcagaacctgaccctcatcactggagacagcctgaccagcagcaatgatgatgaggaccccaagagccaccgggaccccagcaacagacacagctacccccagcaggccccctactggacccacccccagaggatggagaagaagctgcatgctgtgcctgctggcaacacagtgaagttccgctgcccagctgctggcaaccccacccccaccatccgctggctgaaggatggccaggccttccacggggagaacagaattggaggcatccggctgcggcaccagcactggagcctggtgatggagagcgtggtgcccagcgaccggggcacctacacctgcctggtggagaatgctgtgggcagcatccgctacaactacctgctggatgtgctggagaggagcccccaccggcccatcctgcaggccggcctgcctgccaacaccacagctgtggtgggcagtgatgtggagctgctgtgcaaggtgtacagtgatgcccagccccacatccagtggctgaagcacatcgtcatcaatggcagcagctttggagcagatggcttcccctacgtgcaggtgctgaagacagctgacatcaacagcagcgaggtggaggtgctgtacctgagaaatgtgtctgcagaagatgctggggagtacacctgcctggccggcaacagcatcggcctgagctaccagagcgcctggctgactgtgctgcctgaggaggaccccacctggacagctgctgcccctgaggcccgctacacagacatcatcctgtatgccagcggcagcctggccctggccgtgctgctgctgctggccggcctgtaccggggccaggccctgcacggccgccacccccggcccccagccaccgtgcagaagctgagccgcttccccctggcccggcagttcagcctggagagcggcagcagcggcaagagcagcagcagcctggtgcggggcgtgcggctgagcagcagcggccctgccctgctggccggcctggtgtccctggacctgcccctggaccccctgtgggagttcccccgggaccggctggtgctgggcaagcccctgggggagggctgcttcggccaggtggtgcgggcagaggccttcggcatggaccctgcccggccagaccaggccagcacagtggccgtgaagatgctgaaggacaatgccagtgacaaggacctggccgacctggtgtctgagatggaggtgatgaagctgattggccgccacaagaacatcatcaacctgctgggcgtgtgcacccaggagggccccctgtatgtgattgtggagtgtgccgccaagggcaacctgcgggagttcctgcgggcccggcggcccccaggccctgacctgagcccagatggccccaggagcagcgagggccccctgtccttccctgtgctggtgtcctgtgcctaccaggtggcccggggcatgcagtacctggagagcaggaagtgcatccaccgggacctggccgccagaaatgtgctggtgacagaggacaacgtgatgaagattgctgactttggcctggcccggggcgtgcaccacatcgactactacaagaagaccagcaatggccgcctgcctgtgaagtggatggcccctgaggccctgtttgacagagtgtacacccaccagagtgatgtgtggagctttggcatcctgctgtgggagatcttcaccctgggcggcagcccctacccaggcatccctgtggaggagctgttcagcctgctgcgggagggccacaggatggacaggcctccccactgccccccagagctgtatggcctgatgagggagtgctggcacgccgcccccagccagaggcccaccttcaagcagctggtggaggccctggacaaggtgctgctggccgtgtctgaggagtacctggacctgcggctgaccttcggcccctacagccccagcggaggagatgccagcagcacctgcagcagcagtgacagcgtcttcagccatgaccccctgcccctgggcagcagcagcttccccttcggcagcggcgtgcagacctag

SEQ ID NO: 19706 - DNA, 2289 bp, Artificial Sequence
  Description of Artificial Sequence: Synthetic coding sequence
atgaggctgctgctggccctgctgggcgtgctgctgtctgtgcccggcccccctgtgctgagcctggaggccagcgaggaggtggagctggagccctgcctggcccccagcctggagcagcaggagcaggagctgactgtggccctgggccagcctgtgcggctgtgctgcggccgggcagagcggggcggccactggtacaaggagggcagccggctggccccagctggccgggtgcggggctggaggggccgcctggagatcgccagcttcctgcctgaagatgctggccgctacctgtgcctggcccggggctccatgattgtgctgcagaacctgaccctcatcactggagacagcctgaccagcagcaatgatgatgaggaccccaagagccaccgggaccccagcaacagacacagctacccccagcaggccccctactggacccacccccagaggatggagaagaagctgcatgctgtgcctgctggcaacacagtgaagttccgctgcccagctgctggcaaccccacccccaccatccgctggctgaaggatggccaggccttccacggggagaacagaattggaggcatccggctgcggcaccagcactggagcctggtgatggagagcgtggtgcccagcgaccggggcacctacacctgcctggtggagaatgctgtgggcagcatccgctacaactacctgctggatgtgctggagaggagcccccaccggcccatcctgcaggccggcctgcctgccaacaccacagctgtggtgggcagtgatgtggagctgctgtgcaaggtgtacagtgatgcccagccccacatccagtggctgaagcacatcgtcatcaatggcagcagctttggagcagatggcttcccctacgtgcaggtgctgaagacagctgacatcaacagcagcgaggtggaggtgctgtacctgagaaatgtgtctgcagaagatgctggggagtacacctgcctggccggcaacagcatcggcctgagctaccagagcgcctggctgactgtgctgcccggcaccggccgcatcccccacctgacctgtgacagcctgaccccagctggccgcaccaagagccccaccctgcagttcagcctggagagcggcagcagcggcaagagcagcagcagcctggtgcggggcgtgcggctgagcagcagcggccctgccctgctggccggcctggtgtccctggacctgcccctggaccccctgtgggagttcccccgggaccggctggtgctgggcaagcccctgggggagggctgcttcggccaggtggtgcgggcagaggccttcggcatggaccctgcccggccagaccaggccagcacagtggccgtgaagatgctgaaggacaatgccagtgacaaggacctggccgacctggtgtctgagatggaggtgatgaagctgattggccgccacaagaacatcatcaacctgctgggcgtgtgcacccaggagggccccctgtatgtgattgtggagtgtgccgccaagggcaacctgcgggagttcctgcgggcccggcggcccccaggccctgacctgagcccagatggccccaggagcagcgagggccccctgtccttccctgtgctggtgtcctgtgcctaccaggtggcccggggcatgcagtacctggagagcaggaagtgcatccaccgggacctggccgccagaaatgtgctggtgacagaggacaacgtgatgaagattgctgactttggcctggcccggggcgtgcaccacatcgactactacaagaagaccagcaatggccgcctgcctgtgaagtggatggcccctgaggccctgtttgacagagtgtacacccaccagagtgatgtgtggagctttggcatcctgctgtgggagatcttcaccctgggcggcagcccctacccaggcatccctgtggaggagctgttcagcctgctgcgggagggccacaggatggacaggcctccccactgccccccagagctgtatggcctgatgagggagtgctggcacgccgcccccagccagaggcccaccttcaagcagctggtggaggccctggacaaggtgctgctggccgtgtctgaggagtacctggacctgcggctgaccttcggcccctacagccccagcggaggagatgccagcagcacctgcagcagcagtgacagcgtcttcagccatgaccccctgcccctgggcagcagcagcttccccttcggcagcggcgtgcagacctag

SEQ ID NO: 19707 - DNA, 3093 bp, Artificial Sequence
  Description of Artificial Sequence: Synthetic coding sequence
ccctgcatgtggcaccagcagcacgtgccctgtgtgtgtgtgtgcccctacgtgtgtgtgtgcatgagggtgtgtgtgtgtgtgtgctggcccctgagctgtgccctgaatgctgtgtgtgtgacctgccccaagtctgtggcctttgccctgggcgtggccagcgctgcctgtggctgtgtgggcgtgaaggagtggtggctgctgcagcacgccctgcagagcgcctgtgccctgcacgtgcgctgtgtgctgtgcacccaggaggccgccagtgatggagctgctggcagcgctgacctgtgccccctgcccacagagccctgcctggcccccagcctggagcagcaggagcaggagctgactgtggccctgggccagcctgtgcggctgtgctgcggccgggcagagcggggcggccactggtacaaggagggcagccggctggccccagctggccgggtgcggggctggaggggccgcctggagatcgccagcttcctgcctgaagatgctggccgctacctgtgcctggcccggggctccatgattgtgctgcagaacctgaccctcatcactggagacagccccccagccaccatgatgaggacccccagccccatcggcaccccaagaattggaacagtgacccccagcaaggtgagccgcagccccaggacctgtgtgcctgctgctgcccacctgatcacagagaagaggaggcctgtgtgggagcacacagtcatcctgggcgccttcccctgccccccagccccctactggacccacccccagaggatggagaagaagctgcatgctgtgcctgctggcaacacagtgaagttccgctgcccagctgctggcaaccccacccccaccatccgctggctgaaggatggccaggccttccacggggagaacagaattggaggcatccggctgcggcaccagcactggagcctggtgatggagagcgtggtgcccagcgaccggggcacctacacctgcctggtggagaatgctgtgggcagcatccgctacaactacctgctggatgtgctggagaggagcccccaccggcccatcctgcaggccggcctgcctgccaacaccacagctgtggtgggcagtgatgtggagctgctgtgcaaggtgtacagtgatgcccagccccacatccagtggctgaagcacatcgtcatcaatggcagcagctttggagcagatggcttcccctacgtgcaggtgctgaagacagctgacatcaacagcagcgaggtggaggtgctgtacctgagaaatgtgtctgcagaagatgctggggagtacacctgcctggccggcaacagcatcggcctgagctaccagagcgcctggctgactgtgctgcccggggagcacctgaagggccaggagatgctgagagatgcccccctgggccagcagtggggcctgtggcctgtgggctggagcgtgtctgtgggcctgtggggcctggcctggggcgctgtgtgtggctttgtgggcctgagctgcatgacagcccccctgtgcctgagcacccggggccggccctgtgaccggctgctgcgctgtggctgcctgggcctgggcatcaccacagccagctctgtgtgtgtgcccacctacgtgggctcctgggagggcctgggctgcaccggccggcctgtgagccccctgaccagcctgtctgtgtgtgtgtgcccctgtgcccgggcagaggaggaccccacctggacagctgctgcccctgaggcccgctacacagacatcatcctgtatgccagcggcagcctggccctggccgtgctgctgctgctggccggcctgtaccggggccaggccctgcacggccgccacccccggcccccagccaccgtgcagaagctgagccgcttccccctggcccggcagttcagcctggagagcggcagcagcggcaagagcagcagcagcctggtgcggggcgtgcggctgagcagcagcggccctgccctgctggccggcctggtgtccctggacctgcccctggaccccctgtgggagttcccccgggaccggctggtgctgggcaagcccctgggggagggctgcttcggccaggtggtgcgggcagaggccttcggcatggaccctgcccggccagaccaggccagcacagtggccgtgaagatgctgaaggacaatgccagtgacaaggacctggccgacctggtgtctgagatggaggtgatgaagctgattggccgccacaagaacatcatcaacctgctgggcgtgtgcacccaggagggccccctgtatgtgattgtggagtgtgccgccaagggcaacctgcgggagttcctgcgggcccggcggcccccaggccctgacctgagcccagatggccccaggagcagcgagggccccctgtccttccctgtgctggtgtcctgtgcctaccaggtggcccggggcatgcagtacctggagagcaggaagtgcatccaccgggacctggccgccagaaatgtgctggtgacagaggacaacgtgatgaagattgctgactttggcctggcccggggcgtgcaccacatcgactactacaagaagaccagcaatggccgcctgcctgtgaagtggatggcccctgaggccctgtttgacagagtgtacacccaccagagtgatgtgtggagctttggcatcctgctgtgggagatcttcaccctgggcggcagcccctacccaggcatccctgtggaggagctgttcagcctgctgcgggagggccacaggatggacaggcctccccactgccccccagagctgtatggcctgatgagggagtgctggcacgccgcccccagccagaggcccaccttcaagcagctggtggaggccctggacaaggtgctgctggccgtgtctgaggagtacctggacctgcggctgaccttcggcccctacagccccagcggaggagatgccagcagcacctgcagcagcagtgacagcgtcttcagccatgaccccctgcccctgggcagcagcagcttccccttcggcagcggcgtgcagacctag

SEQ ID NO: 19708 - DNA, 2289 bp, Artificial Sequence; identical to SEQ ID NO: 19706
  Description of Artificial Sequence: Synthetic coding sequence

SEQ ID NO: 19709 - DNA, 2409 bp, Artificial Sequence; identical to SEQ ID NO: 19705
  Description of Artificial Sequence: Synthetic coding sequence

SEQ ID NO: 19710 - DNA, 606 bp, Artificial Sequence
  Description of Artificial Sequence: Synthetic coding sequence
atgaggctgctgctggccctgctgggcgtgctgctgtctgtgcccggcccccctgtgctgagcctggaggccagcgaggaggtggagctggagccctgcctggcccccagcctggagcagcaggagcaggagctgactgtggccctgggccagcctgtgcggctgtgctgcggccgggcagagcggggcggccactggtacaaggagggcagccggctggccccagctggccgggtgcggggctggaggggccgcctggagatcgccagcttcctgcctgaagatgctggccgctacctgtgcctggcccggggctccatgattgtgctgcagaacctgaccctcatcactggagacagcctgaccagcagcaatgatgatgaggaccccaagagccaccgggaccccagcaacagacacagctacccccagcaggccccctactggacccacccccagaggatggagaagaagctgcatgctgtgcctgctggcaacacagtgaagttccgctgcccagctgctggcaaccccacccccaccatccgctggctgaaggatggccaggccttccacggggagaacagaattggaggcatcagatag

SEQ ID NO: 19711 - DNA, 264 bp, Artificial Sequence
  Description of Artificial Sequence: Synthetic coding sequence
atgaggctgctgctggccctgctgggcgtgctgctgtctgtgcccggcccccctgtgctgagcctggaggccagcgaggaggtggagctggagccctgcctggcccccagcctggagcagcaggagcaggagctgactgtggccctgggccagcctgtgcggctgtgctgcggccgggcagagcggggcggccactggtacaaggagggcagccggctggccccagctggccgggtgcggggctggaggggccgcctggagtag

SEQ ID NO: 19712 - DNA, 327 bp, Artificial Sequence
  Description of Artificial Sequence: Synthetic coding sequence
atgaggctgctgctggccctgctgggcgtgctgctgtctgtgcccggcccccctgtgctgagcctggaggccagcgaggaggtggagctggagccctgcctggcccccagcctggagcagcaggagcaggagctgactgtggccctgggccagcctgtgcggctgtgctgcggccgggcagagcggggcggccactggtacaaggagggcagccggctggccccagctggccgggtgcggggctggaggggccgcctggagatcgccagcttcctgcctgaagatgctggccgctacctgtgcctggcccggggctccatgatctag

SEQ ID NO: 19713 - DNA, 345 bp, Artificial Sequence
  Description of Artificial Sequence: Synthetic coding sequence
atgaggctgctgctggccctgctgggcgtgctgctgtctgtgcccggcccccctgtgctgagcctggaggccagcgaggaggtggagctggagccctgcctggcccccagcctggagcagcaggagcaggagctgactgtggccctgggccagcctgtgcggctgtgctgcggccgggcagagcggggcggccactggtacaaggagggcagccggctggccccagctggccgggtgcggggctggaggggccgcctggagatcgccagcttcctgcctgaagatgctggccgctacctgtgcctggcccggggctccatgattgtgctgcagaacctgacctag

SEQ ID NO: 19714 - DNA, 7164 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatccctgaggtgccccagctgacagacctgagctttgtggacatcacagacagcagcatcggcctgcgctggacccccctgaacagcagcaccatcatcggctaccgcatcaccgtggtggccgccggggagggcatccccatctttgaagattttgtggacagctctgtgggctactacacagtgacaggcctggagcccggcatcgactatgacatcagcgtcatcaccctcatcaatggaggagagagcgcccccaccaccctgacccagcagacagctgtgcccccacccacagacctgcgcttcttcagtgacatcacagccaacagcttcaccgtgcactggatcgccccccgggccaccatcaccggctaccgcatccgccaccaccctgagcacttcagcggccggccccgggaggacagagtgccccacagcagaaattccatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctatggagagaccggcggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctcatcggcacccagagcacagccatcccagcccccacagacctgaagttcacccaggtgacccccaccagcctgagcgcccagtggaccccaccaaatgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgtccccaccaagaagagcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcccggcacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcccggcacagagtacaccatctacgtgattgccctgaagaacaaccagaagtctgagcccctgattggaaggaagaagacagatgagctgccccagctggtgaccctgccccaccccaacctgcacggccctgagatcctggatgtgcccagcacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctacccacccaacgtgggggaggagatccagatcggccacatccccagagaagatgtggactaccacctgtacccccacggccctggcctgaaccccaatgccagcacaggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtcatcgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggctttggaagtggccacttccgctgtgacagcagccgctggtgccacgacaatggagtgaactacaagattggagagaagtgggaccggcagggagaaaatggccagatgatgagctgcacctgcctgggcaatggcaagggggagttcaagtgtgacccccatgaggccacctgctatgatgatggcaagacctaccacgtgggggagcagtggcagaaggagtacctgggcgccatctgcagctgcacctgctttggaggccagaggggctggaggtgtgacaactgcagaagacctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19715 - DNA, 7341 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatccctgaggtgccccagctgacagacctgagctttgtggacatcacagacagcagcatcggcctgcgctggacccccctgaacagcagcaccatcatcggctaccgcatcaccgtggtggccgccggggagggcatccccatctttgaagattttgtggacagctctgtgggctactacacagtgacaggcctggagcccggcatcgactatgacatcagcgtcatcaccctcatcaatggaggagagagcgcccccaccaccctgacccagcagacagctgtgcccccacccacagacctgcgcttcaccaacattggaccagacaccatgagggtgacctgggcccctcctccttccattgacctgaccaacttcctggtgcgctacagccctgtgaagaatgaggaggatgtggccgagctgagcatcagccccagcgacaatgctgtggtgctgaccaacctgctgcctggaacagaatatgtggtgtctgtgtcctctgtgtatgagcagcacgagagcacccccctgcggggccggcagaagacaggcctggacagccccactggaattgacttcagtgacatcacagccaacagcttcaccgtgcactggatcgccccccgggccaccatcaccggctaccgcatccgccaccaccctgagcacttcagcggccggccccgggaggacagagtgccccacagcagaaattccatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctatggagagaccggcggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctcatcggcacccagagcacagccatcccagcccccacagacctgaagttcacccaggtgacccccaccagcctgagcgcccagtggaccccaccaaatgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgtccccaccaagaagagcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcccggcacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcccggcacagagtacaccatctacgtgattgccctgaagaacaaccagaagtctgagcccctgattggaaggaagaagacagatgagctgccccagctggtgaccctgccccaccccaacctgcacggccctgagatcctggatgtgcccagcacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctacccacccaacgtgggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtgattgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggcttcggcagcggccacttccgctgtgacagcagccgctggtgccacgacaacggggtgaactacaagatcggggagaagtgggaccggcagggagaaaatggccagatgatgagctgcacctgcctgggcaatggaaaaggagagttcaagtgtgacccccatgaggccacctgctatgatgatggcaagacctaccacgtgggggagcagtggcagaaggagtacctgggcgccatctgcagctgcacctgcttcggcggccagaggggctggaggtgtgacaactgccggcggcctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19716 - DNA, 7068 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctgattggcacccagagcacagccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacagatgagctgccccagctggtgaccctgccccaccccaacctgcacggccctgagatcctggatgtgcccagcacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctaccccccaaatgtgggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtcatcgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggctttggaagtggccacttccgctgtgacagcagccgctggtgccacgacaatggagtgaactacaagattggagagaagtgggaccggcagggagaaaatggccagatgatgagctgcacctgcctgggcaatggcaagggggagttcaagtgtgacccccatgaggccacctgctatgatgatggcaagacctaccacgtgggggagcagtggcagaaggagtacctgggcgccatctgcagctgcacctgctttggaggccagaggggctggaggtgtgacaactgcagaagacctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19717 - DNA, 6555 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctgattggcacccagagcacagccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacagtgaatgaaggcctgaaccagcccacagatgacagctgctttgacccctacacagtgagccactatgctgtgggagatgagtgggagaggatgtctgagagcggcttcaagctgctgtgccagtgcctgggcttcggcagcggccacttccgctgtgacagcagccgctggtgccacgacaacggggtgaactacaagatcggggagaagtgggaccggcagggagaaaatggccagatgatgagctgcacctgcctgggcaatggaaaaggagagttcaagtgtgacccccatgaggccacctgctatgatgatggcaagacctaccacgtgggggagcagtggcagaaggagtacctgggcgccatctgcagctgcacctgcttcggcggccagaggggctggaggtgtgacaactgccggcggcctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19718 - DNA, 6636 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctgattggcacccagagcacagccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacaggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtgattgtggaggccctgaaggaccagcagaggcacaaggtgcgggaggaggtggtgacagtgggcaacagcggctggtgccacgacaatggagtgaactacaagattggagagaagtgggaccggcagggagaaaatggccagatgatgagctgcacctgcctgggcaatggcaagggggagttcaagtgtgacccccatgaggccacctgctatgatgatggcaagacctaccacgtgggggagcagtggcagaaggagtacctgggcgccatctgcagctgcacctgctttggaggccagaggggctggaggtgtgacaactgcagaagacctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19719 - DNA, 7434 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatccctgaggtgccccagctgacagacctgagctttgtggacatcacagacagcagcatcggcctgcgctggacccccctgaacagcagcaccatcatcggctaccgcatcaccgtggtggccgccggggagggcatccccatctttgaagattttgtggacagctctgtgggctactacacagtgacaggcctggagcccggcatcgactatgacatcagcgtcatcaccctcatcaatggaggagagagcgcccccaccaccctgacccagcagacagctgtgcccccacccacagacctgcgcttcaccaacattggaccagacaccatgagggtgacctgggcccctcctccttccattgacctgaccaacttcctggtgcgctacagccctgtgaagaatgaggaggatgtggccgagctgagcatcagccccagcgacaatgctgtggtgctgaccaacctgctgcctggaacagaatatgtggtgtctgtgtcctctgtgtatgagcagcacgagagcacccccctgcggggccggcagaagacaggcctggacagccccactggaattgacttcagtgacatcacagccaacagcttcaccgtgcactggatcgccccccgggccaccatcaccggctaccgcatccgccaccaccctgagcacttcagcggccggccccgggaggacagagtgccccacagcagaaattccatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctatggagagaccggcggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctcatcggcacccagagcacagccatcccagcccccacagacctgaagttcacccaggtgacccccaccagcctgagcgcccagtggaccccaccaaatgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgtccccaccaagaagagcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcccggcacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcccggcacagagtacaccatctacgtgattgccctgaagaacaaccagaagtctgagcccctgattggaaggaagaagacagatgagctgccccagctggtgaccctgccccaccccaacctgcacggccctgagatcctggatgtgcccagcacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctacccacccaacgtgggggaggagatccagatcggccacatccccagagaagatgtggactaccacctgtacccccacggccctggcctgaaccccaatgccagcacaggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtcatcgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggctttggaagtggccacttccgctgtgacagcagccgctggtgccacgacaatggagtgaactacaagattggagagaagtgggaccggcagggagaaaatggccagatgatgagctgcacctgcctgggcaatggcaagggggagttcaagtgtgacccccatgaggccacctgctatgatgatggcaagacctaccacgtgggggagcagtggcagaaggagtacctgggcgccatctgcagctgcacctgctttggaggccagaggggctggaggtgtgacaactgcagaagacctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19720 - DNA, 6891 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacagatgagctgccccagctggtgaccctgccccaccccaacctgcacggccctgagatcctggatgtgcccagcacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctaccccccaaatgtgggggaggagatccagatcggccacatcccccgggaggatgtggactaccacctgtacccccacggccctggcctgaaccccaatgccagcacaggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtgattgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggcttcggcagcggccacttccgctgtgacagcagccgctggtgccacgacaacggggtgaactacaagatcggggagaagtgggaccggcagggagaaaatggccagatgatgagctgcacctgcctgggcaatggaaaaggagagttcaagtgtgacccccatgaggccacctgctatgatgatggcaagacctaccacgtgggggagcagtggcagaaggagtacctgggcgccatctgcagctgcacctgcttcggcggccagaggggctggaggtgtgacaactgccggcggcctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19721 - DNA, 6096 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctgattggcacccagagcacagccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacaggccaggaggccctgagccagaccaccatctcctgggcccccttccaggacaccagcgagtacatcatcagctgccaccctgtgggcacagatgaggagcccctgcagagcaccaaggcctag

SEQ ID NO: 19722 - DNA, 6531 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacaggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtgattgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggcttcggcagcggccacttccgctgtgacagcagccgctggtgccacgacaacggggtgaactacaagatcggggagaagtgggaccggcagggagaaaatggccagatgatgagctgcacctgcctgggcaatggaaaaggagagttcaagtgtgacccccatgaggccacctgctatgatgatggcaagacctaccacgtgggggagcagtggcagaaggagtacctgggcgccatctgcagctgcacctgcttcggcggccagaggggctggaggtgtgacaactgccggcggcctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19723 - DNA, 7161 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctgattggcacccagagcacagccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacagatgagctgccccagctggtgaccctgccccaccccaacctgcacggccctgagatcctggatgtgcccagcacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctaccccccaaatgtgggggaggagatccagatcggccacatcccccgggaggatgtggactaccacctgtacccccacggccctggcctgaaccccaatgccagcacaggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtgattgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggcttcggcagcggccacttccgctgtgacagcagccgctggtgccacgacaacggggtgaactacaagatcggggagaagtgggaccggcagggagaaaatggccagatgatgagctgcacctgcctgggcaatggaaaaggagagttcaagtgtgacccccatgaggccacctgctatgatgatggcaagacctaccacgtgggggagcagtggcagaaggagtacctgggcgccatctgcagctgcacctgcttcggcggccagaggggctggaggtgtgacaactgccggcggcctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19724 - DNA, 6723 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctacccacccaacgtgggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtgattgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggcttcggcagcggccacttccgctgtgacagcagccgctggtgccacgacaacggggtgaactacaagatcggggagaagtgggaccggcagggagaaaatggccagatgatgagctgcacctgcctgggcaatggaaaaggagagttcaagtgtgacccccatgaggccacctgctatgatgatggcaagacctaccacgtgggggagcagtggcagaaggagtacctgggcgccatctgcagctgcacctgcttcggcggccagaggggctggaggtgtgacaactgccggcggcctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19725 - DNA, 1974 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcctgtgtccatccccccaagaaacctgggctactag

SEQ ID NO: 19726 - DNA, 6804 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatccctgaggtgccccagctgacagacctgagctttgtggacatcacagacagcagcatcggcctgcgctggacccccctgaacagcagcaccatcatcggctaccgcatcaccgtggtggccgccggggagggcatccccatctttgaagattttgtggacagctctgtgggctactacacagtgacaggcctggagcccggcatcgactatgacatcagcgtcatcaccctcatcaatggaggagagagcgcccccaccaccctgacccagcagacagctgtgcccccacccacagacctgcgcttcaccaacattggaccagacaccatgagggtgacctgggcccctcctccttccattgacctgaccaacttcctggtgcgctacagccctgtgaagaatgaggaggatgtggccgagctgagcatcagccccagcgacaatgctgtggtgctgaccaacctgctgcctggaacagaatatgtggtgtctgtgtcctctgtgtatgagcagcacgagagcacccccctgcggggccggcagaagacaggcctggacagccccactggaattgacttcagtgacatcacagccaacagcttcaccgtgcactggatcgccccccgggccaccatcaccggctaccgcatccgccaccaccctgagcacttcagcggccggccccgggaggacagagtgccccacagcagaaattccatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctatggagagaccggcggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaccatcccagcccccacagacctgaagttcacccaggtgacccccaccagcctgagcgcccagtggaccccaccaaatgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgtccccaccaagaagagcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcccggcacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcccggcacagagtacaccatctacgtgattgccctgaagaacaaccagaagtctgagcccctgattggaaggaagaagacaggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtcatcgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggctttggaagtggccacttccgctgtgacagcagccgctggtgccacgacaatggagtgaactacaagattggagagaagtgggaccggcagggagaaaatggccagatgatgagctgcacctgcctgggcaatggcaagggggagttcaagtgtgacccccatgaggccacctgctatgatgatggcaagacctaccacgtgggggagcagtggcagaaggagtacctgggcgccatctgcagctgcacctgctttggaggccagaggggctggaggtgtgacaactgcagaagacctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19727 - DNA, 6798 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacagatgagctgccccagctggtgaccctgccccaccccaacctgcacggccctgagatcctggatgtgcccagcacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctaccccccaaatgtgggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtcatcgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggctttggaagtggccacttccgctgtgacagcagccgctggtgccacgacaatggagtgaactacaagattggagagaagtgggaccggcagggagaaaatggccagatgatgagctgcacctgcctgggcaatggcaagggggagttcaagtgtgacccccatgaggccacctgctatgatgatggcaagacctaccacgtgggggagcagtggcagaaggagtacctgggcgccatctgcagctgcacctgctttggaggccagaggggctggaggtgtgacaactgcagaagacctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19728 - DNA, 6993 bp, Artificial Sequence
  Description of Artificial Sequence: Synthetic coding sequence
atgctgcggggccctggccctggcctgctgctgctggccgtgcagtgcctgggcacagctgtgcccagcactggagccagcaagagcaagaggcaggcccagcagatggtgcagccccagagccctgtggccgtgtcccagagcaagccaggctgctatgacaatggcaagcactaccagatcaaccagcagtgggagaggacctacctgggcaatgccctggtgtgcacctgctatggaggcagccggggcttcaactgtgagagcaagccagaggccgaggagacctgctttgacaagtacacaggcaacacctacagagtgggggacacctatgaaagacccaaggacagcatgatctgggactgcacctgcatcggggccggccggggccgcatcagctgcaccatcgccaaccgctgccacgagggcggccagagctacaagatcggggacacctggaggcggccccatgagaccggcggctacatgctggagtgtgtgtgcctgggcaatggcaagggggagtggacctgcaagcccatcgccgagaagtgctttgaccacgccgccggcaccagctatgtggtgggggagacctgggagaagccctaccagggctggatgatggtggactgcacctgcctgggggagggcagcggccgcatcacctgcaccagcaggaaccgctgcaatgaccaggacaccaggaccagctaccgcatcggggacacctggagcaagaaggacaacagaggcaacctgctgcagtgcatctgcacaggaaatggccgcggggagtggaagtgtgagcggcacacctctgtgcagaccaccagcagcggcagcggccccttcacagatgtgcgggctgctgtgtaccagccccagccccacccccagcccccaccctacggccactgtgtgacagacagcggcgtggtgtacagcgtgggcatgcagtggctgaagacccagggcaacaagcagatgctgtgcacctgcctgggcaatggagtgtcctgccaggagacagctgtgacccagacctatggaggcaacagcaatggagagccctgtgtgctgcccttcacctacaatggaagaaccttctacagctgcaccacagagggccggcaggacggccacctgtggtgcagcaccaccagcaactatgagcaggaccagaagtacagcttctgcacagaccacacagtgctggtgcagacccggggcggcaacagcaatggagccctgtgccacttccccttcctgtacaacaaccacaactacacagactgcaccagcgagggcagaagagacaacatgaagtggtgtggcaccacccagaactatgatgctgaccagaagtttggcttctgccccatggccgcccacgaggagatctgcaccaccaatgaaggagtgatgtaccgcatcggggaccagtgggacaagcagcacgacatgggccacatgatgcgctgcacctgtgtgggcaatggccgcggggagtggacctgcatcgcctacagccagctgcgggaccagtgcatcgtggatgacatcacctacaacgtgaatgacaccttccacaagagacatgaggagggccacatgctgaactgcacctgcttcggccagggccggggccgctggaagtgtgaccctgtggaccagtgccaggacagcgagaccggcaccttctaccagatcggggacagctgggagaagtatgtgcatggagtgcgctaccagtgctactgctacggccggggcatcggggagtggcactgccagcccctgcagacctaccccagcagcagcggccctgtggaggtgttcatcacagagacccccagccagcccaacagccaccccatccagtggaatgccccccagcccagccacatcagcaagtacatcctgcgctggaggcccaagaacagcgtgggccgctggaaggaggccaccatccctggccacctgaacagctacaccatcaagggcctgaagccaggagtggtgtatgagggccagctgatcagcatccagcagtatggccaccaggaggtgaccaggtttgacttcaccaccaccagcaccagcacccctgtgaccagcaacacagtgactggagagaccacccccttcagccccctggtggccaccagcgagagcgtgacagagatcacagccagcagctttgtggtgtcctgggtgtctgccagtgacacagtgtctggcttccgggtggagtatgagctgtctgaggagggagatgagccccagtacctggacctgcccagcacagccacctctgtgaacatcccagacctgctgcccggcaggaagtacatcgtgaatgtgtaccagatcagtgaagatggagagcagagcctcatcctgagcaccagccagaccacagccccagatgcccccccagacaccaccgtggaccaggtggatgacaccagcatcgtggtgcgctggagccggccccaggcccccatcaccggctacagaattgtgtacagccccagcgtggagggcagcagcacagagctgaacctgcctgagacagccaacagcgtgaccctgagtgacctgcagcccggggtgcagtacaacatcaccatctatgctgtggaggagaaccaggagagcacccctgtggtgatccagcaggagaccaccggcacccccaggagtgacacagtgcccagcccccgggacctgcagtttgtggaggtgacagatgtgaaggtgaccatcatgtggaccccacctgagagcgctgtgacaggctacagagtggatgtgattcctgtgaacctgcctggagagcacggccagaggctgcccatcagcaggaacacctttgctgaggtgacaggcctgagccctggggtgacctactacttcaaggtgtttgctgtgagccacggccgggagagcaagcccctgacagcccagcagaccaccaagctggatgcccccaccaacctgcagtttgtgaatgaaacagacagcacagtgctggtgcgctggaccccaccccgggcccagatcaccggctaccgcctgactgtgggcctgacccggcggggccagccccggcagtacaacgtgggccccagcgtgtccaagtaccccctgaggaacctgcagcctgccagcgagtacacagtgtccctggtggccatcaagggcaaccaggagagccccaaggccactggagtcttcaccaccctgcagcccggcagcagcatccccccctacaacacagaggtgacagagaccaccatcgtcatcacctggaccccagcccccagaattggcttcaagctgggcgtgcggcccagccagggcggggaggccccccgggaggtgaccagtgacagcggcagcatcgtggtgtctggcctgaccccaggagtggagtatgtgtacaccatccaggtgctgagagatggccaggagagagatgcccccatcgtgaacaaggtggtgacccccctgagcccccccaccaacctgcacctggaggccaacccagacaccggggtgctgactgtgtcctgggagaggagcaccaccccagacatcaccggctaccgcatcaccaccacccccaccaacggccagcagggcaacagcctggaggaggtggtgcatgctgaccagagcagctgcacctttgacaacctgagccctggcctggagtacaacgtgtctgtgtacacagtgaaggatgacaaggagagcgtgcccatcagtgacaccatcatcccagctgtgcccccacccacagacctgcgcttcaccaacatcggccctgacaccatgagggtgacctgggcccccccacccagcattgacctgaccaacttcctggtgcgctacagccctgtgaagaatgaagaagatgtggccgagctgagcatcagccccagcgacaatgctgtggtgctgaccaacctgctgcccggcacagaatatgtggtgtctgtgtcctctgtgtatgagcagcacgagagcacccccctgcggggccggcagaagacaggcctggacagccccaccggcatcgacttcagtgacatcacagccaacagcttcaccgtgcactggatcgccccccgggccaccatcaccggctaccgcatccgccaccaccctgagcacttcagcggccggcccagagaagatagagtgccccacagcaggaacagcatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctacggggagactggaggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaacatcgaccggcccaagggcctggccttcacagatgtggatgtggacagcatcaagatcgcctgggagagcccccagggccaggtgagccgctacagagtgacctacagcagcccagaagatggcatccacgagctgtttcctgccccagatggagaggaggacacagctgagctgcagggcctgcggcccggcagcgagtacacagtgtctgtggtggccctgcatgatgacatggagagccagcccctgattggcacccagagcacagccatcccagcccccacagacctgaagttcacccaggtgacccccaccagcctgagcgcccagtggaccccacccaacgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgagccccccccggcgggcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcctggaacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcctggaacagagtacaccatctacgtgattgccctgaagaacaaccagaagtctgagcccctcatcggcaggaagaagacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctacccacccaacgtgggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtgattgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggcttcggcagcggccacttccgctgtgacagcagccgctggtgccacgacaacggggtgaactacaagatcggggagaagtgggaccggcagggagaaaatggccagatgatgagctgcacctgcctgggcaatggaaaaggagagttcaagtgtgacccccatgaggccacctgctatgatgatggcaagacctaccacgtgggggagcagtggcagaaggagtacctgggcgccatctgcagctgcacctgcttcggcggccagaggggctggaggtgtgacaactgccggcggcctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19729 - DNA, 3312 bp, Artificial Sequence
  Description of Artificial Sequence: Synthetic coding sequence
ctgcgctggacccccctgaacagcagcaccatcatcggctaccgcatcaccgtggtggccgccggggagggcatccccatctttgaagattttgtggacagctctgtgggctactacacagtgacaggcctggagcccggcatcgactatgacatcagcgtcatcaccctcatcaatggaggagagagcgcccccaccaccctgacccagcagacagctgtgcccccacccacagacctgcgcttcaccaacattggaccagacaccatgagggtgacctgggcccctcctccttccattgacctgaccaacttcctggtgcgctacagccctgtgaagaatgaggaggatgtggccgagctgagcatcagccccagcgacaatgctgtggtgctgaccaacctgctgcctggaacagaatatgtggtgtctgtgtcctctgtgtatgagcagcacgagagcacccccctgcggggccggcagaagacaggcctggacagccccactggaattgacttcagtgacatcacagccaacagcttcaccgtgcactggatcgccccccgggccaccatcaccggctaccgcatccgccaccaccctgagcacttcagcggccggccccgggaggacagagtgccccacagcagaaattccatcaccctgaccaacctgaccccaggcacagaatatgtggtgtccatcgtggccctgaatggccgggaggagagccccctgctgattggccagcagagcacagtgtctgatgtgccccgggacctggaggtggtggccgccacccccaccagcctgctgatctcctgggatgccccagctgtgacagtgcgctactaccgcatcacctatggagagaccggcggcaacagccctgtgcaggagttcaccgtgcccggcagcaagagcacagccaccatcagcggcctgaagccaggagtggactacaccatcaccgtgtatgctgtgacaggccgcggggacagccctgccagcagcaagcccatcagcatcaactacagaacagaaattgacaagcccagccagatgcaggtgacagatgtgcaggacaacagcatctctgtgaagtggctgcccagcagcagccctgtgacaggctacagagtgaccaccacccccaagaatggacctggccccaccaagaccaagacagctggccctgaccagacagagatgaccatcgagggcctgcagcccaccgtggagtatgtggtgtctgtgtatgcccagaaccccagcggggagagccagcccctggtgcagacagctgtgaccaccatcccagcccccacagacctgaagttcacccaggtgacccccaccagcctgagcgcccagtggaccccaccaaatgtgcagctgaccggctacagagtgcgggtgacccccaaggagaagacaggccccatgaaggagatcaacctggccccagacagcagctctgtggtggtgtctggcctgatggtggccaccaagtatgaggtgtctgtgtatgccctgaaggacaccctgaccagcaggcctgcccagggcgtggtgaccaccctggagaatgtgtccccaccaagaagagcccgggtgacagatgccacagagaccaccatcaccatctcctggaggaccaagacagagaccatcaccggcttccaggtggatgctgtgcctgccaacggccagacccccatccagaggaccatcaagccagatgtgcgcagctacaccatcaccggcctgcagcccggcacagactacaagatctacctgtacaccctgaatgacaatgcccggagcagccctgtggtgattgatgccagcacagccattgatgcccccagcaacctgcgcttcctggccaccacccccaacagcctgctggtgtcctggcagcccccccgggcccgcatcaccggctacatcatcaagtatgagaagccaggcagccccccccgggaggtggtgccccggcccaggcctggggtgacagaggccaccatcaccggcctggagcccggcacagagtacaccatctacgtgattgccctgaagaacaaccagaagtctgagcccctgattggaaggaagaagacagatgagctgccccagctggtgaccctgccccaccccaacctgcacggccctgagatcctggatgtgcccagcacagtgcagaagaccccatttgtgacccaccctggctatgacacaggaaatggcatccagctgcccggcaccagcggccagcagcccagcgtgggccagcagatgatctttgaggagcacggcttccggaggaccaccccacccaccacagccacccccatccgccaccggccccggccctacccacccaacgtgggggaggagatccagatcggccacatccccagagaagatgtggactaccacctgtacccccacggccctggcctgaaccccaatgccagcacaggccaggaggccctgagccagaccaccatctcctgggcccccttccaggacaccagcgagtacatcatcagctgccaccctgtgggcacagatgaggagcccctgcagttccgggtgcccggcaccagcaccagcgccaccctgaccggcctgaccaggggggccacctacaacgtcatcgtggaggccctgaaggaccagcagaggcacaaggtgcgggaggaggtggtgacagtgggcaacagcgtgaatgaaggcctgaaccagcccacagatgacagctgctttgacccctacacagtgagccactatgctgtgggagatgagtgggagaggatgtctgagagcggcttcaagctgctgtgccagtgcctgggctttggaagtggccacttccgctgtgacagcagccgctggtgccacgacaatggagtgaactacaagattggagagaagtgggaccggcagggagaaaatggccagatgatgagctgcacctgcctgggcaatggcaagggggagttcaagtgtgacccccatgaggccacctgctatgatgatggcaagacctaccacgtgggggagcagtggcagaaggagtacctgggcgccatctgcagctgcacctgctttggaggccagaggggctggaggtgtgacaactgcagaagacctggaggagagcccagccctgagggcaccaccggccagagctacaaccagtacagccagcgctaccaccagaggaccaacaccaacgtgaactgccccatcgagtgcttcatgcccctggatgtgcaggccgaccgggaggacagccgggagtag

SEQ ID NO: 19730 - DNA, 312 bp, Artificial Sequence
  Description of Artificial Sequence: Synthetic coding sequence
atgcctgtgtctgtgagcagcggccgcaccttccccaagaggggccagacctgtgtggtgcactacacaggcatgctggaggatggcaagaagtttgacagcagccgggacaggaacaagcccttcaagttcatgctgggcaagcaggaggtgatccggggctgggaggagggcgtggcccagatgtctgtgggccagagggccaagctgaccatcagcccagactatgcctacggggccaccggccaccctggcatcatccccccccacgccaccctggtgtttgatgtggagctgctgaagctggagtag

SEQ ID NO: 19731 - DNA, 327 bp, Artificial Sequence
  Description of Artificial Sequence: Synthetic coding sequence
atgggcgtgcaggtggagaccatcagccctggagatggccgcaccttccccaagaggggccagacctgtgtggtgcactacacaggcatgctggaggatggcaagaagtttgacagcagccgggacaggaacaagcccttcaagttcatgctgggcaagcaggaggtgatccggggctgggaggagggcgtggcccagatgtctgtgggccagagggccaagctgaccatcagcccagactatgcctatggagccaccggccaccctggcatcatcccccctcatgccaccctggtgtttgatgtggagctgctgaagctggagtag

SEQ ID NO: 19732 - DNA, 312 bp, Artificial Sequence; identical to SEQ ID NO: 19730
  Description of Artificial Sequence: Synthetic coding sequence

SEQ ID NO: 19733 - DNA, 327 bp, Artificial Sequence; identical to SEQ ID NO: 19731
  Description of Artificial Sequence: Synthetic coding sequence

SEQ ID NO: 19734 - DNA, 279 bp, Artificial Sequence
  Description of Artificial Sequence: Synthetic coding sequence
atgggcgtgcaggtggagaccatcagccctggagatggcatgctggaggatggcaagaagtttgacagcagccgggacaggaacaagcccttcaagttcatgctgggcaagcaggaggtgatccggggctgggaggagggcgtggcccagatgtctgtgggccagagggccaagctgaccatcagcccagactatgcctatggagccaccggccaccctggcatcatcccccctcatgccaccctggtgtttgatgtggagctgctgaagctggagtag

SEQ ID NO: 19735 - DNA, 1143 bp, Artificial Sequence
  Description of Artificial Sequence: Synthetic coding sequence
atgggcatccagggcctggccaagctgattgctgatgtggcccccagcgccatccgggagaatgacatcaagagctactttggaaggaaggtggccattgatgcctccatgagcatctaccagttcctgattgctgtgcggcagggcggagatgtgctgcagaatgaggagggggagaccaccagccacctgatgggcatgttctaccgcaccatccgcatgatggagaatggcatcaagcctgtgtatgtgtttgatggcaagccaccccagctgaagagcggggagctggccaagagaagtgaaagaagagctgaggccgagaagcagctgcagcaggcccaggccgccggggctgagcaggaggtggagaagttcaccaagaggctggtgaaggtgaccaagcagcacaatgatgagtgcaagcacctgctgagcctgatgggcatcccctacctggatgcccccagcgaggccgaggccagctgtgccgccctggtgaaggccggcaaggtgtatgctgctgccacagaggacatggactgcctgaccttcggcagccctgtgctgatgaggcacctgacagccagcgaggccaagaagctgcccatccaggagttccacctgagccgcatcctgcaggagctgggcctgaaccaggagcagtttgtggacctgtgcatcctgctgggcagtgactactgtgagagcatccggggcatcggccccaagagagctgtggacctgatccagaagcacaagagcattgaggagatcgtgcggcggctggaccccaacaagtaccctgtgcctgagaactggctgcacaaggaggcccaccagctgttcctggagcctgaggtgctggaccctgagagcgtggagctgaagtggagcgagcccaatgaggaggagctgatcaagttcatgtgtggggagaagcagttcagcgaggagcgcatccgctctggagtgaagaggctgagcaagagccggcagggcagcacccagggccgcctggatgacttcttcaaggtgacaggcagcctgagcagcgccaagaggaaggagcctgagcccaagggcagcaccaagaagaaggccaagacaggagctgctgggaagttcaagaggggcaagtag

SEQ ID NO: 19736 - DNA, 498 bp, Artificial Sequence
  Description of Artificial Sequence: Synthetic coding sequence
atgggcatccagggcctggccaagctgattgctgatgtggcccccagcgccatccgggagaatgacatcaagagctactttggaaggaaggtggccattgatgcctccatgagcatctaccagttcctgattgctgtgcggcagggcggagatgtgctgcagaatgaggagggggagaccaccagccacctgatgggcatgttctaccgcaccatccgcatgatggagaatggcatcaagcctgtgtatgtgtttgatggcaagccaccccagctgaagagcggggagctggccaagagaagtgaaagaagagctgaggccgagaagcagctgcagcaggcccaggccgccggggctgagcaggaggtggagaagttcaccaagaggctggtgaaggtgaccaagcagcacaatgatgagtgcaagcacctgctgagcctgatgggcatcccctacctggatgcccccagcgaggccgaggccagctgtgccgcctag

SEQ ID NO: 19737 - DNA, 4017 bp, Artificial Sequence
  Description of Artificial Sequence: Synthetic coding sequence
atggtgtcctactgggacacaggagtgctgctgtgtgccctgctgagctgcctgctgctgaccggcagcagcagcggcagcaagctgaaggaccctgagctgagcctgaagggcacccagcacatcatgcaggccggccagaccctgcacctgcagtgccgcggggaggccgcccacaagtggagcctgcctgagatggtgtccaaggagagcgagcggctgagcatcaccaagagcgcctgtggcagaaatggcaagcagttctgcagcaccctgaccctgaacacagcccaggccaaccacacaggcttctacagctgcaagtacctggccgtgcccaccagcaagaagaaggagacagagagcgccatctacatcttcatcagtgacaccggccggccctttgtggagatgtacagcgagatccctgagatcatccacatgacagagggccgggagctggtgatcccctgccgggtgaccagccccaacatcaccgtgaccctgaagaagttccccctggacaccctcatcccagatggcaagaggatcatctgggacagcaggaagggcttcatcatcagcaatgccacctacaaggagatcggcctgctgacctgtgaggccaccgtgaatggccacctgtacaagaccaactacctgacccaccggcagaccaacaccatcattgatgtgcagatcagcacccccaggcctgtgaagctgctgcggggccacaccctggtgctgaactgcacagccaccacccccctgaacaccagggtgcagatgacctggagctacccagatgagaagaacaagagggcctctgtgagaagaagaattgaccagagcaacagccacgccaacatcttctacagcgtgctgaccatcgacaagatgcagaacaaggacaagggcctgtacacctgccgggtgcgcagcggccccagcttcaagtctgtgaacacctctgtgcacatctatgacaaggccttcatcaccgtgaagcacaggaagcagcaggtgctggagaccgtggccggcaagaggagctaccgcctgtccatgaaggtgaaggccttccccagccctgaggtggtgtggctgaaggatggcctgcctgccacagagaagagcgcccgctacctgacccggggctacagcctcatcatcaaggatgtgacagaggaggatgctggcaactacaccatcctgctgagcatcaagcagagcaatgtgttcaagaacctgacagccaccctgattgtgaatgtgaagccccagatctatgagaaggctgtgtcctccttcccagaccctgccctgtaccccctgggcagccggcagatcctgacctgcacagcctacggcatcccccagcccaccatcaagtggttctggcacccctgcaaccacaaccacagcgaggcccgctgtgacttctgcagcaacaatgaggagagcttcatcctggatgctgacagcaacatgggcaaccgcatcgagagcatcacccagaggatggccatcatcgagggcaagaacaagatggccagcaccctggtggtggccgacagccgcatcagcggcatctacatctgcatcgccagcaacaaggtgggcaccgtgggcaggaacatctccttctacatcacagatgtgcccaacggcttccacgtgaacctggagaagatgcccacagaaggagaggacctgaagctgagctgcaccgtgaacaagttcctgtacagagatgtgacctggatcctgctgaggacagtgaacaacagaaccatgcactacagcatcagcaagcagaagatggccatcaccaaggagcacagcatcaccctgaacctgaccatcatgaatgtgtccctgcaggacagcggcacctacgcctgccgggccagaaatgtgtacacaggagaggagatcctgcagaagaaggagatcaccatccgggaccaggaggccccctacctgctgaggaacctgagtgaccacacagtggccatcagcagcagcaccaccctggactgccacgccaatggagtgcctgagccccagatcacctggttcaagaacaaccacaagatccagcaggagcccggcatcatcctgggccctggcagcagcaccctcttcatcgagcgggtgacagaggaggatgaaggagtgtaccactgcaaggccaccaaccagaagggctctgtggagagcagcgcctacctgactgtgcagggcaccagtgacaagagcaacctggagctgatcaccctgacctgcacctgtgtggccgccaccctcttctggctgctgctgaccctcttcatcaggaagatgaagaggagcagcagcgagatcaagacagactacctgagcatcatcatggaccctgatgaggtgcccctggatgagcagtgtgagcggctgccctatgatgccagcaagtgggagtttgcccgggagcggctgaagctgggcaagagcctgggccgcggggccttcggcaaggtggtgcaggccagcgccttcggcatcaagaagagccccacctgcaggacagtggccgtgaagatgctgaaggagggcgccacagccagcgagtacaaggccctgatgacagagctgaagatcctgacccacatcggccaccacctgaatgtggtgaacctgctgggcgcctgcaccaagcagggcggccccctgatggtgattgtggagtactgcaagtatggcaacctgagcaactacctgaagagcaagagggacctcttcttcctgaacaaggatgctgccctgcacatggagcccaagaaggagaagatggagcccggcctggagcagggcaagaagccccggctggacagcgtgaccagcagcgagagctttgccagcagcggcttccaggaggacaagagcctgagtgatgtggaggaggaggaggacagtgatggcttctacaaggagcccatcaccatggaggacctgatctcctacagcttccaggtggcccggggcatggagttcctgagcagcaggaagtgcatccaccgggacctggccgccaggaacatcctgctgtctgagaacaacgtggtgaagatctgtgactttggcctggcccgggacatctacaagaacccagactatgtgaggaagggggacacccggctgcccctgaagtggatggcccctgagagcatctttgacaagatctacagcaccaagagtgatgtgtggagctatggagtgctgctgtgggagatcttcagcctgggcggcagcccctacccaggagtgcagatggatgaggacttctgcagccggctgcgggagggcatgaggatgagggcccctgagtacagcaccccagagatctaccagatcatgctggactgctggcaccgggaccccaaggagcggcccaggtttgctgagctggtggagaagctgggggacctgctgcaggccaacgtgcagcaggacggcaaggactacatccccatcaatgccatcctgactggaaacagcggcttcacctacagcaccccagccttcagcgaggacttcttcaaggagagcatcagcgcccccaagttcaacagcggcagcagtgatgatgtgcgctacgtgaatgccttcaagttcatgagcctggagcgcatcaagacctttgaggagctgctgcccaatgccacctccatgtttgatgactaccagggcgacagcagcaccctgctggccagccccatgctgaagcgcttcacctggacagacagcaagcccaaggccagcctgaagattgacctgcgggtgaccagcaagagcaaggagagcggcctgagtgatgtgtcccggcccagcttctgccacagcagctgtggccacgtgtctgagggcaagaggcgcttcacctatgaccacgccgagctggagaggaagatcgcctgctgcagccccccaccagactacaacagcgtggtgctgtacagcaccccacccatctag

SEQ ID NO: 19738 - DNA, 531 bp, Artificial Sequence
  Description of Artificial Sequence: Synthetic coding sequence
atggtgtcctactgggacacaggagtgctgctgtgtgccctgctgagctgcctgctgctgaccggcagcagcagcggcagcaagctgaaggaccctgagctgagcctgaagggcacccagcacatcatgcaggccggccagaccctgcacctgcagtgccgcggggaggccgcccacaagtggagcctgcctgagatggtgtccaaggagagcgagcggctgagcatcaccaagagcgcctgtggcagaaatggcaagcagttctgcagcaccctgaccctgaacacagcccaggccaaccacacaggcttctacagctgcaagtacctggccgtgcccaccagcaagaagaaggagacagagagcgccatctacatcttcatcagtgacaccggccggccctttgtggagatgtacagcgagatccctgagatcatccacatgacagagggccgggagctggtgatcccctgccgggtgaccagccccaacatcaccgtgaccctgaagaagaagaacaagagggcctag

SEQ ID NO: 19739 - DNA, 1626 bp, Artificial Sequence
  Description of Artificial Sequence: Synthetic coding sequence
atggtgtcctactgggacacaggagtgctgctgtgtgccctgctgagctgcctgctgctgaccggcagcagcagcggcagcaagctgaaggaccctgagctgagcctgaagggcacccagcacatcatgcaggccggccagaccctgcacctgcagtgccgcggggaggccgcccacaagtggagcctgcctgagatggtgtccaaggagagcgagcggctgagcatcaccaagagcgcctgtggcagaaatggcaagcagttctgcagcaccctgaccctgaacacagcccaggccaaccacacaggcttctacagctgcaagtacctggccgtgcccaccagcaagaagaaggagacagagagcgccatctacatcttcatcagtgacaccggccggccctttgtggagatgtacagcgagatccctgagatcatccacatgacagagggccgggagctggtgatcccctgccgggtgaccagccccaacatcaccgtgaccctgaagaagttccccctggacaccctcatcccagatggcaagaggatcatctgggacagcaggaagggcttcatcatcagcaatgccacctacaaggagatcggcctgctgacctgtgaggccaccgtgaatggccacctgtacaagaccaactacctgacccaccggcagaccaacaccatcattgatgtgcagatcagcacccccaggcctgtgaagctgctgcggggccacaccctggtgctgaactgcacagccaccacccccctgaacaccagggtgcagatgacctggagctacccagatgagaagaacaagagggcctctgtgagaagaagaattgaccagagcaacagccacgccaacatcttctacagcgtgctgaccatcgacaagatgcagaacaaggacaagggcctgtacacctgccgggtgcgcagcggccccagcttcaagtctgtgaacacctctgtgcacatctatgacaaggccttcatcaccgtgaagcacaggaagcagcaggtgctggagaccgtggccggcaagaggagctaccgcctgtccatgaaggtgaaggccttccccagccctgaggtggtgtggctgaaggatggcctgcctgccacagagaagagcgcccgctacctgacccggggctacagcctcatcatcaaggatgtgacagaggaggatgctggcaactacaccatcctgctgagcatcaagcagagcaatgtgttcaagaacctgacagccaccctgattgtgaatgtgaagccccagatctatgagaaggctgtgtcctccttcccagaccctgccctgtaccccctgggcagccggcagatcctgacctgcacagcctacggcatcccccagcccaccatcaagtggttctggcacccctgcaaccacaaccacagcgaggcccgctgtgacttctgcagcaacaatgaggagagcttcatcctggatgctgacagcaacatgggcaaccgcatcgagagcatcacccagaggatggccatcatcgagggcaagaacaagctgcccccagccaacagcagcttcatgctgccccccaccagcttcagcagcaactacttccacttcctgccctag

SEQ ID NO: 19740 - DNA, 1671 bp, Artificial Sequence
  Description of Artificial Sequence: Synthetic coding sequence
atgaagaggagcagcagcgagatcaagacagactacctgagcatcatcatggaccctgatgaggtgcccctggatgagcagtgtgagcggctgccctatgatgccagcaagtgggagtttgcccgggagcggctgaagctgggcaagagcctgggccgcggggccttcggcaaggtggtgcaggccagcgccttcggcatcaagaagagccccacctgcaggacagtggccgtgaagatgctgaaggagggcgccacagccagcgagtacaaggccctgatgacagagctgaagatcctgacccacatcggccaccacctgaatgtggtgaacctgctgggcgcctgcaccaagcagggcggccccctgatggtgattgtggagtactgcaagtatggcaacctgagcaactacctgaagagcaagagggacctcttcttcctgaacaaggatgctgccctgcacatggagcccaagaaggagaagatggagcccggcctggagcagggcaagaagccccggctggacagcgtgaccagcagcgagagctttgccagcagcggcttccaggaggacaagagcctgagtgatgtggaggaggaggaggacagtgatggcttctacaaggagcccatcaccatggaggacctgatctcctacagcttccaggtggcccggggcatggagttcctgagcagcaggaagtgcatccaccgggacctggccgccaggaacatcctgctgtctgagaacaacgtggtgaagatctgtgactttggcctggcccgggacatctacaagaacccagactatgtgaggaagggggacacccggctgcccctgaagtggatggcccctgagagcatctttgacaagatctacagcaccaagagtgatgtgtggagctatggagtgctgctgtgggagatcttcagcctgggcggcagcccctacccaggagtgcagatggatgaggacttctgcagccggctgcgggagggcatgaggatgagggcccctgagtacagcaccccagagatctaccagatcatgctggactgctggcaccgggaccccaaggagcggcccaggtttgctgagctggtggagaagctgggggacctgctgcaggccaacgtgcagcaggacggcaaggactacatccccatcaatgccatcctgactggaaacagcggcttcacctacagcaccccagccttcagcgaggacttcttcaaggagagcatcagcgcccccaagttcaacagcggcagcagtgatgatgtgcgctacgtgaatgccttcaagttcatgagcctggagcgcatcaagacctttgaggagctgctgcccaatgccacctccatgtttgatgactaccagggcgacagcagcaccctgctggccagccccatgctgaagcgcttcacctggacagacagcaagcccaaggccagcctgaagattgacctgcgggtgaccagcaagagcaaggagagcggcctgagtgatgtgtcccggcccagcttctgccacagcagctgtggccacgtgtctgagggcaagaggcgcttcacctatgaccacgccgagctggagaggaagatcgcctgctgcagccccccaccagactacaacagcgtggtgctgtacagcaccccacccatctag

SEQ ID NO: 19741 - DNA, 45 bp, Artificial Sequence
  Description of Artificial Sequence: Synthetic coding sequence
gagctgagcaactttgagtgcctgcacccctgcagccaggagtag

SEQ ID NO: 19742 - DNA, 2202 bp, Artificial Sequence
  Description of Artificial Sequence: Synthetic coding sequence
atggtgtcctactgggacacaggagtgctgctgtgtgccctgctgagctgcctgctgctgaccggcagcagcagcggcagcaagctgaaggaccctgagctgagcctgaagggcacccagcacatcatgcaggccggccagaccctgcacctgcagtgccgcggggaggccgcccacaagtggagcctgcctgagatggtgtccaaggagagcgagcggctgagcatcaccaagagcgcctgtggcagaaatggcaagcagttctgcagcaccctgaccctgaacacagcccaggccaaccacacaggcttctacagctgcaagtacctggccgtgcccaccagcaagaagaaggagacagagagcgccatctacatcttcatcagtgacaccggccggccctttgtggagatgtacagcgagatccctgagatcatccacatgacagagggccgggagctggtgatcccctgccgggtgaccagccccaacatcaccgtgaccctgaagaagttccccctggacaccctcatcccagatggcaagaggatcatctgggacagcaggaagggcttcatcatcagcaatgccacctacaaggagatcggcctgctgacctgtgaggccaccgtgaatggccacctgtacaagaccaactacctgacccaccggcagaccaacaccatcattgatgtgcagatcagcacccccaggcctgtgaagctgctgcggggccacaccctggtgctgaactgcacagccaccacccccctgaacaccagggtgcagatgacctggagctacccagatgagaagaacaagagggcctctgtgagaagaagaattgaccagagcaacagccacgccaacatcttctacagcgtgctgaccatcgacaagatgcagaacaaggacaagggcctgtacacctgccgggtgcgcagcggccccagcttcaagtctgtgaacacctctgtgcacatctatgacaaggccttcatcaccgtgaagcacaggaagcagcaggtgctggagaccgtggccggcaagaggagctaccgcctgtccatgaaggtgaaggccttccccagccctgaggtggtgtggctgaaggatggcctgcctgccacagagaagagcgcccgctacctgacccggggctacagcctcatcatcaaggatgtgacagaggaggatgctggcaactacaccatcctgctgagcatcaagcagagcaatgtgttcaagaacctgacagccaccctgattgtgaatgtgaagccccagatctatgagaaggctgtgtcctccttcccagaccctgccctgtaccccctgggcagccggcagatcctgacctgcacagcctacggcatcccccagcccaccatcaagtggttctggcacccctgcaaccacaaccacagcgaggcccgctgtgacttctgcagcaacaatgaggagagcttcatcctggatgctgacagcaacatgggcaaccgcatcgagagcatcacccagaggatggccatcatcgagggcaagaacaagatggccagcaccctggtggtggccgacagccgcatcagcggcatctacatctgcatcgccagcaacaaggtgggcaccgtgggcaggaacatctccttctacatcacagatgtgcccaacggcttccacgtgaacctggagaagatgcccacagaaggagaggacctgaagctgagctgcaccgtgaacaagttcctgtacagagatgtgacctggatcctgctgaggacagtgaacaacagaaccatgcactacagcatcagcaagcagaagatggccatcaccaaggagcacagcatcaccctgaacctgaccatcatgaatgtgtccctgcaggacagcggcacctacgcctgccgggccagaaatgtgtacacaggagaggagatcctgcagaagaaggagatcaccatccgggaccaggaggccccctacctgctgaggaacctgagtgaccacacagtggccatcagcagcagcaccaccctggactgccacgccaatggagtgcctgagccccagatcacctggttcaagaacaaccacaagatccagcaggagcctgagctgtacaccagcaccagccccagcagcagcagcagcagccccctgagcagcagcagcagcagcagcagcagcagcagcagctag

SEQ ID NO: 19743 - DNA, 1086 bp, Artificial Sequence
  Description of Artificial Sequence: Synthetic coding sequence
atgaacagcgacctgctggtggacagtgatggcttctacaaggagcccatcaccatggaggacctgatctcctacagcttccaggtggcccggggcatggagttcctgagcagcaggaagtgcatccaccgggacctggccgccaggaacatcctgctgtctgaaaataatgtggtgaagatctgtgactttggcctggcccgggacatctacaagaacccagactatgtgaggaaaggagacacccggctgcccctgaagtggatggcccctgagagcatctttgacaagatctacagcaccaagagtgatgtgtggagctatggagtgctgctgtgggagatcttcagcctgggcggcagcccctacccaggagtgcagatggatgaggacttctgcagccggctgcgggagggcatgaggatgagggcccctgagtacagcaccccagagatctaccagatcatgctggactgctggcaccgggaccccaaggagcggcccaggtttgctgagctggtggagaagctgggggacctgctgcaggccaacgtgcagcaggacggcaaggactacatccccatcaatgccatcctgaccggcaacagcggcttcacctacagcaccccagccttcagcgaggacttcttcaaggagagcatcagcgcccccaagttcaacagcggcagcagtgatgatgtgcgctacgtgaatgccttcaagttcatgagcctggagcgcatcaagacctttgaggagctgctgcccaatgccacctccatgtttgatgactaccagggcgacagcagcaccctgctggccagccccatgctgaagcgcttcacctggacagacagcaagcccaaggccagcctgaagattgacctgcgggtgaccagcaagagcaaggagagcggcctgagtgatgtgtcccggcccagcttctgccacagcagctgtggccacgtgtctgagggcaagaggcgcttcacctatgaccatgctgagctggagaggaagatcgcctgctgcagccccccaccagactacaacagcgtggtgctgtacagcaccccacccatctag

SEQ ID NO: 19744 - DNA, 75 bp, Artificial Sequence
  Description of Artificial Sequence: Synthetic coding sequence
ctgcccccagccaacagcagcttcatgctgccccccaccagcttcagcagcaactacttccacttcctgccctag

SEQ ID NO: 19745 - DNA, 1062 bp, Artificial Sequence
  Description of Artificial Sequence: Synthetic coding sequence
atggagctgacagagctgctgctggtggtgatgctgctgctgacagcccggctgaccctgagcagccctgcccccccagcctgtgacctgcgggtgctgagcaagctgctgcgggacagccacgtgctgcacagccggctgagccagtgcccagaggtgcaccccctgcccacccctgtgctgctgcctgctgtggacttcagcctgggggagtggaagacccagatggaggagaccaaggcccaggacatcctgggcgctgtgaccctgctgctggagggcgtgatggccgcccggggccagctgggccccacctgcctgagcagcctgctgggccagctgagcggccaggtgcggctgctgctgggcgccctgcagagcctgctgggcacccagctgcccccccagggccgcaccacagcccacaaggaccccaatgccatcttcctgtccttccagcacctgctgcggggcaaggtgcgcttcctgatgctggtgggcggcagcaccctgtgtgtgcggcgggccccacccaccacagctgtgcccagcaggaccagcctggtgctgaccctgaatgagctgcccaacagaaccagcggcctgctggagaccaacttcaccgccagcgcccggaccaccggcagcggcctgctgaagtggcagcagggcttccgggccaagatccctggcctgctgaaccagaccagccgcagcctggaccagatccctggctacctgaaccgcatccacgagctgctgaatggcacccggggcctcttccctggccccagcaggaggaccctgggcgccccagacatcagcagcggcaccagtgacaccggcagcctgccccccaacctgcagcccggctacagccccagccccacccaccccccaacaggccagtacaccctcttccccctgccccccaccctgcccacccctgtggtgcagctgcaccccctgctgcctgaccccagcgcccccacccccacccccaccagccccctgctgaacaccagctacacccacagccagaacctgagccaggagggctag

SEQ ID NO: 19746 - DNA, 537 bp, Artificial Sequence
  Description of Artificial Sequence: Synthetic coding sequence
atgacagtgctggccccagcctggagccccaccacctacctgctgctgctgctgctgctgagcagcggcctgagcggcacccaggactgcagcttccagcacagccccatcagcagtgactttgctgtgaagatccgggagctgagtgactacctgctgcaggactaccctgtgacagtggccagcaacctgcaggatgaggagctgtgtggcggcctgtggaggctggtgctggcccagcgctggatggagcggctgaagacagtggccggcagcaagatgcagggcctgctggagcgggtgaacacagagatccactttgtgaccaagtgtgccttccagcccccacccagctgcctgcgctttgtgcagaccaacatcagccggctgctgcaggagaccagcgagcagctggtggccctgaagccctggatcacccggcagaacttcagccgctgcctggagctgcagtgccagcctgtggagaccgtcttccaccgggtgtcccaggacggcctggacctgctgaccagctag

SEQ ID NO: 19747 - DNA, 708 bp, Artificial Sequence
  Description of Artificial Sequence: Synthetic coding sequence
atgacagtgctggccccagcctggagccccaccacctacctgctgctgctgctgctgctgagcagcggcctgagcggcacccaggactgcagcttccagcacagccccatcagcagtgactttgctgtgaagatccgggagctgagtgactacctgctgcaggactaccctgtgacagtggccagcaacctgcaggatgaggagctgtgtggcggcctgtggaggctggtgctggcccagcgctggatggagcggctgaagacagtggccggcagcaagatgcagggcctgctggagcgggtgaacacagagatccactttgtgaccaagtgtgccttccagcccccacccagctgcctgcgctttgtgcagaccaacatcagccggctgctgcaggagaccagcgagcagctggtggccctgaagccctggatcacccggcagaacttcagccgctgcctggagctgcagtgccagcctgacagcagcaccctgcccccaccctggagcccccggcccctggaggccacagcccccacagccccccagccccccctgctgctgctgctgctgctgcctgtgggcctgctgctgctggccgccgcctggtgcctgcactggcagaggaccaggaggaggacccccaggcctggagagcaggtgccccctgtgcccagcccccaggacctgctgctggtggagcactag

SEQ ID NO: 19748 - DNA, 4092 bp, Artificial Sequence
  Description of Artificial Sequence: Synthetic coding sequence
atgcagagaggagctgccctgtgcctgcggctgtggctgtgcctgggcctgctggatggcctggtgtctggctacagcatgaccccacccaccctgaacatcacagaggagagccacgtgattgacacaggagacagcctgagcatcagctgccggggccagcaccccctggagtgggcctggccaggggcccaggaggccccagccaccggggacaaggacagcgaggacaccggggtggtgcgggactgtgagggcacagatgcccggccctactgcaaggtgctgctgctgcacgaggtgcacgccaatgacaccggcagctatgtgtgctactacaagtacatcaaggcccgcatcgagggcaccacagctgccagcagctatgtgtttgtgcgggactttgagcagcccttcatcaacaagccagacaccctgctggtgaacaggaaggatgccatgtgggtgccctgcctggtgtccatccctggcctgaatgtgaccctgcggagccagagctctgtgctgtggccagatggccaggaggtggtgtgggatgaccggcggggcatgctggtgtccacccccctgctgcatgatgccctgtacctgcagtgtgagaccacctggggagaccaggacttcctgagcaaccccttcctggtgcacatcactggaaatgagctgtatgacatccagctgctgcccaggaagagcctggagctgctggtgggggagaagctggtgctgaactgcaccgtgtgggccgagttcaacagcggcgtgacctttgactgggactacccaggcaagcaggccgagcggggcaagtgggtgcctgagcggcgcagccagcagacccacacagagctgagcagcatcctgaccatccacaacgtgtcccagcacgacctgggcagctatgtgtgcaaggccaacaacggcatccagcgcttccgggagagcacagaggtgattgtgcatgagaaccccttcatctctgtggagtggctgaagggccccatcctggaggccacagctggagatgagctggtgaagctgcctgtgaagctggccgcctacccacctcctgagttccagtggtacaaggatggcaaggccctgagcggccgccacagcccccacgccctggtgctgaaggaggtgacagaggccagcacaggcacctacaccctggccctgtggaacagcgctgctggcctgcggaggaacatcagcctggagctggtggtgaatgtgcccccccagatccacgagaaggaggccagcagccccagcatctacagccgccacagccggcaggccctgacctgcacagcctacggcgtgcccctgcccctgagcatccagtggcactggaggccctggaccccctgcaagatgtttgcccagaggagcctgcggcggcggcagcagcaggacctgatgccccagtgccgggactggagggctgtgaccacccaggatgctgtgaaccccatcgagagcctggacacctggacagaatttgtggagggcaagaacaagacagtgtccaagctggtgatccagaatgccaacgtgtctgccatgtacaagtgtgtggtgagcaacaaggtgggccaggatgagcggctcatctacttctacgtgaccaccatcccagatggcttcaccatcgagagcaagcccagcgaggagctgctggagggccagcctgtgctgctgagctgccaggccgacagctacaagtatgagcacctgcgctggtaccgcctgaacctgagcaccctgcatgatgcccacggcaaccccctgctgctggactgcaagaatgtgcacctgtttgccacccccctggccgccagcctggaggaggtggcccctggggcccggcatgccaccctgagcctgagcatcccccgggtggcccctgagcacgagggccactacgtgtgtgaggtgcaggaccggcgcagccatgacaagcactgccacaagaagtacctgtctgtgcaggccctggaggccccccggctgacccagaacctgacagacctgctggtgaatgtgtctgacagcctggagatgcagtgcctggtggccggggcccacgcccccagcatcgtgtggtacaaggatgagcggctgctggaggagaagagcggcgtggacctggccgacagcaaccagaagctgagcatccagagggtgcgggaggaggatgctggccgctacctgtgcagcgtgtgcaatgccaagggctgtgtgaacagcagcgcctctgtggccgtggagggctctgaagataaaggctccatggagatcgtcatcctggtgggcaccggggtgattgctgtgttcttctgggtgctgctgctgctgatcttctgcaacatgagaagacctgcccacgccgacatcaagacaggctacctgagcatcatcatggaccctggagaggtgcccctggaggagcagtgtgagtacctgtcctatgatgccagccagtgggagttcccccgggagcggctgcacctgggccgggtgctgggctatggagccttcggcaaggtggtggaggccagcgccttcggcatccacaagggcagcagctgtgacacagtggccgtgaagatgctgaaggagggcgccacagccagcgagcaccgggccctgatgtctgagctgaagatcctgatccacatcggcaaccacctgaatgtggtgaacctgctgggcgcctgcaccaagccccagggccccctgatggtgattgtggagttctgcaagtatggcaacctgagcaacttcctgcgggccaagagagatgccttcagcccctgtgccgagaagagccctgagcagaggggccgcttccgggccatggtggagctggcccggctggacagaagaagacctggcagcagtgacagagtgctgtttgcccgcttcagcaagacagagggcggggcccggcgggccagcccagaccaggaggccgaggacctgtggctgagccccctgaccatggaggacctggtgtgctacagcttccaggtggcccggggcatggagttcctggccagcaggaagtgcatccaccgggacctggccgccaggaacatcctgctgtctgagagtgatgtggtgaagatctgtgactttggcctggcccgggacatctacaaggaccctgactatgtgaggaaaggaagtgcccggctgcccctgaagtggatggcccctgagagcatctttgacaaggtgtacaccacccagagtgatgtgtggagctttggagtgctgctgtgggagatcttcagcctgggcgccagcccctacccaggagtgcagatcaatgaggagttctgccagaggctgagagatggcaccaggatgagggcccctgagctggccaccccagccatccgccgcatcatgctgaactgctggagcggggaccccaaggcccggcctgccttcagcgagctggtggagatcctgggggacctgctgcagggccggggcctgcaggaggaggaggaggtgtgcatggcccccaggagcagccagagcagcgaggagggcagcttcagccaggtgtccaccatggccctgcacatcgcccaggctgatgctgaggacagcccccccagcctgcagaggcacagcctggccgcccgctactacaactgggtgtccttccctggctgcctggcccggggagctgagacccggggcagcagcaggatgaagacctttgaggagttccccatgacccccaccacctacaagggctctgtggacaaccagacagattctggcatggtgctggccagcgaggagtttgagcagatcgagagccgccaccggcaggagagcggcttcagctgcaagggccctggccagaatgtggccgtgacccgggcccacccagacagccagggcagaagaagaagacctgagcggggggcccggggcggccaggtgttctacaacagtgaatatggagagctgtctgagcccagcgaggaggaccactgcagccccagcgcccgggtgaccttcttcacagacaacagctactag

SEQ ID NO: 19749 - DNA, 2283 bp, Artificial Sequence
  Description of Artificial Sequence: Synthetic coding sequence
atgctggtgtccacccccctgctgcatgatgccctgtacctgcagtgtgagaccacctggggagaccaggacttcctgagcaaccccttcctggtgcacatcactggaaatgagctgtatgacatccagctgctgcccaggaagagcctggagctgctggtgggggagaagctggtgctgaactgcaccgtgtgggccgagttcaacagcggcgtgacctttgactgggactacccaggcaagcaggccgagcggggcaagtgggtgcctgagcggcgcagccagcagacccacacagagctgagcagcatcctgaccatccacaacgtgtcccagcacgacctgggcagctatgtgtgcaaggccaacaacggcatccagcgcttccgggagagcacagaggtgattgtgcatgagaaccccttcatctctgtggagtggctgaagggccccatcctggaggccacagctggagatgagctggtgaagctgcctgtgaagctggccgcctacccacctcctgagttccagtggtacaaggatggcaaggccctgagcggccgccacagcccccacgccctggtgctgaaggaggtgacagaggccagcacaggcacctacaccctggccctgtggaacagcgctgctggcctgcggaggaacatcagcctggagctggtggtgaatgtgcccccccagatccacgagaaggaggccagcagccccagcatctacagccgccacagccggcaggccctgacctgcacagcctacggcgtgcccctgcccctgagcatccagtggcactggaggccctggaccccctgcaagatgtttgcccagaggagcctgcggcggcggcagcagcaggacctgatgccccagtgccgggactggagggctgtgaccacccaggatgctgtgaaccccatcgagagcctggacacctggacagaatttgtggagggcaagaacaagacagtgtccaagctggtgatccagaatgccaacgtgtctgccatgtacaagtgtgtggtgagcaacaaggtgggccaggatgagcggctcatctacttctacgtgaccaccatcccagatggcttcaccatcgagagcaagcccagcgaggagctgctggagggccagcctgtgctgctgagctgccaggccgacagctacaagtatgagcacctgcgctggtaccgcctgaacctgagcaccctgcatgatgcccacggcaaccccctgctgctggactgcaagaatgtgcacctgtttgccacccccctggccgccagcctggaggaggtggcccctggggcccggcatgccaccctgagcctgagcatcccccgggtggcccctgagcacgagggccactacgtgtgtgaggtgcaggaccggcgcagccatgacaagcactgccacaagaagtacctgtctgtgcaggccctggaggccccccggctgacccagaacctgacagacctgctggtgaatgtgtctgacagcctggagatgcagtgcctggtggccggggcccacgcccccagcatcgtgtggtacaaggatgagcggctgctggaggagaagagcggcgtggacctggccgacagcaaccagaagctgagcatccagagggtgcgggaggaggatgctggccgctacctgtgcagcgtgtgcaatgccaagggctgtgtgaacagcagcgcctctgtggccgtggagggctctgaagataaaggctccatggagatcgtcatcctggtgggcaccggggtgattgctgtgttcttctgggtgctgctgctgctgatcttctgcaacatgagaagacctgcccacgccgacatcaagacaggctacctgagcatcatcatggaccctggagaggtgcccctggaggagcagtgtgagtacctgtcctatgatgccagccagtgggagttcccccgggagcggctgcacctgggccgggtgctgggctatggagccttcggcaaggtggtggaggccagcgccttcggcatccacaagggcagcagctgtgacacagtggccgtgaagatgctgaagggcgtgggcagcgctgggggccggggcagcctggccggggaggagcagcagctgggcgtgggccgctgggatggcaacagcggccgggagacagaagctggcagccagagccacccccgcttctaccgggaggccgccggcttccgggcagagggccccccagagccccccagcgtgggccctgctggctgccctgggggcccctag

SEQ ID NO: 19750 - DNA, 3897 bp, Artificial Sequence
  Description of Artificial Sequence: Synthetic coding sequence
atgcagagaggagctgccctgtgcctgcggctgtggctgtgcctgggcctgctggatggcctggtgtctggctacagcatgaccccacccaccctgaacatcacagaggagagccacgtgattgacacaggagacagcctgagcatcagctgccggggccagcaccccctggagtgggcctggccaggggcccaggaggccccagccaccggggacaaggacagcgaggacaccggggtggtgcgggactgtgagggcacagatgcccggccctactgcaaggtgctgctgctgcacgaggtgcacgccaatgacaccggcagctatgtgtgctactacaagtacatcaaggcccgcatcgagggcaccacagctgccagcagctatgtgtttgtgcgggactttgagcagcccttcatcaacaagccagacaccctgctggtgaacaggaaggatgccatgtgggtgccctgcctggtgtccatccctggcctgaatgtgaccctgcggagccagagctctgtgctgtggccagatggccaggaggtggtgtgggatgaccggcggggcatgctggtgtccacccccctgctgcatgatgccctgtacctgcagtgtgagaccacctggggagaccaggacttcctgagcaaccccttcctggtgcacatcactggaaatgagctgtatgacatccagctgctgcccaggaagagcctggagctgctggtgggggagaagctggtgctgaactgcaccgtgtgggccgagttcaacagcggcgtgacctttgactgggactacccaggcaagcaggccgagcggggcaagtgggtgcctgagcggcgcagccagcagacccacacagagctgagcagcatcctgaccatccacaacgtgtcccagcacgacctgggcagctatgtgtgcaaggccaacaacggcatccagcgcttccgggagagcacagaggtgattgtgcatgagaaccccttcatctctgtggagtggctgaagggccccatcctggaggccacagctggagatgagctggtgaagctgcctgtgaagctggccgcctacccacctcctgagttccagtggtacaaggatggcaaggccctgagcggccgccacagcccccacgccctggtgctgaaggaggtgacagaggccagcacaggcacctacaccctggccctgtggaacagcgctgctggcctgcggaggaacatcagcctggagctggtggtgaatgtgcccccccagatccacgagaaggaggccagcagccccagcatctacagccgccacagccggcaggccctgacctgcacagcctacggcgtgcccctgcccctgagcatccagtggcactggaggccctggaccccctgcaagatgtttgcccagaggagcctgcggcggcggcagcagcaggacctgatgccccagtgccgggactggagggctgtgaccacccaggatgctgtgaaccccatcgagagcctggacacctggacagaatttgtggagggcaagaacaagacagtgtccaagctggtgatccagaatgccaacgtgtctgccatgtacaagtgtgtggtgagcaacaaggtgggccaggatgagcggctcatctacttctacgtgaccaccatcccagatggcttcaccatcgagagcaagcccagcgaggagctgctggagggccagcctgtgctgctgagctgccaggccgacagctacaagtatgagcacctgcgctggtaccgcctgaacctgagcaccctgcatgatgcccacggcaaccccctgctgctggactgcaagaatgtgcacctgtttgccacccccctggccgccagcctggaggaggtggcccctggggcccggcatgccaccctgagcctgagcatcccccgggtggcccctgagcacgagggccactacgtgtgtgaggtgcaggaccggcgcagccatgacaagcactgccacaagaagtacctgtctgtgcaggccctggaggccccccggctgacccagaacctgacagacctgctggtgaatgtgtctgacagcctggagatgcagtgcctggtggccggggcccacgcccccagcatcgtgtggtacaaggatgagcggctgctggaggagaagagcggcgtggacctggccgacagcaaccagaagctgagcatccagagggtgcgggaggaggatgctggccgctacctgtgcagcgtgtgcaatgccaagggctgtgtgaacagcagcgcctctgtggccgtggagggctctgaagataaaggctccatggagatcgtcatcctggtgggcaccggggtgattgctgtgttcttctgggtgctgctgctgctgatcttctgcaacatgagaagacctgcccacgccgacatcaagacaggctacctgagcatcatcatggaccctggagaggtgcccctggaggagcagtgtgagtacctgtcctatgatgccagccagtgggagttcccccgggagcggctgcacctgggccgggtgctgggctatggagccttcggcaaggtggtggaggccagcgccttcggcatccacaagggcagcagctgtgacacagtggccgtgaagatgctgaaggagggcgccacagccagcgagcaccgggccctgatgtctgagctgaagatcctgatccacatcggcaaccacctgaatgtggtgaacctgctgggcgcctgcaccaagccccagggccccctgatggtgattgtggagttctgcaagtatggcaacctgagcaacttcctgcgggccaagagagatgccttcagcccctgtgccgagaagagccctgagcagaggggccgcttccgggccatggtggagctggcccggctggacagaagaagacctggcagcagtgacagagtgctgtttgcccgcttcagcaagacagagggcggggcccggcgggccagcccagaccaggaggccgaggacctgtggctgagccccctgaccatggaggacctggtgtgctacagcttccaggtggcccggggcatggagttcctggccagcaggaagtgcatccaccgggacctggccgccaggaacatcctgctgtctgagagtgatgtggtgaagatctgtgactttggcctggcccgggacatctacaaggaccctgactatgtgaggaaaggaagtgcccggctgcccctgaagtggatggcccctgagagcatctttgacaaggtgtacaccacccagagtgatgtgtggagctttggagtgctgctgtgggagatcttcagcctgggcgccagcccctacccaggagtgcagatcaatgaggagttctgccagaggctgagagatggcaccaggatgagggcccctgagctggccaccccagccatccgccgcatcatgctgaactgctggagcggggaccccaaggcccggcctgccttcagcgagctggtggagatcctgggggacctgctgcagggccggggcctgcaggaggaggaggaggtgtgcatggcccccaggagcagccagagcagcgaggagggcagcttcagccaggtgtccaccatggccctgcacatcgcccaggctgatgctgaggacagcccccccagcctgcagaggcacagcctggccgcccgctactacaactgggtgtccttccctggctgcctggcccggggagctgagacccggggcagcagcaggatgaagacctttgaggagttccccatgacccccaccacctacaagggctctgtggacaaccagacagattctggcatggtgctggccagcgaggagtttgagcagatcgagagccgccaccggcaggagagcggcttcagatag

SEQ ID NO: 19751 - DNA, 3921 bp, Artificial Sequence
  Description of Artificial Sequence: Synthetic coding sequence
atgcagagaggagctgccctgtgcctgcggctgtggctgtgcctgggcctgctggatggcctggtgtctggctacagcatgaccccacccaccctgaacatcacagaggagagccacgtgattgacacaggagacagcctgagcatcagctgccggggccagcaccccctggagtgggcctggccaggggcccaggaggccccagccaccggggacaaggacagcgaggacaccggggtggtgcgggactgtgagggcacagatgcccggccctactgcaaggtgctgctgctgcacgaggtgcacgccaatgacaccggcagctatgtgtgctactacaagtacatcaaggcccgcatcgagggcaccacagctgccagcagctatgtgtttgtgcgggactttgagcagcccttcatcaacaagccagacaccctgctggtgaacaggaaggatgccatgtgggtgccctgcctggtgtccatccctggcctgaatgtgaccctgcggagccagagctctgtgctgtggccagatggccaggaggtggtgtgggatgaccggcggggcatgctggtgtccacccccctgctgcatgatgccctgtacctgcagtgtgagaccacctggggagaccaggacttcctgagcaaccccttcctggtgcacatcactggaaatgagctgtatgacatccagctgctgcccaggaagagcctggagctgctggtgggggagaagctggtgctgaactgcaccgtgtgggccgagttcaacagcggcgtgacctttgactgggactacccaggcaagcaggccgagcggggcaagtgggtgcctgagcggcgcagccagcagacccacacagagctgagcagcatcctgaccatccacaacgtgtcccagcacgacctgggcagctatgtgtgcaaggccaacaacggcatccagcgcttccgggagagcacagaggtgattgtgcatgagaaccccttcatctctgtggagtggctgaagggccccatcctggaggccacagctggagatgagctggtgaagctgcctgtgaagctggccgcctacccacctcctgagttccagtggtacaaggatggcaaggccctgagcggccgccacagcccccacgccctggtgctgaaggaggtgacagaggccagcacaggcacctacaccctggccctgtggaacagcgctgctggcctgcggaggaacatcagcctggagctggtggtgaatgtgcccccccagatccacgagaaggaggccagcagccccagcatctacagccgccacagccggcaggccctgacctgcacagcctacggcgtgcccctgcccctgagcatccagtggcactggaggccctggaccccctgcaagatgtttgcccagaggagcctgcggcggcggcagcagcaggacctgatgccccagtgccgggactggagggctgtgaccacccaggatgctgtgaaccccatcgagagcctggacacctggacagaatttgtggagggcaagaacaagacagtgtccaagctggtgatccagaatgccaacgtgtctgccatgtacaagtgtgtggtgagcaacaaggtgggccaggatgagcggctcatctacttctacgtgaccaccatcccagatggcttcaccatcgagagcaagcccagcgaggagctgctggagggccagcctgtgctgctgagctgccaggccgacagctacaagtatgagcacctgcgctggtaccgcctgaacctgagcaccctgcatgatgcccacggcaaccccctgctgctggactgcaagaatgtgcacctgtttgccacccccctggccgccagcctggaggaggtggcccctggggcccggcatgccaccctgagcctgagcatcccccgggtggcccctgagcacgagggccactacgtgtgtgaggtgcaggaccggcgcagccatgacaagcactgccacaagaagtacctgtctgtgcaggccctggaggccccccggctgacccagaacctgacagacctgctggtgaatgtgtctgacagcctggagatgcagtgcctggtggccggggcccacgcccccagcatcgtgtggtacaaggatgagcggctgctggaggagaagagcggcgtggacctggccgacagcaaccagaagctgagcatccagagggtgcgggaggaggatgctggccgctacctgtgcagcgtgtgcaatgccaagggctgtgtgaacagcagcgcctctgtggccgtggagggctctgaagataaaggctccatggagatcgtcatcctggtgggcaccggggtgattgctgtgttcttctgggtgctgctgctgctgatcttctgcaacatgagaagacctgcccacgccgacatcaagacaggctacctgagcatcatcatggaccctggagaggtgcccctggaggagcagtgtgagtacctgtcctatgatgccagccagtgggagttcccccgggagcggctgcacctgggccgggtgctgggctatggagccttcggcaaggtggtggaggccagcgccttcggcatccacaagggcagcagctgtgacacagtggccgtgaagatgctgaaggagggcgccacagccagcgagcaccgggccctgatgtctgagctgaagatcctgatccacatcggcaaccacctgaatgtggtgaacctgctgggcgcctgcaccaagccccagggccccctgatggtgattgtggagttctgcaagtatggcaacctgagcaacttcctgcgggccaagagagatgccttcagcccctgtgccgagaagagccctgagcagaggggccgcttccgggccatggtggagctggcccggctggacagaagaagacctggcagcagtgacagagtgctgtttgcccgcttcagcaagacagagggcggggcccggcgggccagcccagaccaggaggccgaggacctgtggctgagccccctgaccatggaggacctggtgtgctacagcttccaggtggcccggggcatggagttcctggccagcaggaagtgcatccaccgggacctggccgccaggaacatcctgctgtctgagagtgatgtggtgaagatctgtgactttggcctggcccgggacatctacaaggaccctgactatgtgaggaaaggaagtgcccggctgcccctgaagtggatggcccctgagagcatctttgacaaggtgtacaccacccagagtgatgtgtggagctttggagtgctgctgtgggagatcttcagcctgggcgccagcccctacccaggagtgcagatcaatgaggagttctgccagaggctgagagatggcaccaggatgagggcccctgagctggccaccccagccatccgccgcatcatgctgaactgctggagcggggaccccaaggcccggcctgccttcagcgagctggtggagatcctgggggacctgctgcagggccggggcctgcaggaggaggaggaggtgtgcatggcccccaggagcagccagagcagcgaggagggcagcttcagccaggtgtccaccatggccctgcacatcgcccaggctgatgctgaggacagcccccccagcctgcagaggcacagcctggccgcccgctactacaactgggtgtccttccctggctgcctggcccggggagctgagacccggggcagcagcaggatgaagacctttgaggagttccccatgacccccaccacctacaagggctctgtggacaaccagacagattctggcatggtgctggccagcgaggagtttgagcagatcgagagccgccaccggcaggagagcggcttccggggcaccaggaggaccaggggggcctag

SEQ ID NO: 19752 - DNA, 1740 bp, Artificial Sequence
  Description of Artificial Sequence: Synthetic coding sequence
atgaatgccatcgtggccctgtgccacttctgtgagctgcacggccccaggaccctcttctgcacagaggtgctgcacgcccccctgccccagggagatggaaatgaagacagccctggccagggcgagcaggccgaggaggaggagggcggcatccagatgaacagcaggatgagggcccacagccctgctgagggcgcctctgtggagagcagcagccctggccccaagaagagtgacatgtgtgagggctgccgcagcctggccgccggccaccctggctacatcagccatgacaaggagaccagcatcaagtatgtgagccaccagcaccccagccacccccagctgttcagcatcgtgcggcaggcctgtgtgcgcagcctgagctgtgaggtgtgccccggccgggagggccccatcttctttggagatgagcagcacggctttgtgttcagccacaccttcttcatcaaggacagcctggcccggggcttccagcgctggtacagcatcatcaccatcatgatggaccgcatctacctgatcaacagctggcccttcctgctgggcaaggtgcggggcatcattgatgagctgcagggcaaggccctgaaggtgtttgaggccgagcagtttggctgcccccagagggcccagaggatgaacacagccttcacccccttcctgcaccagagaaatggaaatgctgcccggagcctgaccagcctgaccagtgatgacaacctgtgggcctgcctgcacaccagctttgcctggctgctgaaggcctgtggcagccggctgacagagaagctgctggagggcgcccccacagaggacaccctggtgcagatggagaagctggccgacctggaggaggagagcgagagctgggacaacagcgaggccgaggaggaggagaaggcccctgtgctgcctgagagcacagagggccgggagctgacccagggccctgctgagagcagcagcctgagcggctgcggctcctggcagcccaggaagctgcccgtcttcaagagcctgcggcacatgaggcaggtgctgggcgcccccagcttcaggatgctggcctggcacgtgctgatgggcaaccaggtgatctggaagagcagagatgtggacctggtgcagagcgcctttgaggtgctgcggaccatgctgcctgtgggctgtgtgcgcatcatcccctacagcagccagtatgaggaggcctaccgctgcaacttcctgggcctgagcccccacgtgcagatcccccctcatgtgctgagcagcgagtttgctgtgattgtggaggtgcatgctgctgcccggagcaccctgcaccctgtgggctgtgaagatgaccagagcctgagcaaatatgaatttgtggtgaccagcggcagccctgtggccgctgacagagtgggccccaccatcctgaacaagattgaggccgccctgaccaaccagaacctgtctgtggatgtggtggaccagtgcctggtgtgcctgaaggaggagtggatgaacaaggtgaaggtgctcttcaagttcaccaaggtggacagccggcccaaggaggacacccagaagctgctgagcatcctgggcgccagcgaggaggacaacgtgaagctgctgaagttctggatgacaggcctgagcaagacctacaagagccacctgatgagcacagtgcgcagccccacagccagcgagagcaggaactag

SEQ ID NO: 19753 - DNA, 594 bp, Artificial Sequence
  Description of Artificial Sequence: Synthetic coding sequence
atgaatgccatcgtggccctgtgccacttctgtgagctgcacggccccaggaccctcttctgcacagaggtgctgcacgcccccctgccccagggagatggaaatgaagacagccctggccagggcgagcaggccgaggaggaggagggcggcatccagatgaacagcaggatgagggcccacagccctgctgagggcgcctctgtggagagcagcagccctggccccaagaagagtgacatgtgtgagggctgccgcagcctggccgccggccaccctggctacatcagccatgacaaggagaccagcatcaagtatgtgagccaccagcaccccagccacccccagctgttcagcatcgtgcggcaggcctgtgtgcgcagcctgagctgtgaggtgtccctggtggccacagagcctgtgtctgtgggcgcccacatgctgcccggggccctgggcggcctgggcgccagcatcgcccagggcggccgccactggagcagcctgcgggctgacccccagatcagcacagcccagggcaccggccgcctgccctgcccagagctgcgggaggagagctgctggacctgctag

SEQ ID NO: 19754 - DNA, 1029 bp, Artificial Sequence
  Description of Artificial Sequence: Synthetic coding sequence
atgaatgccatcgtggccctgtgccacttctgtgagctgcacggccccaggaccctcttctgcacagaggtgctgcacgcccccctgccccagggagatggaaatgaagacagccctggccagggcgagcaggccgaggaggaggagggcggcatccagatgaacagcaggatgagggcccacagccctgctgagggcgcctctgtggagagcagcagccctggccccaagaagagtgacatgtgtgagggctgccgcagcctggccgccggccaccctggctacatcagccatgacaaggagaccagcatcaagtatgtgagccaccagcaccccagccacccccagctgttcagcatcgtgcggcaggcctgtgtgcgcagcctgagctgtgaggtgtgccccggccgggagggccccatcttctttggagatgagcagcacggctttgtgttcagccacaccttcttcatcaaggacagcctggcccggggcttccagcgctggtacagcatcatcaccatcatgatggaccgcatctacctgatcaacagctggcccttcctgctgggcaaggtgcggggcatcattgatgagctgcagggcaaggccctgaaggtgtttgaggccgagcagtttggctgcccccagagggcccagaggatgaacacagccttcacccccttcctgcaccagagaaatggaaatgctgcccggagcctgaccagcctgaccagtgatgacaacctgtgggcctgcctgcacaccagctttgcctggctgctgaaggcctgtggcagccggctgacagagaagctgctggagggcgcccccacagaggacaccctggtgcagatggagaagctggccggggaggccggcgtgctgctgcccggcccctggccaggctggccctggggcggcaccagctgcctgctgtcctggcaggagagcctgcgggagggcaatgctgccctgaaccagcccaggaccagcctgcgggaggcccacccccccatctctgtgtag

SEQ ID NO: 19755 - DNA, 594 bp, Artificial Sequence; identical to SEQ ID NO: 19753
  Description of Artificial Sequence: Synthetic coding sequence

SEQ ID NO: 19756 - DNA, 462 bp, Artificial Sequence
  Description of Artificial Sequence: Synthetic coding sequence
atgaacagcaggatgagggcccacagccctgctgagggcgcctctgtggagagcagcagccctggccccaagaagagtgacatgtgtgagggctgccgcagcctggccgccggccaccctggctacatcagccatgacaaggagaccagcatcaagtatgtgagccaccagcaccccagccacccccagctgttcagcatcgtgcggcaggcctgtgtgcgcagcctgagctgtgaggtgtgccccggccgggagggccccatcttctttggagatgagcagcacggctttgtgttcagccacaccttcttcatcaaggacagcctggcccggggcttccagcgctggtacagcatcatcaccatcatgatggaccgcatctacctgatcaacagctggcccttcctgctgggcaaggtgcggggcatcattgatgagctgcagggcaaggccctgaagtag

SEQ ID NO: 19757 - DNA, 1419 bp, Artificial Sequence
  Description of Artificial Sequence: Synthetic coding sequence
atgctgggcaccgtgaagatggagggccacgagaccagtgactggaacagctactatgctgacacccaggaggcctacagctctgtgcctgtgagcaacatgaacagcggcctgggctccatgaacagcatgaacacctacatgaccatgaacaccatgaccaccagcggcaacatgaccccagccagcttcaacatgtcctatgccaaccctggcctgggcgccggcctgagccctggagctgtggccggcatgcctgggggcagcgctggggccatgaacagcatgacagctgctggggtgacagccatgggcacagccctgagccccagcggcatgggcgccatgggcgcccagcaggccgcctccatgaatggcctgggcccctatgctgctgccatgaacccctgcatgagccccatggcctatgcccccagcaacctgggccgcagcagagctgggggcggcggagatgccaagaccttcaagaggagctacccccacgccaagccaccctacagctacatcagcctcatcaccatggccatccagcaggcccccagcaagatgctgaccctgtctgagatctaccagtggatcatggacctcttcccctactaccggcagaaccagcagcgctggcagaacagcatccgccacagcctgtccttcaatgactgctttgtgaaggtggcccggagcccagacaagccaggcaagggcagctactggaccctgcacccagacagcggcaacatgtttgaaaatggctgctacctgcggcggcagaagcgcttcaagtgtgagaagcagcccggggccggcggcggcggcggcagcggcagcggcggcagcggggccaagggcggccctgagagcaggaaggaccccagcggggccagcaaccccagcgctgacagccccctgcaccggggcgtgcacggcaagacaggccagctggagggcgccccagcccctggccctgctgccagcccccagaccctggaccacagcggggccacagccactggaggagccagcgagctgaagaccccagccagcagcacagccccacccatcagcagcggccctggggccctggcctctgtgcctgccagccacccagcccacggcctggcccctcatgagagccagctgcacctgaagggggacccccactacagcttcaaccaccccttcagcatcaacaacctgatgagcagcagcgagcagcagcacaagctggacttcaaggcctatgagcaggccctgcagtacagcccctacggcagcaccctgcctgccagcctgcccctgggcagcgcctctgtgaccaccaggagccccatcgagcccagcgccctggagcccgcctactaccagggcgtgtacagcaggcctgtgctgaacaccagctag

SEQ ID NO: 19758 - DNA, 1320 bp, Artificial Sequence
  Description of Artificial Sequence: Synthetic coding sequence
atgaacagcggcctgggctccatgaacagcatgaacacctacatgaccatgaacaccatgaccaccagcggcaacatgaccccagccagcttcaacatgtcctatgccaaccctggcctgggcgccggcctgagccctggagctgtggccggcatgcctgggggcagcgctggggccatgaacagcatgacagctgctggggtgacagccatgggcacagccctgagccccagcggcatgggcgccatgggcgcccagcaggccgcctccatgaatggcctgggcccctatgctgctgccatgaacccctgcatgagccccatggcctatgcccccagcaacctgggccgcagccgggccggcggcggcggagatgccaagaccttcaagaggagctacccccacgccaagccaccctacagctacatcagcctcatcaccatggccatccagcaggcccccagcaagatgctgaccctgtctgagatctaccagtggatcatggacctcttcccctactaccggcagaaccagcagcgctggcagaacagcatccgccacagcctgtccttcaatgactgctttgtgaaggtggcccggagcccagacaagccaggcaagggcagctactggaccctgcacccagattctggcaacatgtttgaaaatggctgctacctgcggcggcagaagcgcttcaagtgtgagaagcagcctggagctgggggcggcggcggcagcggcagcggcggcagcggggccaagggcggccctgagagcaggaaggaccccagcggggccagcaaccccagcgctgacagccccctgcacagaggagtgcacggcaagacaggccagctggagggcgccccagcccctggccctgctgccagcccccagaccctggaccacagcggggccacagccaccggcggggccagcgagctgaagaccccagccagcagcacagccccacccatcagcagcggccctggggccctggcctctgtgcctgccagccacccagcccacggcctggcccctcatgagagccagctgcacctgaagggggacccccactacagcttcaaccaccccttcagcatcaacaacctgatgagcagcagcgagcagcagcacaagctggacttcaaggcctatgagcaggccctgcagtacagcccctacggcagcaccctgcctgccagcctgcccctgggcagcgcctctgtgaccaccaggagccccatcgagcccagcgccctggagcccgcctactaccagggcgtgtacagcaggcctgtgctgaacaccagctag

SEQ ID NO: 19759 - DNA, 1506 bp, Artificial Sequence
  Description of Artificial Sequence: Synthetic coding sequence
atgcaggcccgctacagcgtgtctgaccccaatgccctgggcgtggtgccctacctgtctgagcagaactactacagagctgctggcagctatggaggcatggccagccccatgggcgtgtacagcggccaccctgagcagtacagcgctggcatgggccgctcctatgccccctaccaccaccaccagcctgctgcccccaaggacctggtgaagccaccctacagctacatcgccctgatcaccatggccatccagaatgcccctgagaagaagatcaccctgaatggcatctaccagttcatcatggaccgcttccccttctaccgggagaacaagcagggctggcagaacagcatccgccacaacctgagcctgaatgaatgttttgtgaaggtgcccagagatgacaagaagccaggcaagggcagctactggaccctggaccctgacagctacaacatgtttgaaaatggcagcttcctgcggaggagaagacgcttcaagaagaaggatgtgtccaaggagaaggaggagcgggcccacctgaaggagcccccacctgctgccagcaagggggccccagccaccccccacctggctgatgcccccaaggaggccgagaagaaggtggtgatcaagtctgaggccgccagccctgccctgcctgtgatcaccaaggtggagaccctgagccctgagagcgccctgcagggcagccccaggtctgctgccagcaccccagctggcagcccagatggcagcctgcctgagcaccacgccgccgccccaaatggcctgcccggcttctctgtggagaacatcatgaccctgcggaccagccccccaggaggagagctgagccctggagctggccgggccggcctggtggtgccccccctggccctgccctatgctgctgcccctcctgctgcctacggccagccctgtgcccagggcctggaggccggggccgccggcggctaccagtgcagcatgagggccatgagcctgtacaccggggctgagaggcctgcccacatgtgtgtgcccccagccctggatgaggccctgagtgaccaccccagcggccccaccagccccctgagcgccctgaacctggccgccggccaggagggcgccctggccgccaccggccaccaccaccagcaccacggccaccaccacccccaggcccctcctcctcctccagccccccagccccagcccaccccccagcccggggctgctgctgcccaggccgcctcctggtacctgaaccacagcggggacctgaaccacctgcccggccacacctttgctgcccagcagcagaccttccccaacgtgcgggagatgttcaacagccaccggctgggcatcgagaacagcaccctgggggagagccaggtgtctggaaatgccagctgccagctgccctaccgcagcaccccacccctgtacagacatgctgccccctacagctatgactgcaccaagtactag

SEQ ID NO: 19760 - DNA, 1968 bp, Artificial Sequence
  Description of Artificial Sequence: Synthetic coding sequence
atggccgaggccccccaggtggtggagattgatcctgactttgagcccctgccccggcccaggagctgcacctggcccctgcccaggcctgagttcagccagagcaacagcgccaccagcagccctgcccccagcggcagcgctgctgccaacccagatgctgctgctggcctgcccagcgccagcgctgctgctgtgtctgctgacttcatgagcaacctgagcctgctggaggagagcgaggacttcccccaggcccctggctctgtggccgctgctgtggccgctgctgctgctgctgctgccactggaggcctgtgtggggacttccagggccctgaggccggctgcctgcacccagccccaccccagcccccacctcctggccccctgagccagcacccccctgtgcccccagctgctgctggccccctggccggccagcccaggaagagcagcagcagcagaagaaatgcctggggcaacctgtcctatgctgacctgatcaccaaggccatcgagagcagcgctgagaagaggctgaccctgagccagatctatgagtggatggtgaagtctgtgccctacttcaaggacaagggggacagcaacagcagcgctggctggaagaacagcatccgccacaacctgagcctgcacagcaagttcatccgggtgcagaatgaaggaacaggcaagagctcctggtggatgctgaaccctgagggcggcaagagcggcaagagcccccggcggcgggccgcctccatggacaacaacagcaagtttgccaagagccgcagccgggccgccaagaagaaggccagcctgcagagcggccaggagggcgctggggacagccctggcagccagttcagcaagtggccagccagccctggcagccacagcaatgatgactttgacaactggagcaccttccggcccaggaccagcagcaatgccagcaccatcagcggccgcctgagccccatcatgacagagcaggatgacctgggggagggagatgtgcacagcatggtgtacccaccttctgctgccaagatggccagcaccctgcccagcctgtctgagatcagcaaccctgagaacatggagaacctgctggacaacctgaacctgctgagcagccccaccagcctgactgtgtccacccagagcagccctggcaccatgatgcagcagaccccctgctacagctttgccccacccaacaccagcctgaacagccccagccccaactaccagaagtacacctacggccagagctccatgagccccctgccccagatgcccatccagaccctgcaggacaacaagagcagctatggaggcatgagccagtacaactgtgcccctggcctgctgaaggagctgctgaccagtgacagccccccccacaatgacatcatgacccctgtggaccccggggtggcccagcccaacagccgggtgctgggccagaatgtgatgatgggccccaacagcgtgatgagcacctacggcagccaggccagccacaacaagatgatgaaccccagcagccacacccaccctggccacgcccagcagaccagcgctgtgaatggccggcccctgccccacacagtgtccaccatgccccacaccagcggcatgaaccggctgacccaggtgaagacccctgtgcaggtgcccctgccccaccccatgcagatgtctgccctgggcggctacagctctgtgagcagctgcaatggctacggccgcatgggcctgctgcaccaggagaagctgcccagcgacctggatggcatgtttattgagcggctggactgtgacatggagagcatcatcagaaatgacctgatggatggagacaccctggacttcaactttgacaacgtgctgcccaaccagagcttcccccacagcgtgaagaccaccacccacagctgggtgtctggatag

SEQ ID NO: 19761 - DNA, 2022 bp, Artificial Sequence
  Description of Artificial Sequence: Synthetic coding sequence
atggccgaggccccagccagccctgcccccctgagccccctggaggtggagctggaccctgagtttgagccccagagccggcccaggagctgcacctggcccctgcagaggcctgagctgcaggccagccctgccaagcccagcggggagacagctgctgacagcatgatccctgaggaggaggatgatgaagatgatgaagatggcggcggccgggccggcagcgccatggccatcggcggcggcggcggcagcggcaccctgggcagcggcctgctgctggaggacagcgcccgggtgctggcccctgggggccaggaccccggcagcggccctgccacagctgctgggggcctgagcggcggcacccaggccctgctgcagccccagcagcccctgcccccaccccagcccggggctgctgggggcagcggccagcccaggaagtgcagcagcagaagaaatgcctggggcaacctgtcctatgctgacctgatcacccgggccatcgagagcagcccagacaagaggctgaccctgagccagatctatgagtggatggtgcgctgtgtgccctacttcaaggacaagggggacagcaacagcagcgctggctggaagaacagcatccgccacaacctgagcctgcacagccgcttcatgagggtgcagaatgaaggcaccgggaagagctcctggtggatcatcaacccagatggcggcaagagcggcaaggcccccaggagaagagctgtgtccatggacaacagcaacaagtacaccaagagccggggccgggccgccaagaagaaggccgccctgcagacagcccctgagagcgcagatgacagccccagccagctgagcaagtggccaggcagccccaccagccgcagcagtgatgagctggatgcctggacagacttccgcagcaggaccaacagcaatgccagcacagtgtctggccgcctgagccccatcatggccagcacagagctggatgaggtgcaggatgatgatgcccccctgagccccatgctgtacagcagcagcgccagcctgagccccagcgtgtccaagccctgcaccgtggagctgccccggctgacagacatggccggcaccatgaacctgaatgatggcctgacagagaacctgatggatgacctgctggacaacatcaccctgccccccagccagcccagccccaccggcggcctgatgcagaggagcagcagcttcccctacaccaccaagggcagcggcctgggcagccccaccagcagcttcaacagcacagtgtttggccccagcagcctgaacagcctgcggcagagccccatgcagaccatccaggagaacaagccagccaccttcagctccatgagccactacggcaaccagaccctgcaggacctgctgaccagtgacagcctgagccacagtgatgtgatgatgacccagagcgaccccctgatgagccaggccagcacagctgtgtctgcccagaacagcagaagaaatgtgatgctgagaaatgaccccatgatgagctttgctgcccagcccaaccagggcagcctggtgaaccagaacctgctgcaccaccagcaccagacccagggcgccctgggcggcagccgggccctgagcaacagcgtgagcaacatgggcctgtctgagagcagcagcctgggcagcgccaagcaccagcagcagagccctgtgtcccagagcatgcagaccctgagtgacagcctgagcggcagcagcctgtacagcaccagcgccaacctgcctgtgatgggccacgagaagttccccagcgacctggacctggacatgtttaatggcagcctggagtgtgacatggagagcatcatccgctctgagctgatggatgctgatggcctggacttcaactttgacagcctcatcagcacccagaatgtggtgggcctgaatgtgggcaacttcaccggggccaagcaggccagcagccagagctgggtgcccggctag

SEQ ID NO: 19762 - DNA, 2022 bp, Artificial Sequence; identical to SEQ ID NO: 19761
  Description of Artificial Sequence: Synthetic coding sequence

SEQ ID NO: 19763 - DNA, 1302 bp, Artificial Sequence
  Description of Artificial Sequence: Synthetic coding sequence
atgagggtgcagaatgaaggcaccgggaagagctcctggtggatcatcaacccagatggcggcaagagcggcaaggcccccaggagaagagctgtgtccatggacaacagcaacaagtacaccaagagccggggccgggccgccaagaagaaggccgccctgcagacagcccctgagagcgcagatgacagccccagccagctgagcaagtggccaggcagccccaccagccgcagcagtgatgagctggatgcctggacagacttccgcagcaggaccaacagcaatgccagcacagtgtctggccgcctgagccccatcatggccagcacagagctggatgaggtgcaggatgatgatgcccccctgagccccatgctgtacagcagcagcgccagcctgagccccagcgtgtccaagccctgcaccgtggagctgccccggctgacagacatggccggcaccatgaacctgaatgatggcctgacagagaacctgatggatgacctgctggacaacatcaccctgccccccagccagcccagccccaccggcggcctgatgcagaggagcagcagcttcccctacaccaccaagggcagcggcctgggcagccccaccagcagcttcaacagcacagtgtttggccccagcagcctgaacagcctgcggcagagccccatgcagaccatccaggagaacaagccagccaccttcagctccatgagccactacggcaaccagaccctgcaggacctgctgaccagtgacagcctgagccacagtgatgtgatgatgacccagagcgaccccctgatgagccaggccagcacagctgtgtctgcccagaacagcagaagaaatgtgatgctgagaaatgaccccatgatgagctttgctgcccagcccaaccagggcagcctggtgaaccagaacctgctgcaccaccagcaccagacccagggcgccctgggcggcagccgggccctgagcaacagcgtgagcaacatgggcctgtctgagagcagcagcctgggcagcgccaagcaccagcagcagagccctgtgtcccagagcatgcagaccctgagtgacagcctgagcggcagcagcctgtacagcaccagcgccaacctgcctgtgatgggccacgagaagttccccagcgacctggacctggacatgtccatgggcgcctggaatgtgacctggagccccctgtctgtggtgaacagctggatgctgatgggctggatcctgaccctcatccccagcagcccccacaggatgctgctggtgtag

SEQ ID NO: 19764 - DNA, 1362 bp, Artificial Sequence
  Description of Artificial Sequence: Synthetic coding sequence
atgagggtgcagaatgaaggcaccgggaagagctcctggtggatcatcaacccagatggcggcaagagcggcaaggcccccaggagaagagctgtgtccatggacaacagcaacaagtacaccaagagccggggccgggccgccaagaagaaggccgccctgcagacagcccctgagagcgcagatgacagccccagccagctgagcaagtggccaggcagccccaccagccgcagcagtgatgagctggatgcctggacagacttccgcagcaggaccaacagcaatgccagcacagtgtctggccgcctgagccccatcatggccagcacagagctggatgaggtgcaggatgatgatgcccccctgagccccatgctgtacagcagcagcgccagcctgagccccagcgtgtccaagccctgcaccgtggagctgccccggctgacagacatggccggcaccatgaacctgaatgatggcctgacagagaacctgatggatgacctgctggacaacatcaccctgccccccagccagcccagccccaccggcggcctgatgcagaggagcagcagcttcccctacaccaccaagggcagcggcctgggcagccccaccagcagcttcaacagcacagtgtttggccccagcagcctgaacagcctgcggcagagccccatgcagaccatccaggagaacaagccagccaccttcagctccatgagccactacggcaaccagaccctgcaggacctgctgaccagtgacagcctgagccacagtgatgtgatgatgacccagagcgaccccctgatgagccaggccagcacagctgtgtctgcccagaacagcagaagaaatgtgatgctgagaaatgaccccatgatgagctttgctgcccagcccaaccagggcagcctggtgaaccagaacctgctgcaccaccagcaccagacccagggcgccctgggcggcagccgggccctgagcaacagcgtgagcaacatgggcctgtctgagagcagcagcctgggcagcgccaagcaccagcagcagagccctgtgtcccagagcatgcagaccctgagtgacagcctgagcggcagcagcctgtacagcaccagcgccaacctgcctgtgatgggccacgagaagttccccagcgacctggacctggacatgtttaatggcagcctggagtgtgacatggagagcatcatccgctctgagctgatggatgctgatggcctggacttcaactttgacagcctcatcagcacccagaatgtggtgggcctgaatgtgggcaacttcaccggggccaagcaggccagcagccagagctgggtgcccggctag

SEQ ID NO: 19765 - DNA, 444 bp, Artificial Sequence
  Description of Artificial Sequence: Synthetic coding sequence
atgtccttccgcttcggccagcacctgatcaagcccagcgtggtgttcctgaagacagagctgagctttgccctggtgaacaggaagcctgtggtgcccggccacgtgctggtgtgccccctgcggcctgtggagcgcttccatgacctgcggccagatgaggtggccgacctcttccagaccacccagagggtgggcaccgtggtggagaagcacttccacggcaccagcctgaccttctccatgcaggacggccctgaggccggccagacagtgaagcacgtgcacgtgcacgtgctgcccaggaaggccggggacttccacagaaatgacagcatctatgaggagctgcagaagcatgacaaggaggacttccctgcctcctggaggtctgaggaggagatggctgctgaggccgccgccctgcgggtgtacttccagtag

SEQ ID NO: 19766 - DNA, 444 bp, Artificial Sequence; identical to SEQ ID NO: 19765
  Description of Artificial Sequence: Synthetic coding sequence

SEQ ID NO: 19767 - DNA, 444 bp, Artificial Sequence; identical to SEQ ID NO: 19765
  Description of Artificial Sequence: Synthetic coding sequence

SEQ ID NO: 19768 - DNA, 240 bp, Artificial Sequence
  Description of Artificial Sequence: Synthetic coding sequence
atgtccttccgcttcggccagcacctgatcaagcccagcgtggtgttcctgaagacagagctgagctttgccctggtgaacaggaagcctgtggtgcccggccacgtgctggtgtgccccctgcggcctgtggagcgcttccatgacctgcggccagatgaggtggccgacctcttccagaccacccagagggtgggcaccgtggtggagaagcacttccacggcaccagcctgacctag

SEQ ID NO: 19769 - DNA, 444 bp, Artificial Sequence; identical to SEQ ID NO: 19765
  Description of Artificial Sequence: Synthetic coding sequence

SEQ ID NO: 19770 - DNA, 1725 bp, Artificial Sequence
  Description of Artificial Sequence: Synthetic coding sequence
atgagggaccccggggctgctgcccccctgagcagcctgggcctgtgtgccctggtgctggccctgctgggcgccctgtctgctggggccggggcccagccctaccacggggagaagggcatctctgtgcctgaccacggcttctgccagcccatcagcatccccctgtgcacagacatcgcctacaaccagaccatcctgcccaacctgctgggccacaccaaccaggaggatgctggcctggaggtgcaccagttctaccccctggtgaaggtgcagtgcagccctgagctgcgcttcttcctgtgcagcatgtatgcccctgtgtgcaccgtgctggaccaggccatccccccctgccgcagcctgtgtgagcgggcccggcagggctgtgaggccctgatgaacaagtttggcttccagtggccagagcggctgcgctgtgagaacttccctgtgcacggggccggggagatctgtgtgggccagaacaccagtgatggcagcggcggccctgggggcggccccacagcctaccccacagccccctacctgcctgacctgcccttcaccgccctgcccccaggggccagtgatggccggggccggcctgccttccccttcagctgcccccggcagctgaaggtgcccccctacctgggctaccgcttcctgggggagcgggactgtggggccccctgtgagcccggccgggccaacggcctgatgtacttcaaggaggaggagaggagatttgcccggctgtgggtgggcgtgtggagcgtgctgtgctgtgccagcaccctcttcaccgtgctgacctacctggtggacatgaggcgcttctcctacccagagcggcccatcatcttcctgagcggctgctacttcatggtggccgtggcccacgtggccggcttcctgctggaggacagagctgtgtgtgtggagcgcttcagtgatgatggctacagaacagtggcccagggcaccaagaaggagggctgcaccatcctcttcatggtgctgtacttcttcggcatggccagcagcatctggtgggtgatcctgagcctgacctggttcctggccgccggcatgaagtggggccacgaggccatcgaggccaacagccagtacttccacctggccgcctgggccgtgcctgctgtgaagaccatcaccatcctggccatgggccaggtggatggagacctgctgagcggcgtgtgctacgtgggcctgagctctgtggatgccctgcggggctttgtgctggcccccctgtttgtgtacctgttcatcggcaccagcttcctgctggccggctttgtgtccctcttccgcatccgcaccatcatgaagcatgatggcaccaagacagagaagctggagaagctgatggtgagaattggagtcttctctgtgctgtacacagtgcctgccaccatcgtgctggcctgctacttctatgagcaggccttccgggagcactgggagaggacctggctgctgcagacctgcaagagctatgctgtgccctgccccccaggccacttcccccccatgagcccagacttcaccgtcttcatgatcaagtacctgatgaccatgattgtgggcatcaccaccggcttctggatctggagcggcaagaccctgcagagctggaggcgcttctaccaccggctgagccacagcagcaaaggagaaacagctgtgtag

SEQ ID NO: 19771 - DNA, 654 bp, Artificial Sequence
  Description of Artificial Sequence: Synthetic coding sequence
atgtccttccggggcggcggccggggcggcttcaacagaggaggcggcggcggcggcttcaacagaggaggcagcagcaaccacttccggggcggcggcggcggcggcggcggcggcaacttccggggcggcggccggggcggcttcggccggggcggcggccggggcggcttcaacaagggccaggaccagggccccccagagcgggtggtgctgctgggggagttcctgcacccctgtgaagatgacatcgtgtgcaagtgcaccacagatgagaacaaggtgccctacttcaatgcccctgtgtacctggagaacaaggagcagatcggcaaggtggatgagatcttcggccagctgcgggacttctacttctctgtgaagctgtctgagaacatgaaggccagcagcttcaagaagctgcagaagttctacatcgacccctacaagctgctgcccctgcagcgcttcctgcccaggcctcctggagagaagggccccccccggggcggcggccggggcggccggggcggcggccggggcggcggcggccggggcggcggccggggcggcggcttccggggcggccggggcggcggcggcggcggcttccggggcggccggggcggcggcttccggggccggggccactag

SEQ ID NO: 19772 - DNA, 1533 bp, Artificial Sequence
  Description of Artificial Sequence: Synthetic coding sequence
atgtaccgggccctgcggctgctggcccggagccggcccctggtgcgggccccagctgctgccctggccagcgcccctggcctgggcggcgctgctgtgcccagcttctggcccccaaatgctgccaggatggccagccagaacagcttccgcatcgagtatgacacctttggagagctgaaggtgcccaatgacaagtactacggggcccagacagtgcgcagcaccatgaacttcaagattggaggagtgacagagaggatgcccacccctgtgatcaaggccttcggcatcctgaagagagctgctgctgaggtgaaccaggactatggcctggaccccaagatcgccaatgccatcatgaaggccgcagatgaggtggccgagggcaagctgaatgaccacttccccctggtggtgtggcagacaggcagcggcacccagaccaacatgaatgtgaatgaggtgatcagcaacagagccatcgagatgctgggcggggagctgggcagcaagatccctgtgcaccccaatgaccacgtgaacaagagccagagcagcaatgacaccttccccacagccatgcacatcgctgctgccatcgaggtgcatgaggtgctgctgcccggcctgcagaagctgcatgatgccctggatgccaagagcaaggagtttgcccagatcatcaagattggaagaacccacacccaggatgctgtgcccctgaccctgggccaggagttcagcggctacgtgcagcaggtgaagtatgccatgacccgcatcaaggccgccatgccccgcatctatgagctggccgccggcggcacagctgtgggcaccggcctgaacaccagaattggatttgctgagaaggtggccgccaaggtggccgccctgaccggcctgccctttgtgacagcccccaacaagtttgaggccctggccgcccatgatgccctggtggagctgagcggggccatgaacaccacagcctgcagcctgatgaagatcgccaatgacatccgcttcctgggcagcggccccaggagcggcctgggggagctgatcctgcctgaaaatgaacctggcagcagcatcatgcctgggaaggtgaaccccacccagtgtgaggccatgaccatggtggccgcccaggtgatgggcaaccacgtggccgtgacagtgggcggcagcaatggccactttgagctgaatgtgttcaagcccatgatgatcaagaatgtgctgcacagcgcccggctgctgggagatgcctctgtgtccttcacagagaactgtgtggtgggcatccaggccaacacagagcgcatcaacaagctgatgaatgaaagcctgatgctggtgacagccctgaacccccacatcggctatgacaaggccgccaagatcgccaagacagcccacaagaatggcagcaccctgaaggagacagccatcgagctgggctacctgacagctgagcagtttgatgagtgggtgaagcccaaggacatgctgggccccaagtag

SEQ ID NO: 19773 - DNA, 537 bp, Artificial Sequence
  Description of Artificial Sequence: Synthetic coding sequence
atgagccccagcggccgcctgtgcctgctgaccatcgtgggcctcatcctgcccacccggggccagaccctgaaggacaccaccagcagcagcagcgctgacagcaccatcatggacatccaggtgcccacccgggccccagatgctgtgtacacagagctgcagcccaccagccccacccccacctggccagcagatgagaccccccagccccagacccagacccagcagctggagggcacagatggccccctggtgacagatcctgagacccacaagagcaccaaggccgcccaccccacagatgacaccaccaccctgtctgagcggcccagccccagcacagatgtgcagacagacccccagaccctgaagcccagcggcttccatgaagatgaccccttcttctatgatgagcacaccctgaggaagaggggcctgctggtggccgctgtgctcttcatcaccggcatcatcatcctgaccagcgggaaatgtcggcagctgagccggctgtgcaggaaccgctgcaggtag

SEQ ID NO: 19774 - DNA, 324 bp, Artificial Sequence
  Description of Artificial Sequence: Synthetic coding sequence
atgcagaccctgagcaacatcccctgcttctgcctgcacggcagcctgctgcccagcacagacctggccaccctgagcgcccaccccacagatgacaccaccaccctgtctgagcggcccagccccagcacagatgtgcagacagacccccagaccctgaagcccagcggcttccatgaagatgaccccttcttctatgatgagcacaccctgaggaagaggggcctgctggtggccgctgtgctcttcatcaccggcatcatcatcctgaccagcggcaagtgccggcagctgagccggctgtgcaggaaccgctgcaggtag

SEQ ID NO: 19775 - DNA, 291 bp, Artificial Sequence
  Description of Artificial Sequence: Synthetic coding sequence
atgagccccagcggccgcctgtgcctgctgaccatcgtgggcctcatcctgcccacccggggccagaccctgaaggacaccaccagcagcagcagcgctgacagcaccatcatggacatccaggtgcccacccgggccccagatgctgtgtacacagagctgcagcccaccagccccacccccacctggccagcagatggagcctacatcacagcctatggagtgacccacttcctgatgaacatgctggccgtgtcctccttcttctgcctgcacacagccccccagtag

SEQ ID NO: 19776 - DNA, 537 bp, Artificial Sequence; identical to SEQ ID NO: 19773
  Description of Artificial Sequence: Synthetic coding sequence

SEQ ID NO: 19777 - DNA, 537 bp, Artificial Sequence; identical to SEQ ID NO: 19773
  Description of Artificial Sequence: Synthetic coding sequence

SEQ ID NO: 19778 - DNA, 537 bp, Artificial Sequence; identical to SEQ ID NO: 19773
  Description of Artificial Sequence: Synthetic coding sequence

SEQ ID NO: 19779 - DNA, 585 bp, Artificial Sequence
  Description of Artificial Sequence: Synthetic coding sequence
atgagccccagcggccgcctgtgcctgctgaccatcgtgggcctcatcctgcccacccggggccagaccctgaaggacaccaccagcagcagcagcgctgacagcaccatcatggacatccaggtgcccacccgggccccagatgctgtgtacacagagctgcagcccaccagccccacccccacctggccagcagatgagaccccccagccccagacccagacccagcagctggagggcacagatggccccctggtgacagatcctgagacccacaagagcaccaaggccgcccaccccacagatgacaccaccaccctgtctgagcggcccagccccagcacagatgtgcagacagacccccagaccctgaagcccagcggcttccatgaagatgaccccttcttctatgatgagcacaccctgaggaagaggggcctgctggtggccgctgtgctcttcatcaccggcatcatcatcctgaccagcgagaactggggctgggtgggccgcacccccaggcctgggggcggcctgatgacagagggctgggtgctgaagggcccctgggccatcctcttctag

SEQ ID NO: 19780 - DNA, 1518 bp, Artificial Sequence
  Description of Artificial Sequence: Synthetic coding sequence
atgagcaacatctgccagaggctgtgggagtacctggagccctacctgccctgcctgagcacagaagctgacaagagcacagtgattgagaaccctggggccctgtgcagcccccagagccagagacatggccactactttgtggccctgtttgactaccaggccaggacagctgaggacctgtccttccgggccggggacaagctgcaggtgctggacaccctgcacgagggctggtggtttgcccggcacctggagaagagaagagatggcagcagccagcagctgcagggctacatccccagcaactacgtggctgaagatagaagcctgcaggccgagccctggttcttcggggccatcggccgcagtgatgctgagaagcagctgctgtacagcgagaacaagacaggcagcttcctgatccgggagagcgagagccagaagggggagttcagcctgtctgtgctggatggagctgtggtgaagcactaccgcatcaagaggctggatgaaggaggcttcttcctgacccggcggcgcatcttcagcaccctgaatgaatttgtgagccactacaccaagaccagtgatggcctgtgtgtgaagctgggcaagccctgcctgaagatccaggtgcctgccccctttgacctgagctacaagacagtggaccagtgggagattgacagaaattccatccagctgctgaagaggctgggcagcggccagtttggagaggtgtgggagggcctgtggaacaacaccacccctgtggccgtgaagaccctgaagccaggctccatggaccccaatgacttcctgcgggaggcccagatcatgaagaacctgcggcaccccaagctgatccagctgtatgctgtgtgcaccctggaggaccccatctacatcatcacagagctgatgagacatggcagcctgcaggagtacctgcagaatgacaccggcagcaagatccacctgacccagcaggtggacatggccgcccaggtggccagcggcatggcctacctggagagcaggaactacatccaccgggacctggccgccagaaatgtgctggtgggggagcacaacatctacaaggtggccgactttggcctggcccgggtcttcaaggtggacaatgaagacatctatgagagcagacatgagatcaagctgcctgtgaagtggacagcccctgaggccatccgcagcaacaagttcagcatcaagagtgatgtgtggagctttggcatcctgctgtatgagatcatcacctacggcaagatgccctacagcggcatgaccggggcccaggtgatccagatgctggcccagaactaccgcctgccccagcccagcaactgcccccagcagttctacaacatcatgctggagtgctggaatgctgagcccaaggagcggcccacctttgagaccctgcgctggaagctggaggactactttgaaacagacagcagctacagtgatgccaacaacttcatcagatag

SEQ ID NO: 19781 - DNA, 1092 bp, Artificial Sequence
  Description of Artificial Sequence: Synthetic coding sequence
atggacagcaccagcctgctgcccaacccctggatccgggtgctggatggagctgtggtgaagcactaccgcatcaagaggctggatgaaggaggcttcttcctgacccggcggcgcatcttcagcaccctgaatgaatttgtgagccactacaccaagaccagtgatggcctgtgtgtgaagctgggcaagccctgcctgaagatccaggtgcctgccccctttgacctgagctacaagacagtggaccagtgggagattgacagaaattccatccagctgctgaagaggctgggcagcggccagtttggagaggtgtgggagggcctgtggaacaacaccacccctgtggccgtgaagaccctgaagccaggctccatggaccccaatgacttcctgcgggaggcccagatcatgaagaacctgcggcaccccaagctgatccagctgtatgctgtgtgcaccctggaggaccccatctacatcatcacagagctgatgagacatggcagcctgcaggagtacctgcagaatgacaccggcagcaagatccacctgacccagcaggtggacatggccgcccaggtggccagcggcatggcctacctggagagcaggaactacatccaccgggacctggccgccagaaatgtgctggtgggggagcacaacatctacaaggtggccgactttggcctggcccgggtcttcaaggtggacaatgaagacatctatgagagcagacatgagatcaagctgcctgtgaagtggacagcccctgaggccatccgcagcaacaagttcagcatcaagagtgatgtgtggagctttggcatcctgctgtatgagatcatcacctacggcaagatgccctacagcggcatgaccggggcccaggtgatccagatgctggcccagaactaccgcctgccccagcccagcaactgcccccagcagttctacaacatcatgctggagtgctggaatgctgagcccaaggagcggcccacctttgagaccctgcgctggaagctggaggactactttgaaacagacagcagctacagtgatgccaacaacttcatcagatag

SEQ ID NO: 19782 - DNA, 1128 bp, Artificial Sequence
  Description of Artificial Sequence: Synthetic coding sequence
atgaggtctgtggcccccagcggccccaagatgggcaacatcacagctgacaacagctccatgagctgcaccatcgaccacaccatccaccagaccctggcccctgtggtgtatgtgacagtgctggtggtgggcttccctgccaactgcctgagcctgtacttcggctacctgcagatcaaggccagaaatgagctgggcgtgtacctgtgcaacctgactgtggccgacctcttctacatctgcagcctgcccttctggctgcagtatgtgctgcagcacgacaactggagccatggagacctgagctgccaggtgtgtggcatcctgctgtatgagaacatctacatctctgtgggcttcctgtgctgcatctctgtggaccgctacctggccgtggcccaccccttccgcttccaccagttccgcaccctgaaggctgctgtgggcgtgtctgtggtgatctgggccaaggagctgctgaccagcatctacttcctgatgcatgaggaggtgattgaagatgagaaccagcaccgggtgtgctttgagcactaccccatccaggcctggcagagggccatcaactactaccgcttcctggtgggcttcctgttccccatctgcctgctgctggccagctaccagggcatcctgcgggctgtgagaagaagccacggcacccagaagagcaggaaggaccagatccagaggctggtgctgagcacagtggtgatcttcctggcctgcttcctgccctaccacgtgctgctgctggtgcgctctgtgtgggaggccagctgtgactttgccaagggcgtcttcaatgcctaccacttcagcctgctgctgaccagcttcaactgtgtggccgaccctgtgctgtactgctttgtgtctgagaccacccaccgggacctggcccggctgcggggggcctgcctggccttcctgacctgcagcaggacaggccgggcccgggaggcctaccccctgggcgcccctgaggccagcggcaagagcggggcccagggcgaggagcctgagctgctgaccaagctgcacccagccttccagacccccaacagccctggcagcggcggcttccccaccggccgcctggcctag

SEQ ID NO: 19783 - DNA, 1017 bp, Artificial Sequence
  Description of Artificial Sequence: Synthetic coding sequence
atgggcaacatcacagctgacaacagctccatgagctgcaccatcgaccacaccatccaccagaccctggcccctgtggtgtatgtgacagtgctggtggtgggcttccctgccaactgcctgagcctgtacttcggctacctgcagatcaaggccagaaatgagctgggcgtgtacctgtgcaacctgactgtggccgacctcttctacatctgcagcctgcccttctggctgcagtatgtgctgcagcacgacaactggagccatggagacctgagctgccaggtgtgtggcatcctgctgtatgagaacatctacatctctgtgggcttcctgtgctgcatctctgtggaccgctacctggccgtggcccaccccttccgcttccaccagttccgcaccctgaaggctgctgtgggcgtgtctgtggtgatctgggccaaggagctgctgaccagcatctacttcctgatgcatgaggaggtgattgaagatgagaaccagcaccgggtgtgctttgagcactaccccatccaggcctggcagagggccatcaactactaccgcttcctggtgggcttcctgttccccatctgcctgctgctggccagctaccagggcatcctgcgggctgtgagaagaagccacggcacccagaagagcaggaaggaccagatccagaggctggtgctgagcacagtggtgatcttcctggcctgcttcctgccctaccacgtgctgctgctggtgcgctctgtgtgggaggccagctgtgactttgccaagggcgtcttcaatgcctaccacttcagcctgctgctgaccagcttcaactgtgtggccgaccctgtgctgtactgctttgtgtctgagaccacccaccgggacctggcccggctgcggggggcctgcctggccttcctgacctgcagcaggacaggccgggcccgggaggcctaccccctgggcgcccctgaggccagcggcaagagcggggcccagggcgaggagccctag

SEQ ID NO: 19784 - DNA, 1098 bp, Artificial Sequence
  Description of Artificial Sequence: Synthetic coding sequence
atgggcaacatcacagctgacaacagctccatgagctgcaccatcgaccacaccatccaccagaccctggcccctgtggtgtatgtgacagtgctggtggtgggcttccctgccaactgcctgagcctgtacttcggctacctgcagatcaaggccagaaatgagctgggcgtgtacctgtgcaacctgactgtggccgacctcttctacatctgcagcctgcccttctggctgcagtatgtgctgcagcacgacaactggagccatggagacctgagctgccaggtgtgtggcatcctgctgtatgagaacatctacatctctgtgggcttcctgtgctgcatctctgtggaccgctacctggccgtggcccaccccttccgcttccaccagttccgcaccctgaaggctgctgtgggcgtgtctgtggtgatctgggccaaggagctgctgaccagcatctacttcctgatgcatgaggaggtgattgaagatgagaaccagcaccgggtgtgctttgagcactaccccatccaggcctggcagagggccatcaactactaccgcttcctggtgggcttcctgttccccatctgcctgctgctggccagctaccagggcatcctgcgggctgtgagaagaagccacggcacccagaagagcaggaaggaccagatccagaggctggtgctgagcacagtggtgatcttcctggcctgcttcctgccctaccacgtgctgctgctggtgcgctctgtgtgggaggccagctgtgactttgccaagggcgtcttcaatgcctaccacttcagcctgctgctgaccagcttcaactgtgtggccgaccctgtgctgtactgctttgtgtctgagaccacccaccgggacctggcccggctgcggggggcctgcctggccttcctgacctgcagcaggacaggccgggcccgggaggcctaccccctgggcgcccctgaggccagcggcaagagcggggcccagggcgaggagcctgagctgctgaccaagctgcacccagccttccagacccccaacagccctggcagcggcggcttccccaccggccgcctggcctag

SEQ ID NO: 19785 - DNA, 1098 bp, Artificial Sequence; identical to SEQ ID NO: 19784
  Description of Artificial Sequence: Synthetic coding sequence

SEQ ID NO: 19786 - DNA, 2100 bp, Artificial Sequence
  Description of Artificial Sequence: Synthetic coding sequence
atgaccctgcggaggaagtgcaatgaagatgatgaggtgttcttcggccccttcggccacaaggagcgctgcatcgccgccagcctggagctgaacaaccctgtgcctgagcagccccccctgcccaccagcgagagcccctttgcctggagccccctggccggggagaagtttgtggaggtgtacaaggaggcccacctgctggccctgcacatcgagagcagcagcaggaaccaggccgcccaggccgccaagccagaggaccccaggagccagggcgtggagcgcttcatccaggagagcaagctgaagatcaacctgtttgagaaggagaaggagatgaagaagagccccaccagcctgaagcgggagacctactacctgagtgacagccccctgctgggcccccctgtgggggagccccggctgctggccagcagccctgccctgcccagcagcggggcccaggcccggctgacccgggcccctggccccccccacagcgcccacgccctgccccgggagagctgcacagcccatgctgccagccaggccgccacccagaggaagccaggcaccaagctgctgctgccccgggccgcctctgtgcggggccgcagcatccctggagctgctgagaagcccaagaaggagatcccagccagccccagcaggaccaagatcccagctgagaaggagagccacagagatgtgctgcctgacaagccagcccctggagctgtgaatgtgcctgctgctggcagccacctgggccagggcaagagggccatccctgtgcccaacaagctgggcctgaagaagaccctgctgaaggcccctggcagcaccagcaacctggccaggaagagcagcagcggccctgtgtggagcggggccagcagcgcctgcaccagccctgctgtgggcaaggccaagagcagcgagtttgccagcatcccagccaacagcagccggcccctgagcaacatcagcaagagcggccgcatgggccctgccatgctgcggcctgccctgcctgctggccctgtgggcgccagctcctggcaggccaagagggtggatgtgtctgagctggccgctgagcagctgacagcccctccttctgccagccccacccagccccagaccccagagggcggcggccagtggctgaacagcagctgtgcctggagcgagagcagccagctgaacaagaccaggagcatcagaagaagagacagctgcctgaacagcaagaccaaggtgatgcccacccccaccaaccagttcaagatccccaagttcagcattggagacagcccagacagcagcacccccaagctgagccgggcccagaggccccagagctgcacctctgtgggccgggtgacagtgcacagcacccctgtgagaagaagcagcggccctgccccccagagcctgctgagcgcctggagggtgtctgccctgcccaccccagccagccgccgctgcagcggcctgccccccatgacccccaagaccatgcccagggctgtgggcagccccctgtgtgtgcctgccaggagaagaagcagcgagcccaggaagaacagcgccatgaggacagagcccacccgggagagcaacaggaagacagacagccggctggtggatgtgtccccagaccggggcagcccccccagccgggtgccccaggccctgaacttcagccctgaggagagtgacagcaccttcagcaagagcacagccacagaggtggcccgggaggaggccaagccaggaggagatgctgcccccagcgaggccctgctggtggacatcaagctggagcccctggccgtgaccccagatgctgccagccagcccctgattgacctgcccctgattgacttctgtgacaccccagaggcccacgtggccgtgggcagcgagagccggcccctgattgacctgatgaccaacaccccagacatgaacaagaatgtggccaagcccagccctgtggtgggccagctgattgacctgagcagccccctcatccagctgagccctgaggccgacaaggaaaatgtggacagccccctgctgaagttctag

SEQ ID NO: 19787 - DNA, 2220 bp, Artificial Sequence
  Description of Artificial Sequence: Synthetic coding sequence
atggagggcggcggcggcagagatgagcccagcgcctgcagagctggagatgtgaacatggatgaccccaagaaggaggacatcctgctgctggctgatgagaagtttgattttgacctgagcctgagcagcagcagcgccaatgaagatgatgaggtgttcttcggccccttcggccacaaggagcgctgcatcgccgccagcctggagctgaacaaccctgtgcctgagcagccccccctgcccaccagcgagagcccctttgcctggagccccctggccggggagaagtttgtggaggtgtacaaggaggcccacctgctggccctgcacatcgagagcagcagcaggaaccaggccgcccaggccgccaagccagaggaccccaggagccagggcgtggagcgcttcatccaggagagcaagctgaagatcaacctgtttgagaaggagaaggagatgaagaagagccccaccagcctgaagcgggagacctactacctgagtgacagccccctgctgggcccccctgtgggggagccccggctgctggccagcagccctgccctgcccagcagcggggcccaggcccggctgacccgggcccctggccccccccacagcgcccacgccctgccccgggagagctgcacagcccatgctgccagccaggccgccacccagaggaagccaggcaccaagctgctgctgccccgggccgcctctgtgcggggccgcagcatccctggagctgctgagaagcccaagaaggagatcccagccagccccagcaggaccaagatcccagctgagaaggagagccacagagatgtgctgcctgacaagccagcccctggagctgtgaatgtgcctgctgctggcagccacctgggccagggcaagagggccatccctgtgcccaacaagctgggcctgaagaagaccctgctgaaggcccctggcagcaccagcaacctggccaggaagagcagcagcggccctgtgtggagcggggccagcagcgcctgcaccagccctgctgtgggcaaggccaagagcagcgagtttgccagcatcccagccaacagcagccggcccctgagcaacatcagcaagagcggccgcatgggccctgccatgctgcggcctgccctgcctgctggccctgtgggcgccagctcctggcaggccaagagggtggatgtgtctgagctggccgctgagcagctgacagcccctccttctgccagccccacccagccccagaccccagagggcggcggccagtggctgaacagcagctgtgcctggagcgagagcagccagctgaacaagaccaggagcatcagaagaagagacagctgcctgaacagcaagaccaaggtgatgcccacccccaccaaccagttcaagatccccaagttcagcattggagacagcccagacagcagcacccccaagctgagccgggcccagaggccccagagctgcacctctgtgggccgggtgacagtgcacagcacccctgtgagaagaagcagcggccctgccccccagagcctgctgagcgcctggagggtgtctgccctgcccaccccagccagccgccgctgcagcggcctgccccccatgacccccaagaccatgcccagggctgtgggcagccccctgtgtgtgcctgccaggagaagaagcagcgagcccaggaagaacagcgccatgaggacagagcccacccgggagagcaacaggaagacagacagccggctggtggatgtgtccccagaccggggcagcccccccagccgggtgccccaggccctgaacttcagccctgaggagagtgacagcaccttcagcaagagcacagccacagaggtggcccgggaggaggccaagccaggaggagatgctgcccccagcgaggccctgctggtggacatcaagctggagcccctggccgtgaccccagatgctgccagccagcccctgattgacctgcccctgattgacttctgtgacaccccagaggcccacgtggccgtgggcagcgagagccggcccctgattgacctgatgaccaacaccccagacatgaacaagaatgtggccaagcccagccctgtggtgggccagctgattgacctgagcagccccctcatccagctgagccctgaggccgacaaggaaaatgtggacagccccctgctgaagttctag

SEQ ID NO: 19788 - DNA, 1149 bp, Artificial Sequence
  Description of Artificial Sequence: Synthetic coding sequence
atgggagactggagcgccctgggcaagctgctggacaaggtgcaggcctacagcacagctgggggcaaggtgtggctgtctgtgctcttcatcttccgcatcctgctgctgggcacagctgtggagagcgcctggggagatgagcagagcgccttccgctgcaacacccagcagcccggctgtgaaaatgtgtgctatgacaagagcttccccatcagccacgtgcgcttctgggtgctgcagatcatctttgtgtctgtgcccaccctgctgtacctggcccacgtgttctacgtgatgaggaaggaggagaagctgaacaagaaggaggaggagctgaaggtggcccagacagatggagtgaatgtggacatgcacctgaagcagatcgagatcaagaagttcaagtatggaattgaggagcacggcaaggtgaagatgagaggaggcctgctgcggacctacatcatcagcatcctcttcaagagcatctttgaggtggccttcctgctgatccagtggtacatctacggcttcagcctgtctgctgtgtacacctgcaagagggacccctgcccccaccaggtggactgcttcctgagccggcccacagagaagaccatcttcatcatcttcatgctggtggtgtccctggtgtccctggccctgaacatcatcgagctgttctacgtgttcttcaagggcgtgaaggacagagtgaagggcaagagtgacccctaccacgccaccagcggggccctgagccctgccaaggactgtggcagccagaagtatgcctacttcaacggctgcagcagccccacagcccccctgagccccatgagccccccaggctacaagctggtgactggagacaggaacaacagcagctgcaggaactacaacaagcaggccagcgagcagaactgggccaactacagcgctgagcagaacaggatgggccaggccggcagcaccatcagcaacagccacgcccagccctttgacttcccagatgacaaccagaacagcaagaagctggccgccggccacgagctgcagcccctggccatcgtggaccagaggcccagcagccgggccagcagccgggccagcagccggcccaggccagatgacctggagatctag

SEQ ID NO: 19789 - DNA, 1101 bp, Artificial Sequence
  Description of Artificial Sequence: Synthetic coding sequence
atgggagactggagcgccctgggcaagctgctggacaaggtgcaggcctacagcacagctgggggcaaggtgtggctgagcgcctggggagatgagcagagcgccttccgctgcaacacccagcagcccggctgtgaaaatgtgtgctatgacaagagcttccccatcagccacgtgcgcttctgggtgctgcagatcatctttgtgtctgtgcccaccctgctgtacctggcccacgtgttctacgtgatgaggaaggaggagaagctgaacaagaaggaggaggagctgaaggtggcccagacagatggagtgaatgtggacatgcacctgaagcagatcgagatcaagaagttcaagtatggaattgaggagcacggcaaggtgaagatgagaggaggcctgctgcggacctacatcatcagcatcctcttcaagagcatctttgaggtggccttcctgctgatccagtggtacatctacggcttcagcctgtctgctgtgtacacctgcaagagggacccctgcccccaccaggtggactgcttcctgagccggcccacagagaagaccatcttcatcatcttcatgctggtggtgtccctggtgtccctggccctgaacatcatcgagctgttctacgtgttcttcaagggcgtgaaggacagagtgaagggcaagagtgacccctaccacgccaccagcggggccctgagccctgccaaggactgtggcagccagaagtatgcctacttcaacggctgcagcagccccacagcccccctgagccccatgagccccccaggctacaagctggtgactggagacaggaacaacagcagctgcaggaactacaacaagcaggccagcgagcagaactgggccaactacagcgctgagcagaacaggatgggccaggccggcagcaccatcagcaacagccacgcccagccctttgacttcccagatgacaaccagaacagcaagaagctggccgccggccacgagctgcagcccctggccatcgtggaccagaggcccagcagccgggccagcagccgggccagcagccggcccaggccagatgacctggagatctag

SEQ ID NO: 19790 - DNA, 2673 bp, Artificial Sequence
  Description of Artificial Sequence: Synthetic coding sequence
atggacagcaacacagcccccctgggccccagctgcccccagcccccaccagccccccagccccaggcccggagccggctgaatgccacagccagcctggagcaggagaggtctgagcggccccgggcccctggcccccaggccggccctggccctggggtgagagatgctgctgccccagctgagccccaggcccagcacaccaggagccgggagcgggcagatggcaccggccccaccaagggggacatggagatcccctttgaggaggtgctggagcgggccaaggccggggaccccaaggcccagacagaggtgggcaagcactacctgcagctggccggggacacagatgaggagctgaacagctgcacagctgtggactggctggtgctggccgccaagcagggccggcgggaggccgtgaagctgctgcggcgctgcctggccgaccggcggggcatcaccagtgaaaatgaaagagaggtgcggcagctgagcagcgagacagacctggagagagctgtgaggaaggccgccctggtgatgtactggaagctgaaccccaagaagaagaagcaggtggccgtggccgagctgctggagaatgtgggccaggtgaatgaacatgatggaggagcccagcccggccctgtgcccaagagcctgcagaagcagaggaggatgctggagcggctggtgagcagcgagagcaagaactacatcgccctggatgactttgtggagatcaccaagaagtatgccaagggcgtcatccccagcagcctcttcctgcaggatgatgaagatgatgatgagctggccggcaagagccctgaggacctgcccctgcggctgaaggtggtgaagtaccccctgcacgccatcatggagatcaaggagtacctgattgacatggccagccgggccggcatgcactggctgagcaccatcatccccacccaccacatcaatgccctgatcttcttcttcatcgtgagcaacctgaccatcgacttctttgccttcttcatccccctggtgatcttctacctgtccttcatctccatggtgatctgcaccctgaaggtgttccaggacagcaaggcctgggagaacttccgcaccctgacagacctgctgctgcgctttgagcccaacctggatgtggagcaggccgaggtgaactttggctggaaccacctggagccctatgcccacttcctgctgtctgtgttcttcgtcatcttctccttccccatcgccagcaaggactgcatcccctgcagcgagctggccgtcatcaccggcttcttcaccgtgaccagctacctgagcctgagcacccatgctgagccctacacccggcgggccctggccacagaggtgacagctggcctgctgagcctgctgcccagcatgcccctgaactggccctacctgaaggtgctgggccagaccttcatcaccgtgcctgtgggccacctggtggtgctgaatgtgtctgtgccctgcctgctgtatgtgtacctgctgtacctgttcttcaggatggcccagctgaggaacttcaagggcacctactgctacctggtgccctacctggtgtgcttcatgtggtgtgagctgtctgtggtgatcctgctggagagcacaggcctgggcctgctgcgggccagcatcggctacttcctgttcctgtttgccctgcccatcctggtggccggcctggccctggtgggcgtgctgcagtttgcccgctggttcaccagcctggagctgaccaagattgctgtgacagtggccgtgtgcagcgtgcccctgctgctgcgctggtggaccaaggccagcttctctgtggtgggcatggtgaagagcctgaccaggagctccatggtgaagctgatcctggtgtggctgacagccatcgtgctcttctgctggttctacgtgtacagaagtgagggcatgaaggtgtacaacagcaccctgacctggcagcagtatggagccctgtgtggcccccgggcctggaaggagaccaacatggcccggacccagatcctgtgcagccacctggagggccaccgggtgacctggacaggccgcttcaagtatgtgcgggtgacagacatcgacaacagcgctgagagcgccatcaacatgctgcccttcttcatcggggactggatgcgctgcctgtatggagaggcctacccagcctgcagccctggcaacaccagcacagctgaggaggagctgtgccgcctgaagctgctggccaagcacccctgccacatcaagaagtttgaccgctacaagtttgagatcaccgtgggcatgcccttcagcagtggagcagatggcagccgcagccgggaggaggatgatgtgaccaaggacatcgtgctgcgggccagcagcgagttcaagtctgtgctgctgagcctgcggcagggcagcctgattgagttcagcaccatcctggagggccgcctgggcagcaagtggcctgtgtttgagctgaaggccatcagctgcctgaactgcatggcccagctgagccccacccggcggcacgtgaagattgaacatgactggaggagcacagtgcacggggctgtgaagtttgcctttgacttcttcttcttccccttcctgtctgctgcctag

SEQ ID NO: 19791 - DNA, 654 bp, Artificial Sequence; identical to SEQ ID NO: 19771
  Description of Artificial Sequence: Synthetic coding sequence

SEQ ID NO: 19792 - DNA, 1590 bp, Artificial Sequence
  Description of Artificial Sequence: Synthetic coding sequence
atgggctgtgtgttctgcaagaagctggagcctgtggccacagccaaggaggatgctggcctggagggggacttccgctcctatggagctgctgaccactacggccctgaccccaccaaggcccggcctgccagcagctttgcccacatccccaactacagcaacttcagcagccaggccatcaaccctggcttcctggacagcggcaccatccggggcgtgtctggaattggagtgaccctcttcatcgccctgtatgactatgaggccaggacagaagatgacctgaccttcaccaagggggagaagttccacatcctgaacaacacagaaggagactggtgggaggcccggagcctgagcagcggcaagacaggctgcatccccagcaactacgtggcccctgtggacagcatccaggccgaggagtggtactttgggaagattggaaggaaggatgctgagcggcagctgctgagccctggcaacccccagggcgccttcctgatccgggagagcgagaccaccaagggggcctacagcctgagcatccgggactgggaccagaccaggggggaccacgtgaagcactacaagatcaggaagctggacatgggcggctactacatcaccaccagggtgcagttcaacagcgtgcaggagctggtgcagcactacatggaggtgaatgatggcctgtgcaacctgctgattgccccctgcaccatcatgaagccccagaccctgggcctggccaaggatgcctgggagatcagccgcagcagcatcaccctggagcggcggctgggcaccggctgctttggagatgtgtggctgggcacctggaatggcagcaccaaggtggccgtgaagaccctgaagccaggcaccatgagccccaaggccttcctggaggaggcccaggtgatgaagctgctgcggcatgacaagctggtgcagctgtatgctgtggtgtctgaggagcccatctacatcgtgacagagttcatgtgccacggcagcctgctggacttcctgaagaaccctgagggccaggacctgcggctgccccagctggtggacatggccgcccaggtggccgagggcatggcctacatggagaggatgaactacatccaccgggacctgcgggccgccaacatcctggtgggggagcggctggcctgcaagattgctgactttggcctggcccggctcatcaaggatgatgagtacaacccctgccagggcagcaagttccccatcaagtggacagcccctgaggccgccctgtttggccgcttcaccatcaagagtgatgtgtggagctttggcatcctgctgacagagctgatcaccaagggccgcatcccctacccaggcatgaacaagcgggaggtgctggagcaggtggagcagggctaccacatgccctgccccccaggctgcccagccagcctgtatgaggccatggagcagacctggaggctggaccctgaggagcggcccacctttgagtacctgcagagcttcctggaggactacttcaccagcgctgagccccagtaccagcccggggaccagacctag

SEQ ID NO: 19793 - DNA, 1590 bp, Artificial Sequence; identical to SEQ ID NO: 19792
  Description of Artificial Sequence: Synthetic coding sequence

SEQ ID NO: 19794 - DNA, 1590 bp, Artificial Sequence; identical to SEQ ID NO: 19792
  Description of Artificial Sequence: Synthetic coding sequence

SEQ ID NO: 19795 - DNA, 1590 bp, Artificial Sequence; identical to SEQ ID NO: 19792
  Description of Artificial Sequence: Synthetic coding sequence

SEQ ID NO: 19796 - DNA, 942 bp, Artificial Sequence
  Description of Artificial Sequence: Synthetic coding sequence
atgggctgtgtgttctgcaagaagctggagcctgtggccacagccaaggaggatgctggcctggagggggacttccgctcctatggagctgctgaccactacggccctgaccccaccaaggcccggcctgccagcagctttgcccacatccccaactacagcaacttcagcagccaggccatcaaccctggcttcctggacagcggcaccatccggggcgtgtctggaattggagtgaccctcttcatcgccctgtatgactatgaggccaggacagaagatgacctgaccttcaccaagggggagaagttccacatcctgaacaacacagaaggagactggtgggaggcccggagcctgagcagcggcaagacaggctgcatccccagcaactacgtggcccctgtggacagcatccaggccgaggagtggtactttgggaagattggaaggaaggatgctgagcggcagctgctgagccctggcaacccccagggcgccttcctgatccgggagagcgagaccaccaagggggcctacagcctgagcatccgggactgggaccagaccaggggggaccacgtgaagcactacaagatcaggaagctggacatgggcggctactacatcaccaccagggtgcagttcaacagcgtgcaggagctggtgcagcactacatggaggtgaatgatggcctgtgcaacctgctgattgccccctgcaccatcatgaagccccagaccctgggcctggccaaggatgcctgggagatcagccgcagcagcatcaccctggagcggcggctgggcaccggctgctttggagatgtgtggctgggcacctggaatggcagcaccaaggtggccgtgaagaccctgaagccaggcaccatgagccccaaggccttcctggaggaggcccaggtgatgaagctgctgtag

SEQ ID NO: 19797 - DNA, 1392 bp, Artificial Sequence
  Description of Artificial Sequence: Synthetic coding sequence
atgggctgtgtgttctgcaagaagctggagcctgtggccacagccaaggaggatgctggcctggagggggacttccgctcctatggagctgctgaccactacggccctgaccccaccaaggcccggcctgccagcagctttgcccacatccccaactacagcaacttcagcagccaggccatcaaccctggcttcctggacagcggcaccatccggggcgtgtctggaattggagtgaccctcttcatcgccctgtatgactatgaggccaggacagaagatgacctgaccttcaccaagggggagaagttccacatcctgaacaacacagagggcgcctacagcctgagcatccgggactgggaccagaccaggggggaccacgtgaagcactacaagatcaggaagctggacatgggcggctactacatcaccaccagggtgcagttcaacagcgtgcaggagctggtgcagcactacatggaggtgaatgatggcctgtgcaacctgctgattgccccctgcaccatcatgaagccccagaccctgggcctggccaaggatgcctgggagatcagccgcagcagcatcaccctggagcggcggctgggcaccggctgctttggagatgtgtggctgggcacctggaatggcagcaccaaggtggccgtgaagaccctgaagccaggcaccatgagccccaaggccttcctggaggaggcccaggtgatgaagctgctgcggcatgacaagctggtgcagctgtatgctgtggtgtctgaggagcccatctacatcgtgacagagttcatgtgccacggcagcctgctggacttcctgaagaaccctgagggccaggacctgcggctgccccagctggtggacatggccgcccaggtggccgagggcatggcctacatggagaggatgaactacatccaccgggacctgcgggccgccaacatcctggtgggggagcggctggcctgcaagattgctgactttggcctggcccggctcatcaaggatgatgagtacaacccctgccagggcagcaagttccccatcaagtggacagcccctgaggccgccctgtttggccgcttcaccatcaagagtgatgtgtggagctttggcatcctgctgacagagctgatcaccaagggccgcatcccctacccaggcatgaacaagcgggaggtgctggagcaggtggagcagggctaccacatgccctgccccccaggctgcccagccagcctgtatgaggccatggagcagacctggaggctggaccctgaggagcggcccacctttgagtacctgcagagcttcctggaggactacttcaccagcgctgagccccagtaccagcccggggaccagacctag

SEQ ID NO: 19798 - DNA, 1005 bp, Artificial Sequence
  Description of Artificial Sequence: Synthetic coding sequence
atggagttccctggcctgggcagcctgggcaccagcgagcccctgccccagtttgtggaccctgccctggtgagcagcaccccagagagcggggtcttcttccccagcggccctgagggcctggatgctgctgccagcagcacagcccccagcacagccacagctgctgctgctgccctggcctactacagagatgctgaggcctaccgccacagccctgtgttccaggtgtaccccctgctgaactgcatggagggcatccctgggggcagcccctatgccggctgggcctacggcaagacaggcctgtacccagccagcacagtgtgccccacccgggaggacagccccccccaggccgtggaggacctggatggcaagggcagcaccagcttcctggagaccctgaagacagagcggctgagcccagacctgctgaccctgggccctgccctgcccagcagcctgcctgtgcccaacagcgcctatggaggccctgacttcagcagcaccttcttcagccccaccggcagccccctgaacagcgctgcctacagcagccccaagctgcggggcaccctgcccctgcccccctgtgaggccagagaatgtgtgaactgtggggccacagccacccccctgtggaggcgggacagaacaggccactacctgtgcaatgcctgtggcctgtaccacaagatgaatggccagaaccggcccctcatccggcccaagaagaggctgattgtgtccaagagagctggcacccagtgcaccaactgccagaccaccaccaccaccctgtggaggagaaatgccagcggggaccctgtgtgcaatgcctgtggcctgtactacaagctgcaccagcactactgcggcggcagcgcccagctgatgagggcccagagcatggccagcagaggaggagtggtgtccttcagcagctgcagccagaacagcggccagcccaagagcctgggccccaggcaccccctggcctag

SEQ ID NO: 19799 - DNA, 1242 bp, Artificial Sequence
  Description of Artificial Sequence: Synthetic coding sequence
atggagttccctggcctgggcagcctgggcaccagcgagcccctgccccagtttgtggaccctgccctggtgagcagcaccccagagagcggggtcttcttccccagcggccctgagggcctggatgctgctgccagcagcacagcccccagcacagccacagctgctgctgctgccctggcctactacagagatgctgaggcctaccgccacagccctgtgttccaggtgtaccccctgctgaactgcatggagggcatccctgggggcagcccctatgccggctgggcctacggcaagacaggcctgtacccagccagcacagtgtgccccacccgggaggacagccccccccaggccgtggaggacctggatggcaagggcagcaccagcttcctggagaccctgaagacagagcggctgagcccagacctgctgaccctgggccctgccctgcccagcagcctgcctgtgcccaacagcgcctatggaggccctgacttcagcagcaccttcttcagccccaccggcagccccctgaacagcgctgcctacagcagccccaagctgcggggcaccctgcccctgcccccctgtgaggccagagaatgtgtgaactgtggggccacagccacccccctgtggaggcgggacagaacaggccactacctgtgcaatgcctgtggcctgtaccacaagatgaatggccagaaccggcccctcatccggcccaagaagaggctgattgtgtccaagagagctggcacccagtgcaccaactgccagaccaccaccaccaccctgtggaggagaaatgccagcggggaccctgtgtgcaatgcctgtggcctgtactacaagctgcaccaggtgaaccggcccctgaccatgaggaaggatggcatccagaccaggaacaggaaggccagcggcaagggcaagaagaagaggggcagcagcctgggcggcaccggggctgctgagggccctgctgggggcttcatggtggtggccggcggcagcggcagcggcaactgtggggaggtggccagcggcctgaccctgggccccccaggcacagcccacctgtaccagggcctgggccctgtggtgctgagcggccctgtgagccacctgatgcccttccctggccccctgctgggcagccccaccggcagcttccccaccggccccatgccacccaccaccagcaccaccgtggtggcccccctgagcagctag

SEQ ID NO: 19800 - DNA, 369 bp, Artificial Sequence
  Description of Artificial Sequence: Synthetic coding sequence
tgacagaaccggcccctcatccggcccaagaagaggctcatcgtgtccaagagagctggcacccagtgcaccaactgccagaccaccaccaccaccctgtggaggagaaatgccagcggggaccctgtgtgcaatgcctgtggcctgtactacaagctgcaccaggtgaaccggcccctgaccatgaggaaggatggcatccagaccaggaacaggaaggccagcggcaagggcaagaagaagaggggcagcagcctgggcggcactggagctgctgagggccctgccctgctgtggtggctgcggagcgcccacgagggcacagagcacggcctgcagaggcggggcggcgtgctgctgctgctgtag

SEQ ID NO: 19801 - DNA, 1332 bp, Artificial Sequence
  Description of Artificial Sequence: Synthetic coding sequence
atggaggtgacagctgaccagccccgctgggtgagccaccaccaccctgctgtgctgaatggccagcacccagacacccaccaccctggcctgagccacagctacatggatgctgcccagtaccccctgcctgaggaggtggatgtgctcttcaacattgatggccagggcaaccacgtgcccccctactacggcaacagcgtgcgggccaccgtgcagcgctacccacccacccaccacggcagccaggtgtgcaggcctcccctgctgcacggcagcctgccctggctggatggcggcaaggccctgggcagccaccacacagccagcccctggaacctgagccccttcagcaagaccagcatccaccacggcagccctggccccctgtctgtgtaccccccagccagcagcagcagcctgagcggcggccacgccagcccccacctgttcaccttcccccccaccccacccaaggatgtgtccccagaccccagcctgagcaccccaggcagcgctggcagcgcccggcaggatgagaaggagtgcctgaagtaccaggtgcccctgcctgacagcatgaagctggagagcagccacagccggggctccatgacagccctgggcggggccagcagcagcacccaccaccccatcaccacctacccaccctacgtgcctgagtacagcagcggcctcttcccccccagcagcctgctgggcggcagccccactggatttggctgcaagagccggcccaaggcccggagcagcacaggccgggagtgtgtgaactgtggggccaccagcacccccctgtggaggagagatggcaccggccactacctgtgcaatgcctgtggcctgtaccacaagatgaatggccagaaccggcccctcatcaagcccaagaggcggctgtctgctgccaggagagctggcaccagctgtgccaactgccagaccaccaccaccaccctgtggaggagaaatgccaatggagaccctgtgtgcaatgcctgtggcctgtactacaagctgcacaacatcaaccggcccctgaccatgaagaaggagggcatccagaccaggaacaggaagatgagcagcaagagcaagaagtgcaagaaggtgcatgacagcctggaggacttccccaagaacagcagcttcaacccagctgccctgagccgccacatgagcagcctgagccacatcagccccttcagccacagcagccacatgctgaccacccccacccccatgcacccccccagcagcctgagctttggcccccaccaccccagctccatggtgacagccatgggctag

SEQ ID NO: 19802 - DNA, 1335 bp, Artificial Sequence
  Description of Artificial Sequence: Synthetic coding sequence
atggaggtgacagctgaccagccccgctgggtgagccaccaccaccctgctgtgctgaatggccagcacccagacacccaccaccctggcctgagccacagctacatggatgctgcccagtaccccctgcctgaggaggtggatgtgctcttcaacattgatggccagggcaaccacgtgcccccctactacggcaacagcgtgcgggccaccgtgcagcgctacccacccacccaccacggcagccaggtgtgcaggcctcccctgctgcacggcagcctgccctggctggatggcggcaaggccctgggcagccaccacacagccagcccctggaacctgagccccttcagcaagaccagcatccaccacggcagccctggccccctgtctgtgtaccccccagccagcagcagcagcctgagcggcggccacgccagcccccacctgttcaccttcccccccaccccacccaaggatgtgtccccagaccccagcctgagcaccccaggcagcgctggcagcgcccggcaggatgagaaggagtgcctgaagtaccaggtgcccctgcctgacagcatgaagctggagagcagccacagccggggctccatgacagccctgggcggggccagcagcagcacccaccaccccatcaccacctacccaccctacgtgcctgagtacagcagcggcctcttcccccccagcagcctgctgggcggcagccccactggatttggctgcaagagccggcccaaggcccggagcagcacagagggcagagaatgtgtgaactgtggggccaccagcacccccctgtggaggagagatggcaccggccactacctgtgcaatgcctgtggcctgtaccacaagatgaatggccagaaccggcccctcatcaagcccaagaggcggctgtctgctgcccggcgggccggcaccagctgtgccaactgccagaccaccaccaccaccctgtggaggagaaatgccaacggggaccctgtgtgcaatgcctgtggcctgtactacaagctgcacaacatcaaccggcccctgaccatgaagaaggagggcatccagaccaggaacaggaagatgagcagcaagagcaagaagtgcaagaaggtgcatgacagcctggaggacttccccaagaacagcagcttcaacccagctgccctgagccgccacatgagcagcctgagccacatcagccccttcagccacagcagccacatgctgaccacccccacccccatgcacccccccagcagcctgagctttggcccccaccaccccagctccatggtgacagccatgggctag

SEQ ID NO: 19803 - DNA, 393 bp, Artificial Sequence
  Description of Artificial Sequence: Synthetic coding sequence
atggaggtgacagctgaccagccccgctgggtgagccaccaccaccctgctgtgctgaatggccagcacccagacacccaccaccctggcctgagccacagctacatggatgctgcccagtaccccctgcctgaggaggtggatgtgctcttcaacattgatggccagggcaaccacgtgcccccctactacggcaacagcgtgcgggccaccgtgcagcgctacccacccacccaccacggcagccaggtgtgcaggcctcccctgctgcacggcagcctgccctggctggatggcggcaaggccctgggcagccaccacacagccagcccctggaacctgcggccctgcctgcagtgcctgtgggccctgctgcaggccagccagtgctag

SEQ ID NO: 19804 - DNA, 798 bp, Artificial Sequence
  Description of Artificial Sequence: Synthetic coding sequence
atgagaagagctgagctggccggcctgaagaccatggcctgggtgcctgctgagagcgctgtggaggagctgatgccccggctgctgcctgtggagccctgtgacctgacagagggctttgaccccagcgtgccccccaggaccccccaggagtacctgcggcgggtgcagatcgaggccgcccagtgcccagatgtggtggtggcccagattgaccccaagaagctgaagaggaagcagagcgtgaacatcagcctgagcggctgccagcctgcccctgagggctacagccccaccctgcagtggcagcagcagcaggtggcccagttcagcacagtgcggcagaatgtgaacaagcacaggagccactggaagagccagcagctggacagcaatgtgaccatgcccaagtcagaagatgaggagggctggaagaagttctgcctgggggagaagctgtgtgctgatggagctgtgggccctgccaccaatgaaagccctggcattgattatgtgcaggccaccgtgacctctgtgctggagtacctgagcaactggtttggagagcgggacttcaccccagagctgggccgctggctgtatgccctgctggcctgcctggagaagcccctgctgcctgaggcccacagcctcatccggcagctggcccggcgctgcagcgaggtgcggctgctggtggacagcaaggatgatgagcgggtgcctgccctgaacctgctgatctgcctggtgagccgctactttgaccagagggacctggctgatgagcccagctag

SEQ ID NO: 19805 - DNA, 843 bp, Artificial Sequence
  Description of Artificial Sequence: Synthetic coding sequence
atgagaagagctgagctggccggcctgaagaccatggcctgggtgcctgctgagagcgctgtggaggagctgatgccccggctgctgcctgtggagccctgtgacctgacagagggctttgaccccagcgtgccccccaggaccccccaggagtacctgcggcgggtgcagatcgaggccgcccagtgcccagatgtggtggtggcccagattgaccccaagaagctgaagaggaagcagagcgtgaacatcagcctgagcggctgccagcctgcccctgagggctacagccccaccctgcagtggcagcagcagcaggtggcccagttcagcacagtgcggcagaatgtgaacaagcacaggagccactggaagagccagcagctggacagcaatgtgaccatgcccaagtcagaagatgaggagggctggaagaagttctgcctgggggagaagctgtgtgctgatggagctgtgggccctgccaccaatgaaagccctggcattgattatgtgcagatcggcttcccccccctgctgagcatcgtgtccaggatgaaccaggccaccgtgacctctgtgctggagtacctgagcaactggtttggagagcgggacttcaccccagagctgggccgctggctgtatgccctgctggcctgcctggagaagcccctgctgcctgaggcccacagcctcatccggcagctggcccggcgctgcagcgaggtgcggctgctggtggacagcaaggatgatgagcgggtgcctgccctgaacctgctgatctgcctggtgagccgctactttgaccagagggacctggctgatgagcccagctag

SEQ ID NO: 19806 - DNA, 753 bp, Artificial Sequence
  Description of Artificial Sequence: Synthetic coding sequence
atgagaagagctgagctggccggcctgaagaccatggcctgggtgcctgctgagagcgctgtggaggagctgatgccccggctgctgcctgtggagccctgtgacctgacagagggctttgaccccagcgtgccccccaggaccccccaggagtacctgcggcgggtgcagatcgaggccgcccagtgcccagatgtggtggtggcccagattgaccccaagaagctgaagaggaagcagagcgtgaacatcagcctgagcggctgccagcctgcccctgagggctacagccccaccctgcagtggcagcagcagcaggtggcccagttcagcacagtgcggcagaatgtgaacaagcacaggagccactggaagagccagcagctggacagcaatgtgaccatgcccaagtcagaagatgaggagggctggaagaagttctgcctgggggagaagctgtgtgctgatggagctgtgggccctgccaccaatgaaagccctggcattgattatgtgcagatcggcttcccccccctgctgagcatcgtgtccaggatgaaccaggccaccgtgacctctgtgctggagtacctgagcaactggtttggagagcgggacttcaccccagagctgggccgctggctgtatgccctgctggcctgcctggagaagcccctgctgcctgaggcccacagcctcatccggcagctggcccggcgctgcagcgaggtgcggctgctggtggtgttctag

SEQ ID NO: 19807 - DNA, 768 bp, Artificial Sequence
  Description of Artificial Sequence: Synthetic coding sequence
atggatgtgatggatggctgccagttcagccccagcgagtacttctatgatggcagctgcatccccagccctgagggggagtttggagatgaatttgtgccccgggtggccgcctttggagcccacaaggccgagctgcagggcagtgatgaagatgagcacgtgcgggcccccaccggccaccaccaggccggccactgcctgatgtgggcctgcaaggcctgcaagaggaagagcaccaccatggacaggaggaaggccgccaccatgagggagcggcggcggctgaagaaggtgaaccaggcctttgagaccctgaagcgctgcaccaccaccaaccccaaccagaggctgcccaaggtggagatcctgagaaatgccatccgctacatcgagagcctgcaggagctgctgcgggagcaggtggagaactactacagcctgcccggccagagctgcagcgagcccaccagccccaccagcaactgcagtgatggcatgcctgagtgcaacagccctgtgtggagcaggaagagcagcacctttgacagcatctactgcccagatgtgtccaatgtgtatgccacagacaagaacagcctgagcagcctggactgcctgagcaacatcgtggaccgcatcaccagcagcgagcagcccggcctgcccctgcaggacctggccagcctgagccctgtggccagcacagacagccagcctgccacccctggggccagcagcagccgcctcatctaccacgtgctgtag

SEQ ID NO: 19808 - DNA, 1725 bp, Artificial Sequence
  Description of Artificial Sequence: Synthetic coding sequence
ctgagccccagcctgggcttccctgcccagatgaaccaccagaagggccccagccccagctttggagtgcagccctgtggcccccatgattctgcccggggcggcatgatcccccacccccagagccggggccccttccccacctgccagctgaagtctgagctggacatgctggtgggcaaatgtcgggaggagcccctggagggggacatgagcagccccaacagcacaggcatccaggaccccctgctgggcatgctggatggaagagaggacctggagcgggaggagaagcgggagcctgagagcgtgtatgaaacagactgccgctgggatggctgcagccaggagtttgacagccaggagcagctggtgcaccacatcaacagcgagcacatccacggggagaggaaggagtttgtgtgccactggggcggctgcagccgggagctgcggcccttcaaggcccagtacatgctggtggtgcacatgagaagacacactggagagaagccccacaagtgcacctttgagggctgcaggaagagctacagccggctggagaacctgaagacccacctgcggagccacactggagagaagccctacatgtgtgaacatgagggctgcagcaaggccttcagcaatgccagtgaccgggccaagcaccagaacagaacccacagcaatgagaagccctacgtgtgcaagctgcccggctgcaccaagcgctacacagaccccagcagcctgaggaagcacgtgaagacagtgcacggcccagatgcccacgtgaccaagaggcacagaggagatggccccctgccccgggcccccagcatcagcacagtggagcccaagcgggagcgggagggcggccccatccgggaggagagccggctgactgtgcctgagggcgccatgccaccccacccccagcccctcttcagccactacccccagcccagccccccccagtacctgcagagcggcccctacacccagcccccaccagactacctgcccagcgagccccggccctgcctggactttgacagccccacccacagcacaggccagctgaaggcccagctggtgtgcaactacgtgcagagccagcaggagctgctgtgggagggcggcggccgggaggatgccccagcccaggagcccagctaccagagccccaagttcctgggcggcagccaggtgagccccagccgggccaaggcccctgtgaacacctacggccctggcttcggccccaacctgcccaaccacaagagcggcagctaccccacccccagcccctgccacgagaactttgtggtgggcgccaacagagccagccacagagctgctgccccaccccggctgctgccccccctgcccacctgctacggccccctgaaggtgggcggcaccaaccccagctgtggccaccctgaggtgggccgcctgggcggcggccctgccctgtacccacctcctgagggccaggtgtgcaaccccctggacagcctggacctggacaacacccagctggactttgtggccatcctggatgagccccagggcctgagccccccacccagccatgaccagaggggcagcagcggccacaccccaccacccagcggcccccccaacatggctgtgggcaacatgtctgtgctgctgcggagcctgcccggggagacagagttcctgaacagcagcgcctag

SEQ ID NO: 19809 - DNA, 390 bp, Artificial Sequence
  Description of Artificial Sequence: Synthetic coding sequence
atgttcaacagcatgaccccaccacccatcagcagctatggagagccctgctgcctgcggcccctgcccagccagggcgcccccagcgtgggcacagagggcctgagcggcccccccttctgccaccaggccaacctgatgagcggcccccacagctatggccctgcccgggagaccaacagctgcacagagggccccctcttcagcagccccaggtctgctgtgaagctgaccaagaagagggccctgagcatcagccccctgagtgatgccagcctggacctgcagaccgtcatccgcaccagccccagcagcctggtggccttcatcaacagccgctgcaccagccctgggggcagctatggccacctgagcatcggcaccatgtag

SEQ ID NO: 19810 - DNA, 3198 bp, Artificial Sequence
  Description of Artificial Sequence: Synthetic coding sequence
atgttcaacagcatgaccccaccacccatcagcagctatggagagccctgctgcctgcggcccctgcccagccagggcgcccccagcgtgggcacagaggtgaagctgaccaagaagagggccctgagcatcagccccctgagtgatgccagcctggacctgcagaccgtcatccgcaccagccccagcagcctggtggccttcatcaacagccgctgcaccagccctgggggcagctatggccacctgagcatcggcaccatgagccccagcctgggcttccctgcccagatgaaccaccagaagggccccagccccagctttggagtgcagccctgtggcccccatgacagcgcccggggcggcatgatcccccacccccagagccggggccccttccccacctgccagctgaagtctgagctggacatgctggtgggcaagtgccgggaggagcccctggagggggacatgagcagccccaacagcacaggcatccaggaccccctgctgggcatgctggatggccgggaggacctggagcgggaggagaagcgggagcctgagagcgtgtatgaaacagactgccgctgggatggctgcagccaggagtttgacagccaggagcagctggtgcaccacatcaacagcgagcacatccatggagagaggaaggagtttgtgtgccactggggcggctgcagccgggagctgcggcccttcaaggcccagtacatgctggtggtgcacatgaggaggcacactggagagaagccccacaagtgcacctttgagggctgcaggaagagctacagccggctggagaacctgaagacccacctgcggagccacactggagagaagccctacatgtgtgagcacgagggctgcagcaaggccttcagcaatgccagtgaccgggccaagcaccagaacagaacccacagcaatgagaagccctacgtgtgcaagctgcccggctgcaccaagcgctacacagaccccagcagcctgaggaagcacgtgaagacagtgcacggcccagatgcccacgtgaccaagaggcacagaggagatggccccctgccccgggcccccagcatcagcacagtggagcccaagcgggagcgggagggcggccccatccgggaggagagccggctgactgtgcctgagggcgccatgaagccccagcccagccctggggcccagagcagctgcagcagtgaccacagccctgctggcagcgctgccaacacagacagcggcgtggagatgactggaaatgctgggggcagcacagaggacctgagcagcctggatgagggcccctgcatcgccggcaccggcctgagcaccctgcggcggctggagaacctgcggctggaccagctgcaccagctgcggcccatcggcacccggggcctgaagctgcccagcctgagccacacaggcaccaccgtgtcccggcgggtgggcccccctgtgtccctggagcggcgcagcagcagcagcagcagcatcagcagcgcctacacagtgagccgccgcagcagcctggccagccccttccccccaggcagccccccagaaaatggagccagcagcctgcccggcctgatgcctgcccagcactacctgctgcgggcccgctatgccagcgcccggggcggcggcaccagccccacagctgccagcagcctggacagaattggaggcctgcccatgccaccctggaggagcagagctgagtacccaggctacaaccccaatgctggggtgacccggcgggccagtgaccctgcccaggccgctgacaggcctgccccagcccgggtgcagcgcttcaagagcctgggctgtgtgcacaccccacccaccgtggccggcggcggccagaactttgacccctacctgcccacctctgtgtacagcccccagccccccagcatcacagaaaatgctgccatggatgcccggggcctgcaggaggagcctgaggtgggcacctccatggtgggcagcggcctgaacccctacatggacttccccccaacagacaccctgggctatggaggccctgagggcgctgctgctgagccctacggggcccggggccctggcagcctgcccctgggccctggcccccccaccaactacggccccaacccctgcccccagcaggccagctacccagaccccacccaggagacctggggcgagttccccagccacagcggcctgtacccaggccccaaggccctgggcggcacctacagccagtgcccccggctggagcactacggccaggtgcaggtgaagccagagcagggctgccctgtgggcagtgacagcacaggcctggccccctgcctgaatgcccaccccagcgagggccccccccacccccagcccctcttcagccactacccccagcccagccccccccagtacctgcagagcggcccctacacccagcccccaccagactacctgcccagcgagccccggccctgcctggactttgacagccccacccacagcacaggccagctgaaggcccagctggtgtgcaactacgtgcagagccagcaggagctgctgtgggagggcggcggcagagaagatgccccagcccaggagcccagctaccagagccccaagttcctgggcggcagccaggtgagccccagccgggccaaggcccctgtgaacacctacggccctggcttcggccccaacctgcccaaccacaagagcggcagctaccccacccccagcccctgccatgaaaattttgtggtgggcgccaacagagccagccacagagctgctgccccaccccggctgctgccccccctgcccacctgctacggccccctgaaggtgggcggcaccaaccccagctgtggccaccctgaggtgggccgcctgggcggcggccctgccctgtacccacctcctgagggccaggtgtgcaaccccctggacagcctggacctggacaacacccagctggactttgtggccatcctggatgagccccagggcctgagccccccacccagccatgaccagaggggcagcagcggccacaccccacctccttctggcccccccaacatggctgtgggcaacatgtctgtgctgctgcggagcctgcctggagaaacagagttcctgaacagcagcgcctag

SEQ ID NO: 19811 - DNA, 528 bp, Artificial Sequence
  Description of Artificial Sequence: Synthetic coding sequence
atgagccccagcctgggcttccctgcccagatgaaccaccagaagggccccagccccagctttggagtgcagccctgtggcccccatgattctgcccggggcggcatgatcccccacccccagagccggggccccttccccacctgccagctgaagtctgagctggacatgctggtgggcaaatgtcgggaggagcccctggagggggacatgagcagccccaacagcacaggcatccaggaccccctgctgggcatgctggatggaagagaggacctggagcgggaggagaagcgggagcctgagagcgtgtatgaaacagactgccgctgggatggctgcagccaggagtttgacagccaggagcagctggtgcaccacatcaacagcgagcacatccacggggagaggaaggagtttgtgtgccactggggcggctgcagccgggagctgcggcccttcaaggcccagtacatgctggtggtgcacatgagaagacacactggagagaagccccacaagtgctag

SEQ ID NO: 19812 - DNA, 2937 bp, Artificial Sequence
  Description of Artificial Sequence: Synthetic coding sequence
atgagccccagcctgggcttccctgcccagatgaaccaccagaagggccccagccccagctttggagtgcagccctgtggcccccatgattctgcccggggcggcatgatcccccacccccagagccggggccccttccccacctgccagctgaagtctgagctggacatgctggtgggcaaatgtcgggaggagcccctggagggggacatgagcagccccaacagcacaggcatccaggaccccctgctgggcatgctggatggaagagaggacctggagcgggaggagaagcgggagcctgagagcgtgtatgaaacagactgccgctgggatggctgcagccaggagtttgacagccaggagcagctggtgcaccacatcaacagcgagcacatccacggggagaggaaggagtttgtgtgccactggggcggctgcagccgggagctgcggcccttcaaggcccagtacatgctggtggtgcacatgagaagacacactggagagaagccccacaagtgcacctttgagggctgcaggaagagctacagccggctggagaacctgaagacccacctgcggagccacactggagagaagccctacatgtgtgaacatgagggctgcagcaaggccttcagcaatgccagtgaccgggccaagcaccagaacagaacccacagcaatgagaagccctacgtgtgcaagctgcccggctgcaccaagcgctacacagaccccagcagcctgaggaagcacgtgaagacagtgcacggcccagatgcccacgtgaccaagaggcacagaggagatggccccctgccccgggcccccagcatcagcacagtggagcccaagcgggagcgggagggcggccccatccgggaggagagccggctgactgtgcctgagggcgccatgaagccccagcccagccctggggcccagagcagctgcagcagtgaccacagccctgctggcagcgctgccaacacagattctggagtggagatgactggaaatgccggcggcagcacagaggacctgagcagcctggatgagggcccctgcatcgccggcaccggcctgagcaccctgcggcggctggagaacctgcggctggaccagctgcaccagctgcggcccatcggcacccggggcctgaagctgcccagcctgagccacacaggcaccaccgtgtccagaagagtgggcccccctgtgtccctggagaggaggagcagcagcagcagcagcatcagcagcgcctacacagtgtccagaagaagcagcctggccagccccttccccccaggcagccccccagaaaatggagccagcagcctgcccggcctgatgcctgcccagcactacctgctgcgggcccgctatgccagcgcccggggcggcggcaccagccccacagctgccagcagcctggaccgcatcggcggcctgcccatgccaccctggaggagcagagctgagtacccaggctacaaccccaatgctggggtgacccggcgggccagtgaccctgcccaggccgctgacaggcctgccccagcccgggtgcagcgcttcaagagcctgggctgtgtgcacaccccacccaccgtggccggcggcggccagaactttgacccctacctgcccacctctgtgtacagcccccagcccccatccatcacagaaaatgctgccatggatgcccggggcctgcaggaggagcctgaggtgggcacctccatggtgggcagcggcctgaacccctacatggacttccccccaacagacaccctgggctacggcggccctgagggcgctgctgctgagccctatggagcccggggccctggcagcctgcccctgggccctggcccccccaccaactacggccccaacccctgcccccagcaggccagctacccagaccccacccaggagacctggggcgagttccccagccacagcggcctgtacccaggccccaaggccctgggcggcacctacagccagtgcccccggctggagcactacggccaggtgcaggtgaagccagagcagggctgccctgtgggcagtgacagcacaggcctggccccctgcctgaatgcccaccccagcgagggccccccccacccccagcccctcttcagccactacccccagcccagccccccccagtacctgcagagcggcccctacacccagcccccaccagactacctgcccagcgagccccggccctgcctggactttgacagccccacccacagcacaggccagctgaaggcccagctggtgtgcaactacgtgcagagccagcaggagctgctgtgggagggcggcggccgggaggatgccccagcccaggagcccagctaccagagccccaagttcctgggcggcagccaggtgagccccagccgggccaaggcccctgtgaacacctacggccctggcttcggccccaacctgcccaaccacaagagcggcagctaccccacccccagcccctgccacgagaactttgtggtgggcgccaacagagccagccacagagctgctgccccaccccggctgctgccccccctgcccacctgctacggccccctgaaggtgggcggcaccaaccccagctgtggccaccctgaggtgggccgcctgggcggcggccctgccctgtacccacctcctgagggccaggtgtgcaaccccctggacagcctggacctggacaacacccagctggactttgtggccatcctggatgagccccagggcctgagccccccacccagccatgaccagaggggcagcagcggccacaccccaccacccagcggcccccccaacatggctgtgggcaacatgtctgtgctgctgcggagcctgcccggggagacagagttcctgaacagcagcgcctag

SEQ ID NO: 19813 - DNA, 135 bp, Artificial Sequence
  Description of Artificial Sequence: Synthetic coding sequence
atgagcggcccccacagctatggccctgcccgggagaccaacagctgcacagagggccccctcttcagcagccccaggtctgctgtgaagctgaccaagaagagggccctgagcatcagccccctgagtgactag

SEQ ID NO: 19814 - DNA, 3198 bp, Artificial Sequence; identical to SEQ ID NO: 19810
  Description of Artificial Sequence: Synthetic coding sequence

SEQ ID NO: 19815 - DNA, 1548 bp, Artificial Sequence
  Description of Artificial Sequence: Synthetic coding sequence
atggccgagcaggtggccctgagcaggacccaggtgtgtggcatcctgcgggaggagctgttccagggagatgccttccaccagagcgacacccacatcttcatcatcatgggcgccagcggggacctggccaagaagaagatctaccccaccatctggtggctgttcagagatggcctgctgcctgagaacaccttcatcgtgggctacgcccggagccggctgactgtggccgacatcaggaagcagagcgagcccttcttcaaggccaccccagaggagaagctgaagctggaggacttctttgccaggaacagctatgtggccggccagtatgatgatgctgccagctaccagaggctgaacagccacatgaatgccctgcacctgggcagccaggccaacagactcttctacctggccctgcccccaacagtgtatgaagctgtgaccaagaacatccacgagagctgcatgagccagatcggctggaaccgcatcatcgtggagaagcccttcggccgggacctgcagagcagtgaccggctgagcaaccacatcagcagcctcttccgggaggaccagatctacagaattgaccactacctgggcaaggagatggtgcagaacctgatggtgctgcgctttgccaaccgcatcttcggccccatctggaacagagacaacatcgcctgcgtcatcctgaccttcaaggagccctttggaacagagggccggggcggctactttgatgaatttggcatcatcagagatgtgatgcagaaccacctgctgcagatgctgtgcctggtggccatggagaagccagccagcaccaacagtgatgatgtgagagatgagaaggtgaaggtgctgaagtgcatcagcgaggtgcaggccaacaacgtggtgctgggccagtatgtgggcaacccagatggagagggggaggccaccaagggctacctggatgaccccaccgtgccccggggcagcaccacagccacctttgctgctgtggtgctgtatgtggagaatgaacgctgggatggagtgcccttcatcctgcgctgtgggaaggccctgaatgaaaggaaggccgaggtgcggctgcagttccatgatgtggccggggacatcttccaccagcagtgcaagagaaatgagctggtgatccgggtgcagcccaatgaagctgtgtacaccaagatgatgaccaagaagccaggcatgttcttcaaccctgaggagagcgagctggacctgacctacggcaaccgctacaagaatgtgaagctgcctgatgcctatgagcggctcatcctggatgtgttctgtggcagccagatgcactttgtgcggagtgatgagctgcgggaggcctggaggatcttcacccccctgctgcaccagatcgagctggagaagcccaagcccatcccctacatctacggcagccggggccccacagaagcagatgagctgatgaagagggtgggcttccagtatgagggcacctacaagtgggtgaacccccacaagctgtag

SEQ ID NO: 19816 - DNA, 1686 bp, Artificial Sequence
  Description of Artificial Sequence: Synthetic coding sequence
atggccgagcaggtggccctgagcaggacccaggtgtgtggcatcctgcgggaggagctgttccagggagatgccttccaccagagcgacacccacatcttcatcatcatgggcgccagcggggacctggccaagaagaagatctaccccaccatctggtggctgttcagagatggcctgctgcctgagaacaccttcatcgtgggctacgcccggagccggctgactgtggccgacatcaggaagcagagcgagcccttcttcaaggccaccccagaggagaagctgaagctggaggacttctttgccaggaacagctatgtggccggccagtatgatgatgctgccagctaccagaggctgaacagccacatgaatgccctgcacctgggcagccaggccaacagactcttctacctggccctgcccccaacagtgtatgaagctgtgaccaagaacatccacgagagctgcatgagccagatcggctggaaccgcatcatcgtggagaagcccttcggccgggacctgcagagcagtgaccggctgagcaaccacatcagcagcctcttccgggaggaccagatctacagaattgaccactacctgggcaaggagatggtgcagaacctgatggtgctgcgctttgccaaccgcatcttcggccccatctggaacagagacaacatcgcctgcgtcatcctgaccttcaaggagccctttggaacagagggccggggcggctactttgatgaatttggcatcatccggggccctggccggcagggcggcagcggcagcgagagctgcagcctgagcctgggcagcctggtgtggggcccccacgccctggagcccggggagcagggcggggagctgcggcgggccctggccagctctgtgcccagagatgtgatgcagaaccacctgctgcagatgctgtgcctggtggccatggagaagccagccagcaccaacagtgatgatgtgagagatgagaaggtgaaggtgctgaagtgcatcagcgaggtgcaggccaacaacgtggtgctgggccagtatgtgggcaacccagatggagagggggaggccaccaagggctacctggatgaccccaccgtgccccggggcagcaccacagccacctttgctgctgtggtgctgtatgtggagaatgaacgctgggatggagtgcccttcatcctgcgctgtgggaaggccctgaatgaaaggaaggccgaggtgcggctgcagttccatgatgtggccggggacatcttccaccagcagtgcaagagaaatgagctggtgatccgggtgcagcccaatgaagctgtgtacaccaagatgatgaccaagaagccaggcatgttcttcaaccctgaggagagcgagctggacctgacctacggcaaccgctacaagaatgtgaagctgcctgatgcctatgagcggctcatcctggatgtgttctgtggcagccagatgcactttgtgcggagtgatgagctgcgggaggcctggaggatcttcacccccctgctgcaccagatcgagctggagaagcccaagcccatcccctacatctacggcagccggggccccacagaagcagatgagctgatgaagagggtgggcttccagtatgagggcacctacaagtgggtgaacccccacaagctgtag

SEQ ID NO: 19817 - DNA, 1638 bp, Artificial Sequence
  Description of Artificial Sequence: Synthetic coding sequence
atgggcagaagaggcagcgcccctggaaatggccgcaccctgcggggctgtgagcggggcggcagaagaagaagatctgctgacagcgtgatggccgagcaggtggccctgagcaggacccaggtgtgtggcatcctgcgggaggagctgttccagggagatgccttccaccagagcgacacccacatcttcatcatcatgggcgccagcggggacctggccaagaagaagatctaccccaccatctggtggctgttcagagatggcctgctgcctgagaacaccttcatcgtgggctacgcccggagccggctgactgtggccgacatcaggaagcagagcgagcccttcttcaaggccaccccagaggagaagctgaagctggaggacttctttgccaggaacagctatgtggccggccagtatgatgatgctgccagctaccagaggctgaacagccacatgaatgccctgcacctgggcagccaggccaacagactcttctacctggccctgcccccaacagtgtatgaagctgtgaccaagaacatccacgagagctgcatgagccagatcggctggaaccgcatcatcgtggagaagcccttcggccgggacctgcagagcagtgaccggctgagcaaccacatcagcagcctcttccgggaggaccagatctacagaattgaccactacctgggcaaggagatggtgcagaacctgatggtgctgcgctttgccaaccgcatcttcggccccatctggaacagagacaacatcgcctgcgtcatcctgaccttcaaggagccctttggaacagagggccggggcggctactttgatgaatttggcatcatcagagatgtgatgcagaaccacctgctgcagatgctgtgcctggtggccatggagaagccagccagcaccaacagtgatgatgtgagagatgagaaggtgaaggtgctgaagtgcatcagcgaggtgcaggccaacaacgtggtgctgggccagtatgtgggcaacccagatggagagggggaggccaccaagggctacctggatgaccccaccgtgccccggggcagcaccacagccacctttgctgctgtggtgctgtatgtggagaatgaacgctgggatggagtgcccttcatcctgcgctgtgggaaggccctgaatgaaaggaaggccgaggtgcggctgcagttccatgatgtggccggggacatcttccaccagcagtgcaagagaaatgagctggtgatccgggtgcagcccaatgaagctgtgtacaccaagatgatgaccaagaagccaggcatgttcttcaaccctgaggagagcgagctggacctgacctacggcaaccgctacaagaatgtgaagctgcctgatgcctatgagcggctcatcctggatgtgttctgtggcagccagatgcactttgtgcggagtgatgagctgcgggaggcctggaggatcttcacccccctgctgcaccagatcgagctggagaagcccaagcccatcccctacatctacggcagccggggccccacagaagcagatgagctgatgaagagggtgggcttccagtatgagggcacctacaagtgggtgaacccccacaagctgtag

SEQ ID NO: 19818 - DNA, 1548 bp, Artificial Sequence; identical to SEQ ID NO: 19815
  Description of Artificial Sequence: Synthetic coding sequence

SEQ ID NO: 19819 - DNA, 771 bp, Artificial Sequence
  Description of Artificial Sequence: Synthetic coding sequence
atggccgagcaggtggccctgagcaggacccaggtgtgtggcatcctgcgggaggagctgttccagggagatgccttccaccagagcgacacccacatcttcatcatcatgggcgccagcggggacctggccaagaagaagatctaccccaccatctggtggctgttcagagatggcctgctgcctgagaacaccttcatcgtgggctacgcccggagccggctgactgtggccgacatcaggaagcagagcgagcccttcttcaaggccaccccagaggagaagctgaagctggaggacttctttgccaggaacagctatgtggccggccagtatgatgatgctgccagctaccagaggctgaacagccacatgaatgccctgcacctgggcagccaggccaacagactcttctacctggccctgcccccaacagtgtatgaagctgtgaccaagaacatccacgagagctgcatgagccagatcggctggaaccgcatcatcgtggagaagcccttcggccgggacctgcagagcagtgaccggctgagcaaccacatcagcagcctcttccgggaggaccagatctacagaattgaccactacctgggcaaggagatggtgcagaacctgatggtgctgcgctttgccaaccgcatcttcggccccatctggaacagagacaacatcgcctgcgtcatcctgaccttcaaggagccctttggaacagagggccggggcggctactttgatgaatttggcatcatctag

SEQ ID NO: 19820 - DNA, 675 bp, Artificial Sequence
  Description of Artificial Sequence: Synthetic coding sequence
atggcccggctgctgcaggccagctgcctgctgagcctgctgctggccggctttgtgtcccagagccggggccaggagaagagcaagatggactgccacggcggcatcagcggcaccatctatgaatatggagccctgaccattgatggagaggagtacatccccttcaagcagtatgctgggaagtatgtgctgtttgtgaatgtggccagctacctgaccggccagtacatcgagctgaatgccctgcaggaggagctggcccccttcggcctggtgatcctgggcttcccctgcaaccagtttgggaagcaggagcctggagaaaattctgagatcctgcccaccctgaagtatgtgcggcctgggggcggctttgtgcccaacttccagctgtttgagaagggagatgtgaatggagagaaggagcagaagttctacaccttcctgaagaacagctgcccccccaccagcgagctgctgggcaccagtgacaggctcttctgggagcccatgaaggtgcatgacatccgctggaactttgagaagttcctggtgggcccagatggcatccccatcatgcgctggcaccacaggaccaccgtgtccaatgtgaagatggacatcctgagctacatgaggcggcaggccgccctgggcgtgaagaggaagtag

SEQ ID NO: 19821 - DNA, 219 bp, Artificial Sequence
  Description of Artificial Sequence: Synthetic coding sequence
atggcccggctgctgcaggccagctgcctgctgagcctgctgctggccggctttgtgtcccagagccggggccaggagaagagcaagatggactgccacggcggcatcagcggcaccatctatgaatatggagccctgaccattgatggagaggagtacatccccttcaagcagtatgctgggaagtatgtgctgtttgtgaatgtggccagctactag

SEQ ID NO: 19822 - DNA, 633 bp, Artificial Sequence
  Description of Artificial Sequence: Synthetic coding sequence
atgccaccctacacagtggtgtacttccctgtgcggggccgctgtgccgccctgaggatgctgctggccgaccagggccagagctggaaggaggaggtggtgacagtggagacctggcaggagggcagcctgaaggccagctgcctgtatggccagctgcccaagttccaggatggagacctgaccctgtaccagagcaacaccatcctgcggcacctgggccgcaccctgggcctgtatggcaaggaccagcaggaggccgccctggtggacatggtgaatgatggagtggaggacctgcgctgcaagtacatcagcctcatctacaccaactatgaggccggcaaggatgattatgtgaaggccctgcccggccagctgaagccctttgagaccctgctgagccagaaccagggcggcaagaccttcatcgtgggggaccagatcagctttgctgactacaacctgctggacctgctgctgattcatgaggtgctggcccctggctgcctggatgccttccccctgctgagcgcctacgtgggccgcctgagcgcccggcccaagctgaaggccttcctggccagcccagaatatgtgaacctgcccatcaatggaaatggcaagcagtag

SEQ ID NO: 19823 - DNA, 2184 bp, Artificial Sequence
  Description of Artificial Sequence: Synthetic coding sequence
atggccttccagaaggctgtgaagggcaccatcctggtgggcggcggggccctggccaccgtgctgggcctgagccagtttgcccactacagaaggaagcagatgaacctggcctacgtgaaggctgctgactgcatcagcgagcctgtgaaccgggagccccccagccgggaggcccagctgctgaccctgcagaacaccagcgagtttgacatcctggtgattggaggaggagccaccggcagcggctgtgccctggatgctgtgacccggggcctgaagacagccctggtggagagagatgacttcagcagcggcaccagcagccgcagcaccaagctgatccacggcggcgtgcgctacctgcagaaggccatcatgaagctggacatcgagcagtacaggatggtgaaggaggccctgcacgagcgggccaacctgctggagatcgccccccacctgagcgcccccctgcccatcatgctgcctgtgtacaagtggtggcagctgccctactactgggtgggcatcaagctgtatgacctggtggccggcagcaactgcctgaagagcagctatgtgctgagcaagagccgggccctggagcacttccccatgctgcagaaggacaagctggtgggcgccatcgtgtactatgatggccagcacaatgatgccaggatgaacctggccatcgccctgacagctgcccgctatggagctgccacagccaactacatggaggtggtgtccctgctgaagaagacagacccccagacaggcaaggtgcgggtgtctggggcccgctgcaaggatgtgctgaccggccaggagtttgatgtgcgggccaagtgtgtgatcaatgccaccggccccttcacagacagcgtgaggaagatggatgacaaggatgctgctgccatctgccagcccagcgctggggtgcacatcgtgatgcctggctactacagccctgagagcatgggcctgctggaccctgccaccagtgatggccgggtcatcttcttcctgccctggcagaagatgaccatcgccggcaccacagacacccccacagatgtgacccaccaccccatccccagcgaggaggacatcaacttcatcctgaatgaggtgaggaactacctgagctgtgatgtggaggtgagaagaggagatgtgctggccgcctggagcggcatccggcccctggtgacagaccccaagtctgctgacacccagagcatcagcaggaaccacgtggtggacatcagcgagagcggcctcatcaccatcgccggcggcaagtggaccacctaccgctccatggccgaggacaccatcaatgctgctgtgaagacccacaacctgaaggccggccccagcaggacagtgggcctcttcctgcagggcggcaaggactggagccccaccctgtacatccggctggtgcaggactatggcctggagagcgaggtggcccagcacctggccgccacctatggagacaaggcctttgaggtggccaagatggcctctgtgacaggcaagcgctggcccatcgtgggcgtgcggctggtgtctgagttcccctacattgaagctgaggtgaagtatggcatcaaggagtatgcctgcacagctgtggacatgatcagcaggaggacccggctggccttcctgaatgtgcaggccgctgaggaggccctgcccagaattgtggagctgatgggccgggagctgaactgggatgactacaagaagcaggagcagctggagacagccaggaagttcctgtactatgagatgggctacaagagccgctctgagcagctgacagacagaagtgagatcagcctgctgcccagcgacatcgaccgctacaagaagcgcttccacaagtttgatgctgaccagaagggcttcatcaccatcgtggatgtgcagagggtgctggagagcatcaacgtgcagatggatgagaacaccctgcacgagatcctgaatgaggtggacctgaacaagaatggccaggtggagctgaatgagttcctgcagctgatgtctgccatccagaagggccgggtgtctggcagccggctggccatcctgatgaagacagctgaggagaacctggaccggcgggtgcccatccctgtggacaggagctgtggcggcctgtag

SEQ ID NO: 19824 - DNA, 1503 bp, Artificial Sequence
  Description of Artificial Sequence: Synthetic coding sequence
atgaacctggccatcgccctgacagctgcccgctacggggccgccacagccaactacatggaggtggtgtccctgctgaagaagacagacccccagacaggcaaggtgcgggtgtctggggcccgctgcaaggatgtgctgaccggccaggagtttgatgtgcgggccaagtgtgtgatcaatgccaccggccccttcacagattctgtgaggaagatggatgacaaggatgctgctgccatctgccagcccagcgctggggtgcacatcgtgatgcctggctactacagccctgagagcatgggcctgctggaccctgccaccagtgatggccgggtcatcttcttcctgccctggcagaagatgaccatcgccggcaccacagacacccccacagatgtgacccaccaccccatccccagcgaggaggacatcaacttcatcctgaatgaggtgaggaactacctgagctgtgatgtggaggtgagaagaggagatgtgctggccgcctggagcggcatccggcccctggtgacagaccccaagtctgctgacacccagagcatcagcagaaatcatgtggtggacatcagcgagagcggcctcatcaccatcgccggcggcaagtggaccacctaccgctccatggccgaggacaccatcaatgctgctgtgaagacccacaacctgaaggccggccccagcaggacagtgggcctcttcctgcagggcggcaaggactggagccccaccctgtacatccggctggtgcaggactatggcctggagagcgaggtggcccagcacctggccgccacctacggggacaaggcctttgaggtggccaagatggcctctgtgacaggcaagcgctggcccatcgtgggcgtgcggctggtgtctgagttcccctacatcgaggccgaggtgaagtatggcatcaaggagtatgcctgcacagctgtggacatgatcagcaggaggacccggctggccttcctgaatgtgcaggccgctgaggaggccctgccccgcatcgtggagctgatgggccgggagctgaactgggatgactacaagaagcaggagcagctggagacagccaggaagttcctgtactatgagatgggctacaagagccgctctgagcagctgacagacagaagtgagatcagcctgctgcccagcgacatcgaccgctacaagaagcgcttccacaagtttgatgctgaccagaagggcttcatcaccatcgtggatgtgcagagggtgctggagagcatcaacgtgcagatggatgagaacaccctgcacgagatcctgaatgaggtggacctgaacaagaatggccaggtggagctgaatgagttcctgcagctgatgtctgccatccagaagggccgggtgtctggcagccggctggccatcctgatgaagacagctgaggagaacctggacagaagagtgcccatccctgtggacaggagctgtggcggcctgtag

SEQ ID NO: 19825 - DNA, 2184 bp, Artificial Sequence; identical to SEQ ID NO: 19823
  Description of Artificial Sequence: Synthetic coding sequence

SEQ ID NO: 19826 - DNA, 2184 bp, Artificial Sequence; identical to SEQ ID NO: 19823
  Description of Artificial Sequence: Synthetic coding sequence

SEQ ID NO: 19827 - DNA, 330 bp, Artificial Sequence
  Description of Artificial Sequence: Synthetic coding sequence
atggccttccagaaggctgtgaagggcaccatcctggtgggcggcggggccctggccaccgtgctgggcctgagccagtttgcccactacagaaggaagcagatgaacctggcctacgtgaaggctgctgactgcatcagcgagcctgtgaaccgggagccccccagccgggaggcccagctgctgaccctgcagaacaccagcgagtttgacatcctggtgattggaggaggagccaccggcagcggctgtgccctggatgctgtgacccggggcctgaagacagccctggtggagagagatgacttcagcagcggcaccagcagctag

SEQ ID NO: 19828 - DNA, 2184 bp, Artificial Sequence; identical to SEQ ID NO: 19823
  Description of Artificial Sequence: Synthetic coding sequence

SEQ ID NO: 19829 - DNA, 1140 bp, Artificial Sequence
  Description of Artificial Sequence: Synthetic coding sequence
atggccttccagaaggctgtgaagggcaccatcctggtgggcggcggggccctggccaccgtgctgggcctgagccagtttgcccactacagaaggaagcagatgaacctggcctacgtgaaggctgctgactgcatcagcgagcctgtgaaccgggagccccccagccgggaggcccagctgctgaccctgcagaacaccagcgagtttgacatcctggtgattggaggaggagccaccggcagcggctgtgccctggatgctgtgacccggggcctgaagacagccctggtggagagagatgacttcagcagcggcaccagcagccgcagcaccaagctgatccacggcggcgtgcgctacctgcagaaggccatcatgaagctggacatcgagcagtacaggatggtgaaggaggccctgcacgagcgggccaacctgctggagatcgccccccacctgagcgcccccctgcccatcatgctgcctgtgtacaagtggtggcagctgccctactactgggtgggcatcaagctgtatgacctggtggccggcagcaactgcctgaagagcagctatgtgctgagcaagagccgggccctggagcacttccccatgctgcagaaggacaagctggtgggcgccatcgtgtactatgatggccagcacaatgatgccaggatgaacctggccatcgccctgacagctgcccgctatggagctgccacagccaactacatggaggtggtgtccctgctgaagaagacagacccccagacaggcaaggtgcgggtgtctggggcccgctgcaaggatgtgctgaccggccaggagtttgatgtgcgggccaagtgtgtgatcaatgccaccggccccttcacagacagcgtgaggaagatggatgacaaggatgctgctgccatctgccagcccagcgctggggtgcacatcgtgatgcctggctactacagccctgagagcatgggcctgctggaccctgccaccagtgatggccgggtcatcttcttcctgccctggcagaagatgaccatcgccggcaccacagacacccccacagatgtgacccaccaccccatccccagcgaggaggacatcaacttcatcctgaatgaggtgtag

SEQ ID NO: 19830 - DNA, 1263 bp, Artificial Sequence
  Description of Artificial Sequence: Synthetic coding sequence
atgagcggccggcccaggaccaccagctttgctgagagctgcaagcctgtgcagcagcccagcgccttcggctccatgaaggtgtcccgggacaaggatggcagcaaggtgaccaccgtggtggccaccccaggccagggccctgaccggccccaggaggtgtcctacacagacaccaaggtgattggaaatggcagctttggagtggtgtaccaggccaagctgtgtgacagcggggagctggtggccatcaagaaggtgctgcaggacaagcgcttcaagaaccgggagctgcagatcatgaggaagctggaccactgcaacatcgtgcggctgcgctacttcttctacagcagtggagagaagaaggatgaggtgtacctgaacctggtgctggactatgtgcctgagaccgtgtacagagtggcccggcactacagccgggccaagcagaccctgcccgtcatctacgtgaagctgtacatgtaccagctgttccgcagcctggcctacatccacagctttggcatctgccaccgggacatcaagccccagaacctgctgctggaccctgacacagctgtgctgaagctgtgtgactttggaagtgccaagcagctggtgcggggggagcccaacgtgtcctacatctgcagccgctactaccgggcccctgagctgatctttggagccacagactacaccagcagcattgatgtgtggagcgctggctgtgtgctggccgagctgctgctgggccagcccatcttccctggggacagcggcgtggaccagctggtggagatcatcaaggtgctgggcacccccacccgggagcagatccgggagatgaaccccaactacacagagttcaagttcccccagatcaaggcccacccctggaccaaggtgttccggcccaggaccccacctgaggccatcgccctgtgcagccggctgctggagtacacccccacagcccggctgacccccctggaggcctgtgcccacagcttctttgatgagctgcgggaccccaacgtgaagctgcccaacggccgggacaccccagccctcttcaacttcaccacccaggagctgagcagcaacccccccctggccaccatcctgatcccccctcatgcccgcatccaggccgccgccagcacccccaccaatgccacagctgccagtgatgccaacacaggagaccggggccagaccaacaatgctgccagcgccagcgccagcaacagcacctag

SEQ ID NO: 19831 - DNA, 1302 bp, Artificial Sequence
  Description of Artificial Sequence: Synthetic coding sequence
atgagcggccggcccaggaccaccagctttgctgagagctgcaagcctgtgcagcagcccagcgccttcggctccatgaaggtgtcccgggacaaggatggcagcaaggtgaccaccgtggtggccaccccaggccagggccctgaccggccccaggaggtgtcctacacagacaccaaggtgattggaaatggcagctttggagtggtgtaccaggccaagctgtgtgacagcggggagctggtggccatcaagaaggtgctgcaggacaagcgcttcaagaaccgggagctgcagatcatgaggaagctggaccactgcaacatcgtgcggctgcgctacttcttctacagcagtggagagaagaaggatgaggtgtacctgaacctggtgctggactatgtgcctgagaccgtgtacagagtggcccggcactacagccgggccaagcagaccctgcccgtcatctacgtgaagctgtacatgtaccagctgttccgcagcctggcctacatccacagctttggcatctgccaccgggacatcaagccccagaacctgctgctggaccctgacacagctgtgctgaagctgtgtgactttggaagtgccaagcagctggtgcggggggagcccaacgtgtcctacatctgcagccgctactaccgggcccctgagctgatctttggagccacagactacaccagcagcattgatgtgtggagcgctggctgtgtgctggccgagctgctgctgggccagcccatcttccctggggacagcggcgtggaccagctggtggagatcatcaaggtgctgggcacccccacccgggagcagatccgggagatgaaccccaactacacagagttcaagttcccccagatcaaggcccacccctggaccaaggacagcagcggcaccggccacttcaccagcggcgtgcgggtcttccggcccaggaccccacctgaggccatcgccctgtgcagccggctgctggagtacacccccacagcccggctgacccccctggaggcctgtgcccacagcttctttgatgagctgcgggaccccaacgtgaagctgcccaacggccgggacaccccagccctcttcaacttcaccacccaggagctgagcagcaacccccccctggccaccatcctgatccccccccacgcccgcatccaggccgccgccagcacccccaccaatgccacagctgccagtgatgccaacacaggagaccggggccagaccaacaatgctgccagcgccagcgccagcaacagcacctag

SEQ ID NO: 19832 - DNA, 315 bp, Artificial Sequence
  Description of Artificial Sequence: Synthetic coding sequence
atgaaccccaactacacagagttcaagttcccccagatcaaggcccacccctggaccaaggtgttccggcccaggaccccacctgaggccatcgccctgtgcagccggctgctggagtacacccccacagcccggctgacccccctggaggcctgtgcccacagcttctttgatgagctgcgggaccccaacgtgaagctgcccaacggccgggacaccccagccctcttcaacttcaccacccaggatgccaacacaggagaccggggccagaccaacaatgctgccagcgccagcgccagcaacagcacctag

SEQ ID NO: 19833 - DNA, 837 bp, Artificial Sequence
  Description of Artificial Sequence: Synthetic coding sequence
atggaggagaacatggaggagggccagacccagaagggctgctttgagtgctgcatcaagtgcctgggcggcatcccctatgccagcctgattgccaccatcctgctgtatgctggggtggccctcttctgtggctgcggccacgaggccctgagcggcaccgtgaacatcctgcagacctactttgagatggccaggacagctggggacaccctggatgtgttcaccatgattgacatcttcaagtatgtgatctacggcattgctgctgccttctttgtgtatggcatcctgctgatggtggagggcttcttcaccactggagccatcaaggacctgtatggagacttcaagatcaccacctgtggccgctgtgtgtctgcctggttcatcatgctgacctacctgttcatgctggcctggctgggcgtgacagccttcaccagcctgcctgtgtacatgtacttcaacctgtggaccatctgcaggaacaccaccctggtggagggcgccaacctgtgcctggacctgcggcagtttggcatcgtgaccatcggggaggagaagaagatctgcaccgtgtctgagaacttcctgaggatgtgtgagagcacagagctgaacatgaccttccacctgttcatcgtggccctggccggggccggggccgccgtcatcgccatggtgcactacctgatggtgctgagcgccaactgggcctacgtgaaggatgcctgcaggatgcagaagtatgaggacatcaagagcaaggaggagcaggagctgcatgacatccacagcaccaggagcaaggagcggctgaatgcctacacctag

SEQ ID NO: 19834 - DNA, 837 bp, Artificial Sequence; identical to SEQ ID NO: 19833
  Description of Artificial Sequence: Synthetic coding sequence

SEQ ID NO: 19835 - DNA, 33 bp, Artificial Sequence; identical to SEQ ID NO: 10859
  Description of Artificial Sequence: Synthetic coding sequence

SEQ ID NO: 19836 - DNA, 804 bp, Artificial Sequence
  Description of Artificial Sequence: Synthetic coding sequence
atgggctgctttgagtgctgcatcaagtgcctgggcggcatcccctatgccagcctcatcgccaccatcctgctgtatgccggcgtggccctcttctgtggctgcggccacgaggccctgtctggaacagtgaacatcctgcagacctactttgagatggccaggacagctggggacaccctggatgtgttcaccatgattgacatcttcaagtatgtgatctatggaattgctgctgccttctttgtgtatggcatcctgctgatggtggagggcttcttcaccaccggggccatcaaggacctgtatggagacttcaagatcaccacctgtggccgctgtgtgtctgcctggttcatcatgctgacctacctgttcatgctggcctggctgggcgtgacagccttcaccagcctgcctgtgtacatgtacttcaacctgtggaccatctgcaggaacaccaccctggtggagggcgccaacctgtgcctggacctgcggcagtttggaattgtgaccatcggggaggagaagaagatctgcaccgtgtctgagaacttcctgaggatgtgtgagagcacagagctgaacatgaccttccacctgttcatcgtggccctggccggggccggggctgctgtgattgccatggtgcactacctgatggtgctgagcgccaactgggcctacgtgaaggatgcctgcaggatgcagaagtatgaggacatcaagagcaaggaggagcaggagctgcatgacatccacagcaccaggagcaaggagcggctgaatgcctacacctag

SEQ ID NO: 19837 - DNA, 390 bp, Artificial Sequence
  Description of Artificial Sequence: Synthetic coding sequence
atggaggagaacatggaggagggccagacccagaagggctgctttgagtgctgcatcaagtgcctgggcggcatcccctatgccagcctgattgccaccatcctgctgtatgctggggtggccctcttctgtggctgcggccacgaggccctgagcggcaccgtgaacatcctgcagacctactttgagatggccaggacagctggggacaccctggatgtgttcaccatgattgacatcttcaagtatgtgatctacggcattgctgctgccttctttgtgtatggcatcctgctgatggtggagggcttcttcaccactggagccatcaaggacctgtatggagacttcaagatcaccacctgtggccgctgtgtgtctgcctggtag

SEQ ID NO: 19838 - DNA, 816 bp, Artificial Sequence
  Description of Artificial Sequence: Synthetic coding sequence
atgacagacctggagggctgctttgagtgctgcatcaagtgcctgggcggcatcccctatgccagcctcatcgccaccatcctgctgtatgccggcgtggccctcttctgtggctgcggccacgaggccctgtctggaacagtgaacatcctgcagacctactttgagatggccaggacagctggggacaccctggatgtgttcaccatgattgacatcttcaagtatgtgatctatggaattgctgctgccttctttgtgtatggcatcctgctgatggtggagggcttcttcaccaccggggccatcaaggacctgtatggagacttcaagatcaccacctgtggccgctgtgtgtctgcctggttcatcatgctgacctacctgttcatgctggcctggctgggcgtgacagccttcaccagcctgcctgtgtacatgtacttcaacctgtggaccatctgcaggaacaccaccctggtggagggcgccaacctgtgcctggacctgcggcagtttggaattgtgaccatcggggaggagaagaagatctgcaccgtgtctgagaacttcctgaggatgtgtgagagcacagagctgaacatgaccttccacctgttcatcgtggccctggccggggccggggctgctgtgattgccatggtgcactacctgatggtgctgagcgccaactgggcctacgtgaaggatgcctgcaggatgcagaagtatgaggacatcaagagcaaggaggagcaggagctgcatgacatccacagcaccaggagcaaggagcggctgaatgcctacacctag

SEQ ID NO: 19839 - DNA, 1206 bp, Artificial Sequence
  Description of Artificial Sequence: Synthetic coding sequence
atgatgggcctgggcaatggccgccgctccatgaagagcccccccctggtgctggccgccctggtggcctgcatcatcgtgctgggcttcaactactggatcgccagcagccgctctgtggacctgcagacccgcatcatggagctggagggccgggtgcggcgggctgctgctgagagaggagctgtggagctgaagaagaatgagttccagggcgagctggagaagcagcgggagcagctggacaagatccagagcagccacaacttccagctggagagcgtgaacaagctgtaccaggatgagaaggctgtgctggtgaacaacatcaccaccggggagcggctcatccgggtgctgcaggaccagctgaagaccctgcagagaaattatggccgcctgcagcaggatgtgctgcagttccagaagaaccagaccaacctggagaggaagttctcctatgacctgagccagtgcatcaaccagatgaaggaggtgaaggagcagtgtgaggagcgcatcgaggaggtgaccaagaagggaaatgaggccgtggccagccgggacctgtctgagaacaatgaccagaggcagcagctgcaggccctgtctgagccccagccccggctgcaggccgccggcctgccccacacagaggtgccccagggcaaaggaaatgtgctgggcaacagcaagagccagaccccagcccccagcagcgaggtggtgctggacagcaagaggcaggtggagaaggaggagaccaatgagatccaggtggtgaatgaggagccccagagggaccggctgccccaggagcccggccgggagcaggtggtggaggacaggcctgtgggcggccggggctttggaggagctggggagctgggccagaccccccaggtgcaggccgccctgtctgtgtcccaggagaaccctgagatggagggccctgagcgggaccagctggtgatcccagatggccaggaggaggagcaggaggccgccggggagggcaggaaccagcagaagctgcggggggaggatgactacaacatggatgaaaatgaggccgagagcgagacagacaagcaggccgccctggccggaaatgacagaaatattgatgtgttcaacgtggaggaccagaagagggacaccatcaacctgctggaccagcgggagaagaggaaccacaccctgtag

SEQ ID NO: 19840 - DNA, 1206 bp, Artificial Sequence; identical to SEQ ID NO: 19839
  Description of Artificial Sequence: Synthetic coding sequence

SEQ ID NO: 19841 - DNA, 243 bp, Artificial Sequence
  Description of Artificial Sequence: Synthetic coding sequence
atgatgggcctgggcaatggccgccgctccatgaagagcccccccctggtgctggccgccctggtggcctgcatcatcgtgctgggcttcaactactggatcgccagcagccgctctgtggacctgcagacccgcatcatggagctggagggccgggtgcggcgggctgctgctgagagaggagctgtggagctgaagaagaatgagttccagggcgagctggagaagcagcgggagcagtag

SEQ ID NO: 19842 - DNA, 366 bp, Artificial Sequence
  Description of Artificial Sequence: Synthetic coding sequence
atgatgggcctgggcaatggccgccgctccatgaagagcccccccctggtgctggccgccctggtggcctgcatcatcgtgctgggcttcaactactggatcgccagcagccgctctgtggacctgcagacccgcatcatggagctggagggccgggtgcggcgggctgctgctgagagaggagctgtggagctgaagaagaatgagttccagggcgagctggagaagcagcgggagcagctggacaagatccagagcagccacaacttccagctggagagcgtgaacaagctgtaccaggatgagaaggctgtgctggtgaacaacatcaccaccggggagcggctcatccgggtgctgcagtag

SEQ ID NO: 19843 - DNA, 279 bp, Artificial Sequence
  Description of Artificial Sequence: Synthetic coding sequence
atgaagcccatccagaagctgctggccggcctcatcctgctgacctggtgtgtggagggctgcagcagccagcactggagctatggcctgcggcctgggggcaagagagatgctgagaacctgattgacagcttccaggagatcgtgaaggaggtgggccagctggccgagacccagagatttgagtgcaccacccaccagcccaggagccccctgcgggacctgaagggggccctggagagcctgattgaggaggagaccggccagaagaagatctag

SEQ ID NO: 19844 - DNA, 279 bp, Artificial Sequence; identical to SEQ ID NO: 19843
  Description of Artificial Sequence: Synthetic coding sequence

SEQ ID NO: 19845 - DNA, 774 bp, Artificial Sequence
  Description of Artificial Sequence: Synthetic coding sequence
atgcctgcctccatgttcagcattgacaacatcctggccgcccggccccgctgcaaggacagcgtgctgcctgtggcccacagcgctgctgcccctgtggtgtttcctgccctgcatggagacagcctgtatggagccagcggcggggccagcagtgactatggagccttctaccccaggcctgtggcccctgggggcgccggcctgcctgctgctgtgtctggcagccggctgggctacaacaactacttctacggccagctgcacgtgcaggccgcccctgtgggccctgcctgctgcggggctgtgccccccctgggcgcccagcagtgcagctgtgtgcccaccccacctggctatgagggccctggctctgtgctggtgtcccctgtgccccaccagatgctgccctacatgaatgtgggcaccctgagcaggacagagctgcagctgctgaaccagctgcactgcaggaggaagagaagacacaggaccatcttcacagatgagcagctggaggccctggagaacctcttccaggagaccaagtacccagatgtgggcacccgggagcagctggccaggaaggtgcacctgcgggaggagaaggtggaggtgtggttcaagaacagaagagccaagtggaggcggcagaagaggagcagcagcgaggagagtgaaaatgctgagaagtggaacaagaccagcagcagcaaggccagccctgagaagcgggaggaggagggcaagagtgacctggacagcgacagctag

SEQ ID NO: 19846 - DNA, 654 bp, Artificial Sequence
  Description of Artificial Sequence: Synthetic coding sequence
atggcctacccaggctacggcggcggcttcggcaacttcagcatccaggtgcccggcatgcagatgggccagcctgtgcctgagactggacctgccatcctgctggatggctacagcggccctgcctacagcgacacctacagcagcgctggggacagcgtgtacacctacttctctgctgtggccggccaggatggagaggtggatgctgaggagctgcagcgctgcctgacccagagcggcatcaatggcacctacagccccttcagcctggagacctgccgcatcatgattgccatgctggaccgggaccacacaggcaagatgggcttcaatgccttcaaggagctgtgggccgccctgaatgcctggaaggagaacttcatgacagtggaccaggacggcagcggcaccgtggagcaccacgagctgcggcaggccatcggcctgatgggctaccgcctgagcccccagaccctgaccaccatcgtgaagcgctacagcaagaatggccgcatcttctttgatgattatgtggcctgctgcgtgaagctgcgggccctgacagacttcttcaggaagagggaccacctgcagcagggcagcgccaacttcatctatgatgacttcctgcagggcaccatggccatctag

SEQ ID NO: 19847 - DNA, 438 bp, Artificial Sequence
  Description of Artificial Sequence: Synthetic coding sequence
atggccacctgggccctgctgctgctggccgccatgctgctgggcaaccctggcctggtgttcagccggctgagccctgagtactatgacctggcccgggcccacctgagagatgaggagaagagctgcccctgcctggcccaggagggcccccagggcgacctgctgaccaagacccaggagctgggccgggactaccgcacctgcctgaccatcgtgcagaagctgaagaagatggtggacaagcccacccagaggtctgtgtccaatgctgccaccagggtgtgcaggacaggccgcagccgctggagagatgtgtgcaggaacttcatgaggcgctaccagagccgggtgacccagggcctggtggccggggagacagcccagcagatctgtgaggacctgcggctgtgcatccccagcacaggccccctgtag

SEQ ID NO: 19848 - DNA, 393 bp, Artificial Sequence
  Description of Artificial Sequence: Synthetic coding sequence
atggagggcctggtgttcagccggctgagccctgagtactatgacctggcccgggcccacctgagagatgaggagaagagctgcccctgcctggcccaggagggcccccagggcgacctgctgaccaagacccaggagctgggccgggactaccgcacctgcctgaccatcgtgcagaagctgaagaagatggtggacaagcccacccagaggtctgtgtccaatgctgccaccagggtgtgcaggacaggccgcagccgctggagagatgtgtgcaggaacttcatgaggcgctaccagagccgggtgacccagggcctggtggccggggagacagcccagcagatctgtgaggacctgcggctgtgcatccccagcacaggccccctgtag

SEQ ID NO: 19849 - DNA, 555 bp, Artificial Sequence
  Description of Artificial Sequence: Synthetic coding sequence
atgagcaggacagcctacacagtgggcgccctgctgctgctgctgggcaccctgctgcctgctgctgagggcaagaagaagggcagccagggcgccatccccccaccagacaaggcccagcacaatgacagcgagcagacccagagcccccagcagcccggcagcaggaacagaggccggggccagggccggggcacagccatgcctggagaggaggtgctggagagcagccaggaggccctgcacgtgacagagaggaagtacctgaagagggactggtgcaagacccagcccctgaagcagaccatccacgaggagggctgcaacagcaggaccatcatcaaccgcttctgctacggccagtgcaacagcttctacatccccaggcacatcaggaaggaggagggcagcttccagagctgcagcttctgcaagcccaagaagttcaccaccatgatggtgaccctgaactgcccagagctgcagccccccaccaagaagaagagggtgaccagggtgaagcagtgccgctgcatcagcattgacctggactag

SEQ ID NO: 19850 - DNA, 432 bp, Artificial Sequence
  Description of Artificial Sequence: Synthetic coding sequence
atgagcaggacagcctacacagtgggcgccctgctgctgctgctgggcaccctgctgcctgctgctgagggcaagaagaagggcagccagggcgccatccccccaccagacaaggccctgcacgtgacagagaggaagtacctgaagagggactggtgcaagacccagcccctgaagcagaccatccacgaggagggctgcaacagcaggaccatcatcaaccgcttctgctacggccagtgcaacagcttctacatccccaggcacatcaggaaggaggagggcagcttccagagctgcagcttctgcaagcccaagaagttcaccaccatgatggtgaccctgaactgcccagagctgcagccccccaccaagaagaagagggtgaccagggtgaagcagtgccgctgcatcagcattgacctggactag

SEQ ID NO: 19851 - DNA, 432 bp, Artificial Sequence; identical to SEQ ID NO: 19850
  Description of Artificial Sequence: Synthetic coding sequence

SEQ ID NO: 19852 - DNA, 396 bp, Artificial Sequence
  Description of Artificial Sequence: Synthetic coding sequence
atgaccctggaggagttctctgctggggagcagaagacagaaagtgaccctgacaacgtggtgctgtgcctgctggccgcagatgaagatgatgacagagatgtggccctgcagatccacttcaccctcatccaggccttctgctgtgaaaatgacatcaacatcctgcgggtgagcaaccctggccgcctggccgagctgctgctgctggagacagatgctggccctgctgccagcgagggcgctgagcagcccccagacctgcactgtgtgctggtgaccaacccccacagcagccagtggaaggaccctgccctgagccagctgatctgcttctgccgggagagccgctacatggaccagtgggtgcctgtgatcaacctgcctgagaggtag

SEQ ID NO: 19853 - DNA, 498 bp, Artificial Sequence
  Description of Artificial Sequence: Synthetic coding sequence
atgaccctggaggagttctctgctggggagcagaagacagagaggatggacaaggtgggagatgccctggaggaggtgctgagcaaggccctgagccagaggaccatcaccgtgggcgtgtatgaagctgccaagctgctgaatgtggaccctgacaacgtggtgctgtgcctgctggccgcagatgaagatgatgacagagatgtggccctgcagatccacttcaccctcatccaggccttctgctgtgaaaatgacatcaacatcctgcgggtgagcaaccctggccgcctggccgagctgctgctgctggagacagatgctggccctgctgccagcgagggcgctgagcagcccccagacctgcactgtgtgctggtgaccaacccccacagcagccagtggaaggaccctgccctgagccagctgatctgcttctgccgggagagccgctacatggaccagtgggtgcctgtgatcaacctgcctgagaggtag

SEQ ID NO: 19854 - DNA, 3693 bp, Artificial Sequence
  Description of Artificial Sequence: Synthetic coding sequence
atgtctgccctgtgctggggccgcggggctgctggcctgaagagggccctgcggccctgtggccggcccggcctgcccgggaaggagggcacagctgggggcgtgtgtggccccaggaggagcagcagcgccagcccccaggagcaggaccaggacaggaggaaggactggggccacgtggagctgctggaggtgctgcaggcccgggtgcggcagctgcaggccgagagcgtgtctgaggtggtggtgaacagagtggatgtggcccggctgcctgaatgtggcagcggagatggcagcctgcagccccccaggaaggtgcagatgggcgccaaggatgccacccctgtgccctgtggccgctgggccaagatcctggagaaggacaagaggacccagcagatgaggatgcagaggctgaaggccaagctgcagatgcccttccagagcggggagttcaaggccctgacccggcggctgcaggtggagccccggctgctgagcaagcagatggccggctgcctggaggactgcacccggcaggcccctgagagcccctgggaggagcagctggcccggctgctgcaggaggcccctgggaagctgagcctggatgtggagcaggcccccagcggccagcacagccaggcccagctgagcggccagcagcagaggctgctggccttcttcaagtgctgcctgctgacagaccagctgcccctggcccaccacctgctggtggtgcaccacggccagaggcagaagaggaagctgctgaccctggacatgtacaatgctgtgatgctgggctgggcccggcagggcgccttcaaggagctggtgtatgtgctcttcatggtgaaggatgctggcctgaccccagacctgctgtcctatgctgctgccctgcagtgcatgggccggcaggaccaggatgctggcaccatcgagcgctgcctggagcagatgagccaggagggcctgaagctgcaggccctcttcaccgctgtgctgctgtctgaggaggaccgggccaccgtgctgaaggctgtgcacaaggtgaagcccaccttcagcctgcccccccagctgcccccacctgtgaacaccagcaagctgctgagagatgtgtatgccaaggatggccgggtgtcctaccccaagctgcacctgcccctgaagaccctgcagtgcctgtttgagaagcagctgcacatggagctggccagccgggtgtgtgtggtgtctgtggagaagcccaccctgcccagcaaggaggtgaagcacgccaggaagaccctgaagaccctgcgggaccagtgggagaaggccctgtgccgggccctgcgggagaccaagaaccggctggagcgggaggtgtatgagggccgcttcagcctgtaccccttcctgtgcctgctggatgagcgggaggtggtgaggatgctgctgcaggtgctgcaggccctgcctgcccagggcgagagcttcaccaccctggcccgggagctgagcgcccggaccttcagccgccacgtggtgcagaggcagagggtgtctggccaggtgcaggccctgcagaaccactacaggaagtacctgtgcctgctggccagtgatgctgaggtgcctgagccctgcctgccccggcagtactgggaggagctgggcgcccctgaggccctgcgggagcagccctggcccctgcctgtgcagatggagctgggcaagctgctggccgagatgctggtgcaggccacccagatgccctgcagcctggacaagccccacaggagcagccggctggtgcctgtgctgtaccacgtgtacagcttcagaaatgtgcagcagatcggcatcctgaagccccacccagcctacgtgcagctgctggagaaggctgctgagcccaccctgacctttgaagctgtggatgtgcccatgctgtgcccccccctgccctggaccagcccccacagcggggccttcctgctgagccccaccaagctgatgaggacagtggagggcgccacccagcaccaggagctgctggagacctgccccccaacagccctgcatggagccctggatgccctgacccagctgggcaactgtgcctggagggtgaatggccgggtgctggacctggtgctgcagctgttccaggccaagggctgcccccagctgggcgtgcctgccccacccagcgaggccccccagcccccagaggcccacctgccccacagcgctgccccagccaggaaggccgagctgcggcgggagctggcccactgccagaaggtggcccgggagatgcacagcctgcgggcagaggccctgtaccgcctgagcctggcccagcacctgcgggacagagtcttctggctgccccacaacatggacttccggggccgcacctacccctgccccccccacttcaaccacctgggcagtgatgtggcccgggccctgctggagtttgcccagggccggcccctgggcccccacggcctggactggctgaagatccacctggtgaacctgaccggcctgaagaagcgggagcccctgaggaagaggctggcctttgctgaggaggtgatggatgacatcctggacagcgctgaccagcccctgaccggcaggaagtggtggatgggcgctgaggagccctggcagaccctggcctgctgcatggaggtggccaatgctgtgcgggccagtgaccctgctgcctacgtgagccacctgcctgtgcaccaggacggcagctgcaatggcctgcagcactacgccgccctgggccgggacagcgtgggcgccgcctctgtgaacctggagcccagtgatgtgccccaggatgtgtacagcggcgtggccgcccaggtggaggtgttccggcggcaggatgcccagaggggcatgagggtggcccaggtgctggagggcttcatcaccaggaaggtggtgaagcagacagtgatgacagtggtgtatggagtgaccaggtatggaggccgcctgcagatcgagaagaggctgcgggagctgagtgacttcccccaggagtttgtgtgggaggccagccactacctggtgcggcaggtgttcaagagcctgcaggagatgttttctggcacccgggccatccagcactggctgacagaaagtgcccggctcatcagccacatgggctctgtggtggagtgggtgacccccctgggcgtgcctgtgatccagccctaccgcctggacagcaaggtgaagcagattggaggcggcatccagagcatcacctacacccacaatggagacatcagcaggaagcccaacaccaggaagcagaagaatggcttcccccccaacttcatccacagcctggacagcagccacatgatgctgacagccctgcactgctacaggaagggcctgacctttgtgtctgtgcatgactgctactggacccatgctgctgatgtgtctgtgatgaaccaggtgtgccgggagcagtttgtgcggctgcacagcgagcccatcctgcaggacctgagccgcttcctggtgaagcgcttctgcagcgagccccagaagatcctggaggccagccagctgaaggagaccctgcaggccgtgcccaagccaggggcctttgacctggagcaggtgaagaggagcacctacttcttctcctag

SEQ ID NO: 19855 - DNA, 480 bp, Artificial Sequence
  Description of Artificial Sequence: Synthetic coding sequence
atgaccctggaggaggtgcggggccaggacacagtgcctgagagcacagccaggatgcagggcgctgggaaggccctgcacgagctgctgctgagcgcccagaggcagggctgcctgacagctggggtgtatgagagcgccaaggtgctgaatgtggaccctgacaacgtgaccttctgtgtgctggccgccggggaggaggatgaaggagacatcgccctgcagatccacttcaccctcatccaggccttctgctgtgaaaatgacatcgacatcgtgcgggtgggagatgtgcagaggctggccgccatcgtgggcgctggggaggaggccggggcccctggggacctgcactgcatcctgatcagcaaccccaatgaagatgcctggaaggaccctgccctggagaagctgagcctcttctgtgaggagagccgctctgtgaatgactgggtgcccagcatcaccctgcctgagtag

SEQ ID NO: 19856 - DNA, 426 bp, Artificial Sequence
  Description of Artificial Sequence: Synthetic coding sequence
atgcagggcgctgggaaggccctgcacgagctgctgctgagcgcccagaggcagggctgcctgacagctggggtgtatgagagcgccaaggtgctgaatgtggaccctgacaacgtgaccttctgtgtgctggccgccggggaggaggatgaaggagacatcgccctgcagatccacttcaccctcatccaggccttctgctgtgaaaatgacatcgacatcgtgcgggtgggagatgtgcagaggctggccgccatcgtgggcgctggggaggaggccggggcccctggggacctgcactgcatcctgatcagcaaccccaatgaagatgcctggaaggaccctgccctggagaagctgagcctcttctgtgaggagagccgctctgtgaatgactgggtgcccagcatcaccctgcctgagtag

SEQ ID NO: 19857 - DNA, 2085 bp, Artificial Sequence
  Description of Artificial Sequence: Synthetic coding sequence
atgcagcctgccatccaggtgtggtttggagaggacctgcccctgagccccaggagccccctgacccccaggcatggccctggcctggccaacgtgtgccagtatgatgagtggattgctgtgagacatgaggccaccctgctgcccatgcaggaggacctgagcatctggctgagcggcctgctgggcatcaaggtgaaggccgagaagctgctggaggagctggacaatggagtgctgctgtgccagctgattgatgtgctgcagaacatggtgaagacctgcaacagcgaggagagcggcaacttccccatgaggaaggtgccctgcaagaaggatgctgccagcggcagcttctttgcccgggacaacacagccaacttcctgcactggtgccgggacattggagtggatgagacctacctgtttgaaagtgagggcctggtgctgcacaaggacccccggcaggtgtacctgtgcctgctggagatcggcagaattgtgagccgctatggagtggagccccctgtgctggtgaagctggagaaggagattgagctggaggagaccctgctgaacaccagcggccctgaggacagcatcagcatccccaagagctgctgcagacatgaggagctgcacgaggccgtgaagcacatcgccgaggaccccccctgcagctgcagccaccgcttcagcattgagtacctgtctgagggccgctaccgcctgggggacaagatcctcttcatccgcatgctgcacggcaagcacgtgatggtgcgggtgggcggcggctgggacaccctgcagggcttcctgctgaagtatgacccctgccgcatcctgcagtttgccaccctggagcagaagatcctggccttccagaagggcgtgtccaatgaatctgtgcctgacagccctgcccggaccccccagcccccagagatgaaccccctgtctgctgtgaacatgttccagaagcagaacagcaagcccagcgtgcctgtgtccatccccaagagcaaggagaagcagggccggcccccaggggccctggtgcctgccagcagcctgaagggcggcaacctgggctccatgtctgtgcgcagcaagctgcccaacagccctgctgccagcagccaccccaagctgaagagcagcaagggcatcaccaagaagccccaggcccccagcaacaatgccagcagcagcctggccagcctgaaccctgtgggcaagaacaccagcagccctgccctgcccaggacagccccctgcatcagcgagagccccaggaagtgcatcagcagccccaacacccccaaggccaaggtgatcccagcccagaacagcgctgacctgcctgagagcaccctgctgcccaacaagtgcagcggcaagacccagcccaagtacctgaagcacaaccacatcagcagccgggacaatgctgtgagccacctggccgcccacagcaacagcagcagcaagtgccccaagctgcccaaggccaacatccctgtgcggcccaagcccagcttccagagcagcgccaagatgaccaagaccagcagcaagaccatcgccaccggcctgggcacccagagccagcccagtgatggagccccccaggccaagcctgtgcctgcccagaagctgaagagcgccctgaacctgaaccagcctgtgtctgtgtcctctgtgtcccctgtgaaggccacccagaagagcaaggacaagaacatcgtgtctgccaccaagaagcagccccagaacaagagcgccttccagaagacaggccccagcagcctgaagagccctggccgcacccccctgagcatcgtgtccctgccccagagcagcaccaagacccagacagcccccaagagcgcccagacagtggccaagagccagcacagcaccaagggccccccaagaagtggcaagaccccagccagcatcaggaagccacccagctctgtgaaggatgctgacagcggggacaagaagcccacagccaagaagaaggaggatgatgaccactactttgtgatgacaggcagcaagaagcccaggaagtag

SEQ ID NO: 19858 - DNA, 2085 bp, Artificial Sequence; identical to SEQ ID NO: 19857
  Description of Artificial Sequence: Synthetic coding sequence

SEQ ID NO: 19859 - DNA, 2085 bp, Artificial Sequence; identical to SEQ ID NO: 19857
  Description of Artificial Sequence: Synthetic coding sequence

SEQ ID NO: 19860 - DNA, 150 bp, Artificial Sequence
  Description of Artificial Sequence: Synthetic coding sequence
atgcagcctgccatccaggtgtggtttggagaggacctgcccctgagccccaggagccccctgacccccaggcatggccctggcctggccaacgtgtgccagtatgatgagtggattgctgtgagacatgaggccaccctgctgccctag

SEQ ID NO: 19861 - DNA, 1611 bp, Artificial Sequence
  Description of Artificial Sequence: Synthetic coding sequence
atgaatgccagcctggagagcctgtacagcgcctgcagcatgcagagcgacacagtgcccctgctgcagaatggccagcacgcccggagccagccccgggccagcggccccccaagaagcatccagccccaggtgagcccccggcagagggtgcagaggagccagcctgtgcacatcctggccgtgcggcggctgcaggaggaggaccagcagttccgcaccagcagcctgcctgccatccccaaccccttccctgagctgtgtggccctggcagcccccctgtgctgaccccaggcagcctgccccccagccaggccgccgccaagcaggatgtgaaggtgttttctgaagatggcaccagcaaggtggtggagatcctggccgacatgacagcccgggacctgtgccagctgctggtgtacaagagccactgtgtggatgacaacagctggaccctggtggagcaccacccccacctgggcctggagcgctgcctggaggaccacgagctggtggtgcaggtggagagcaccatggccagcgagagcaagttcctgttcaggaagaactatgccaagtatgagttcttcaagaaccccatgaacttcttccctgagcagatggtgacctggtgccagcagagcaatggcagccagacccagctgctgcagaacttcctgaacagcagcagctgcccagagatccagggcttcctgcacgtgaaggagctgggcaagaagtcctggaagaagctgtatgtgtgcctgcggcgcagcggcctgtactgcagcaccaagggcaccagcaaggagcccaggcacctgcagctgctggccgacctggaggacagcaacatcttcagcctgattgctggcaggaagcagtacaatgcccccacagaccacggcctgtgcatcaagcccaacaaggtgagaaatgagaccaaggagctgcggctgctgtgtgccgaggatgagcagaccaggacctgctggatgacagccttccggctgctgaagtatggcatgctgctgtaccagaactaccgcatcccccagcagaggaaggccctgctgagccccttcagcacccctgtgcgctctgtgtctgagaacagcctggtggccatggacttcagcggccagacaggccgggtgattgagaacccagctgaggcccagagcgctgccctggaggagggccacgcctggaggaagaggagcaccaggatgaacatcctgggcagccagagccccctgcaccccagcaccctgagcaccgtcatccacaggacccagcactggttccacggccgcatcagccgggaggagagccaccgcatcatcaagcagcagggcctggtggatggcctcttcctgctgcgggacagccagagcaaccccaaggcctttgtgctgaccctgtgccaccaccagaagatcaagaacttccagatcctgccctgtgaagatgatggccagaccttcttcagcctggatgatggcaacaccaagttcagtgacctgatccagctggtggacttctaccagctgaacaagggcgtgctgccctgcaagctgaagcaccactgcatccgggtggccctgtag

SEQ ID NO: 19862 - DNA, 1647 bp, Artificial Sequence
  Description of Artificial Sequence: Synthetic coding sequence
atggccctggccggctgcccagacagcttcctgcaccacccctactaccaggacaaggtggagcagacccccaggagccagcaggaccctgctggccctggcctgcctgcccagagcgaccggctggccaaccaccaggaggatgatgtggacctggaggccctggtgaatgacatgaatgccagcctggagagcctgtacagcgcctgcagcatgcagagcgacacagtgcccctgctgcagaatggccagcacgcccggagccagccccgggccagcggccccccaagaagcatccagccccaggtgagcccccggcagagggtgcagaggagccagcctgtgcacatcctggccgtgcggcggctgcaggaggaggaccagcagttccgcaccagcagcctgcctgccatccccaaccccttccctgagctgtgtggccctggcagcccccctgtgctgaccccaggcagcctgccccccagccaggccgccgccaagcaggatgtgaaggtgttttctgaagatggcaccagcaaggtggtggagatcctggccgacatgacagcccgggacctgtgccagctgctggtgtacaagagccactgtgtggatgacaacagctggaccctggtggagcaccacccccacctgggcctggagcgctgcctggaggaccacgagctggtggtgcaggtggagagcaccatggccagcgagagcaagttcctgttcaggaagaactatgccaagtatgagttcttcaagaaccccatgaacttcttccctgagcagatggtgacctggtgccagcagagcaatggcagccagacccagctgctgcaggagcccaggcacctgcagctgctggccgacctggaggacagcaacatcttcagcctgattgctggcaggaagcagtacaatgcccccacagaccacggcctgtgcatcaagcccaacaaggtgagaaatgagaccaaggagctgcggctgctgtgtgccgaggatgagcagaccaggacctgctggatgacagccttccggctgctgaagtatggcatgctgctgtaccagaactaccgcatcccccagcagaggaaggccctgctgagccccttcagcacccctgtgcgctctgtgtctgagaacagcctggtggccatggacttcagcggccagacaggccgggtgattgagaacccagctgaggcccagagcgctgccctggaggagggccacgcctggaggaagaggagcaccaggatgaacatcctgggcagccagagccccctgcaccccagcaccctgagcaccgtcatccacaggacccagcactggttccacggccgcatcagccgggaggagagccaccgcatcatcaagcagcagggcctggtggatggcctcttcctgctgcgggacagccagagcaaccccaaggcctttgtgctgaccctgtgccaccaccagaagatcaagaacttccagatcctgccctgtgaagatgatggccagaccttcttcagcctggatgatggcaacaccaagttcagtgacctgatccagctggtggacttctaccagctgaacaagggcgtgctgccctgcaagctgaagcaccactgcatccgggtggccctgtag

SEQ ID NO: 19863 - DNA, 381 bp, Artificial Sequence
  Description of Artificial Sequence: Synthetic coding sequence
atgaacatcctgggcagccagagccccctgcaccccagcaccctgagcaccgtcatccacaggacccagcactggttccacggccgcatcagccgggaggagagccaccgcatcatcaagcagcagggcctggtggatggcctcttcctgctgcgggacagccagagcaaccccaaggcctttgtgctgaccctgtgccaccaccagaagatcaagaacttccagatcctgccctgtgaagatgatggccagaccttcttcagcctggatgatggcaacaccaagttcagtgacctgatccagctggtggacttctaccagctgaacaagggcgtgctgccctgcaagctgaagcaccactgcatccgggtggccctgtag

SEQ ID NO: 19864 - DNA, 1611 bp, Artificial Sequence; identical to SEQ ID NO: 19861
  Description of Artificial Sequence: Synthetic coding sequence

SEQ ID NO: 19865 - DNA, 1785 bp, Artificial Sequence
  Description of Artificial Sequence: Synthetic coding sequence
atggccctggccggctgcccagacagcttcctgcaccacccctactaccaggacaaggtggagcagacccccaggagccagcaggaccctgctggccctggcctgcctgcccagagcgaccggctggccaaccaccaggaggatgatgtggacctggaggccctggtgaatgacatgaatgccagcctggagagcctgtacagcgcctgcagcatgcagagcgacacagtgcccctgctgcagaatggccagcacgcccggagccagccccgggccagcggccccccaagaagcatccagccccaggtgagcccccggcagagggtgcagaggagccagcctgtgcacatcctggccgtgcggcggctgcaggaggaggaccagcagttccgcaccagcagcctgcctgccatccccaaccccttccctgagctgtgtggccctggcagcccccctgtgctgaccccaggcagcctgccccccagccaggccgccgccaagcaggatgtgaaggtgttttctgaagatggcaccagcaaggtggtggagatcctggccgacatgacagcccgggacctgtgccagctgctggtgtacaagagccactgtgtggatgacaacagctggaccctggtggagcaccacccccacctgggcctggagcgctgcctggaggaccacgagctggtggtgcaggtggagagcaccatggccagcgagagcaagttcctgttcaggaagaactatgccaagtatgagttcttcaagaaccccatgaacttcttccctgagcagatggtgacctggtgccagcagagcaatggcagccagacccagctgctgcagaacttcctgaacagcagcagctgcccagagatccagggcttcctgcacgtgaaggagctgggcaagaagtcctggaagaagctgtatgtgtgcctgcggcgcagcggcctgtactgcagcaccaagggcaccagcaaggagcccaggcacctgcagctgctggccgacctggaggacagcaacatcttcagcctgattgctggcaggaagcagtacaatgcccccacagaccacggcctgtgcatcaagcccaacaaggtgagaaatgagaccaaggagctgcggctgctgtgtgccgaggatgagcagaccaggacctgctggatgacagccttccggctgctgaagtatggcatgctgctgtaccagaactaccgcatcccccagcagaggaaggccctgctgagccccttcagcacccctgtgcgctctgtgtctgagaacagcctggtggccatggacttcagcggccagacaggccgggtgattgagaacccagctgaggcccagagcgctgccctggaggagggccacgcctggaggaagaggagcaccaggatgaacatcctgggcagccagagccccctgcaccccagcaccctgagcaccgtcatccacaggacccagcactggttccacggccgcatcagccgggaggagagccaccgcatcatcaagcagcagggcctggtggatggcctcttcctgctgcgggacagccagagcaaccccaaggcctttgtgctgaccctgtgccaccaccagaagatcaagaacttccagatcctgccctgtgaagatgatggccagaccttcttcagcctggatgatggcaacaccaagttcagtgacctgatccagctggtggacttctaccagctgaacaagggcgtgctgccctgcaagctgaagcaccactgcatccgggtggccctgtag

SEQ ID NO: 19866 - DNA, 1785 bp, Artificial Sequence; identical to SEQ ID NO: 19865
  Description of Artificial Sequence: Synthetic coding sequence

SEQ ID NO: 19867 - DNA, 1611 bp, Artificial Sequence; identical to SEQ ID NO: 19861
  Description of Artificial Sequence: Synthetic coding sequence

SEQ ID NO: 19868 - DNA, 1611 bp, Artificial Sequence; identical to SEQ ID NO: 19861
  Description of Artificial Sequence: Synthetic coding sequence

SEQ ID NO: 19869 - DNA, 1767 bp, Artificial Sequence
  Description of Artificial Sequence: Synthetic coding sequence
atgcaggccgccggccccctcttccgcagcaaggacaaggtggagcagacccccaggagccagcaggaccctgctggccctggcctgcctgcccagagcgaccggctggccaaccaccaggaggatgatgtggacctggaggccctggtgaatgacatgaatgccagcctggagagcctgtacagcgcctgcagcatgcagagcgacacagtgcccctgctgcagaatggccagcacgcccggagccagccccgggccagcggccccccaagaagcatccagccccaggtgagcccccggcagagggtgcagaggagccagcctgtgcacatcctggccgtgcggcggctgcaggaggaggaccagcagttccgcaccagcagcctgcctgccatccccaaccccttccctgagctgtgtggccctggcagcccccctgtgctgaccccaggcagcctgccccccagccaggccgccgccaagcaggatgtgaaggtgttttctgaagatggcaccagcaaggtggtggagatcctggccgacatgacagcccgggacctgtgccagctgctggtgtacaagagccactgtgtggatgacaacagctggaccctggtggagcaccacccccacctgggcctggagcgctgcctggaggaccacgagctggtggtgcaggtggagagcaccatggccagcgagagcaagttcctgttcaggaagaactatgccaagtatgagttcttcaagaaccccatgaacttcttccctgagcagatggtgacctggtgccagcagagcaatggcagccagacccagctgctgcagaacttcctgaacagcagcagctgcccagagatccagggcttcctgcacgtgaaggagctgggcaagaagtcctggaagaagctgtatgtgtgcctgcggcgcagcggcctgtactgcagcaccaagggcaccagcaaggagcccaggcacctgcagctgctggccgacctggaggacagcaacatcttcagcctgattgctggcaggaagcagtacaatgcccccacagaccacggcctgtgcatcaagcccaacaaggtgagaaatgagaccaaggagctgcggctgctgtgtgccgaggatgagcagaccaggacctgctggatgacagccttccggctgctgaagtatggcatgctgctgtaccagaactaccgcatcccccagcagaggaaggccctgctgagccccttcagcacccctgtgcgctctgtgtctgagaacagcctggtggccatggacttcagcggccagacaggccgggtgattgagaacccagctgaggcccagagcgctgccctggaggagggccacgcctggaggaagaggagcaccaggatgaacatcctgggcagccagagccccctgcaccccagcaccctgagcaccgtcatccacaggacccagcactggttccacggccgcatcagccgggaggagagccaccgcatcatcaagcagcagggcctggtggatggcctcttcctgctgcgggacagccagagcaaccccaaggcctttgtgctgaccctgtgccaccaccagaagatcaagaacttccagatcctgccctgtgaagatgatggccagaccttcttcagcctggatgatggcaacaccaagttcagtgacctgatccagctggtggacttctaccagctgaacaagggcgtgctgccctgcaagctgaagcaccactgcatccgggtggccctgtag

SEQ ID NO: 19870 - DNA, 1611 bp, Artificial Sequence; identical to SEQ ID NO: 19861
  Description of Artificial Sequence: Synthetic coding sequence

SEQ ID NO: 19871 - DNA, 1611 bp, Artificial Sequence; identical to SEQ ID NO: 19861
  Description of Artificial Sequence: Synthetic coding sequence

SEQ ID NO: 19872 - DNA, 345 bp, Artificial Sequence
  Description of Artificial Sequence: Synthetic coding sequence
atgcaggccgccggccccctcttccgcagcaaggacaaggtggagcagacccccaggagccagcaggaccctgctggccctggcctgcctgcccagagcgaccggctggccaaccaccaggaggatgatgtggacctggaggccctggtgaatgacatgaatgccagcctggagagcctgtacagcgcctgcagcatgcagagcgacacagtgcccctgctgcagaatggccagcacgcccggagccagccccgggccagcggccccccaagaagcatccagccccaggtgagcccccggcagagggtgcagaggagccagcctgtgcacatcctggccgtgtag

SEQ ID NO: 19873 - DNA, 1767 bp, Artificial Sequence; identical to SEQ ID NO: 19869
  Description of Artificial Sequence: Synthetic coding sequence

SEQ ID NO: 19874 - DNA, 531 bp, Artificial Sequence
  Description of Artificial Sequence: Synthetic coding sequence
atggaggccatcgccaagtatgacttcaaggccacagcagatgatgagctgtccttcaagagaggagacatcctgaaggtgctgaatgaagaatgtgaccagaactggtacaaggccgagctgaatggcaaggatggcttcatccccaagaactacatcgagatgaagccccacccctttggaaatgatgtgcagcacttcaaggtgctgagagatggagctgggaagtacttcctgtgggtggtgaagttcaacagcctgaatgagctggtggactaccacaggagcacctctgtgtccaggaaccagcagatcttcctgcgggacatcgagcaggtgccccagcagcccacctacgtgcaggccctgtttgattttgacccccaggaggatggagagctgggcttcagaagaggagacttcatccacgtgatggacaacagcgaccccaactggtggaagggggcctgccacggccagacaggcatgttccccaggaactacgtgacccctgtgaacagaaatgtgtag

SEQ ID NO: 19875 - DNA, 654 bp, Artificial Sequence
  Description of Artificial Sequence: Synthetic coding sequence
atggaggccatcgccaagtatgacttcaaggccacagcagatgatgagctgtccttcaagagaggagacatcctgaaggtgctgaatgaagaatgtgaccagaactggtacaaggccgagctgaatggcaaggatggcttcatccccaagaactacatcgagatgaagccccacccctggttcttcggcaagatcccccgggccaaggccgaggagatgctgagcaagcagagacatgatggagccttcctgatccgggagagcgagagcgcccctggggacttcagcctgtctgtgaagtttggaaatgatgtgcagcacttcaaggtgctgagagatggagctgggaagtacttcctgtgggtggtgaagttcaacagcctgaatgagctggtggactaccacaggagcacctctgtgtccaggaaccagcagatcttcctgcgggacatcgagcaggtgccccagcagcccacctacgtgcaggccctgtttgattttgacccccaggaggatggagagctgggcttccggcggggggacttcatccacgtgatggacaacagcgaccccaactggtggaagggggcctgccacggccagacaggcatgttccccagaaattatgtgacccctgtgaacagaaatgtgtag

SEQ ID NO: 19876 - DNA, 654 bp, Artificial Sequence; identical to SEQ ID NO: 19875
  Description of Artificial Sequence: Synthetic coding sequence

SEQ ID NO: 19877 - DNA, 654 bp, Artificial Sequence; identical to SEQ ID NO: 19875
  Description of Artificial Sequence: Synthetic coding sequence

SEQ ID NO: 19878 - DNA, 222 bp, Artificial Sequence
  Description of Artificial Sequence: Synthetic coding sequence
atgcctgccctgcacatcgaggacctgcctgagaaggagaagctgaagatggaggtggagcagctgaggaaggaggtgaagctgcagaggcagcaggtgtccaaatgttctgaggagatcaagaactacatcgaggagaggtctggagaggaccccctggtgaagggcatccctgaggacaagaaccccttcaaggagaagggcagctgtgtgatctcctag

SEQ ID NO: 19879 - DNA, 432 bp, Artificial Sequence
  Description of Artificial Sequence: Synthetic coding sequence
atgagcggccggggcaagacaggaggcaaggcccgggccaaggccaagagccgcagcagccgggccggcctgcagtttcctgtgggccgggtgcaccggctgctgaggaagggccactatgcagagcgggtgggcgctggggcccctgtgtacctggccgctgtgctggagtacctgacagctgagatcctggagctggccggaaatgctgcccgggacaacaagaagacccgcatcatccccaggcacctgcagctggccatcagaaatgatgaggagctgaacaagctgctgggcggcgtgaccatcgcccagggcggcgtgctgcccaacatccaggccgtgctgctgcccaagaagaccagcgccaccgtgggccccaaggcccccagcggcggcaagaaggccacccaggccagccaggagtactag

SEQ ID NO: 19880 - DNA, 432 bp, Artificial Sequence; identical to SEQ ID NO: 19879
  Description of Artificial Sequence: Synthetic coding sequence

SEQ ID NO: 19881 - DNA, 276 bp, Artificial Sequence
  Description of Artificial Sequence: Synthetic coding sequence
atgtgcccctgccccctgcaccggggccggggccccccagctgtgtgtgcctgcagcgctggccgcctgggcctgcggagcagcgctgcccagctgacagctgcccggctgaaggccctgggagatgagctgcaccagaggaccatgtggaggcggcgggcccggagcagaagagccccagcccctggggccctgcccacctactggccctggctgtgtgccgccgcccaggtggccgccctggccgcctggctgctgggcagaagaaacctgtag

SEQ ID NO: 19882 - DNA, 618 bp, Artificial Sequence
  Description of Artificial Sequence: Synthetic coding sequence
atgacagagcggcgggtgcccttcagcctgctgcggggccccagctgggaccccttccgggactggtacccccacagccggctgtttgaccaggccttcggcctgccccggctgcctgaggagtggagccagtggctgggcggcagctcctggccaggctacgtgcggcccctgcccccagctgccatcgagagccctgctgtggccgccccagcctacagccgggccctgagccggcagctgagcagtggagtgtctgagatccgccacacagctgaccgctggagggtgtccctggatgtgaaccactttgccccagatgagctgactgtgaagaccaaggatggagtggtggagatcaccgggaagcatgaggagcggcaggatgaacatggctacatcagccgctgcttcaccaggaagtacaccctgcccccaggagtggaccccacccaggtgagcagcagcctgagccctgagggcaccctgactgtggaggcccccatgcccaagctggccacccagagcaatgagatcaccatccctgtgacctttgagagccgggcccagctgggcggccctgaggccgccaagagtgatgaaacagctgccaagtag

SEQ ID NO: 19883 - DNA, 513 bp, Artificial Sequence
  Description of Artificial Sequence: Synthetic coding sequence
atgacagagcggcgggtgcccttcagcctgctgcggggccccagctggccaggctacgtgcggcccctgcccccagctgccatcgagagccctgctgtggccgccccagcctacagccgggccctgagccggcagctgagcagcggcgtgtctgagatccgccacacagctgaccgctggagggtgtccctggatgtgaaccactttgccccagatgagctgactgtgaagaccaaggatggagtggtggagatcaccgggaagcatgaggagcggcaggatgagcacggctacatcagccgctgcttcaccaggaagtacaccctgcccccaggagtggaccccacccaggtgagcagcagcctgagccctgagggcaccctgactgtggaggcccccatgcccaagctggccacccagagcaatgagatcaccatccctgtgacctttgagagccgggcccagctgggcggccctgaggccgccaagagtgatgaaacagctgccaagtag

SEQ ID NO: 19884 - DNA, 1926 bp, Artificial Sequence
  Description of Artificial Sequence: Synthetic coding sequence
atggccacagccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaacccccagaacacagtgtttgatgccaagaggctcatcggcaggaagttcaatgaccctgtggtgcaggccgacatgaagctgtggcccttccaggtgatcaatgaaggaggcaagcccaaggtgctggtgtcctacaagggggagaacaaggccttctacccagaggagatcagctccatggtgctgaccaagctgaaggagacagctgaggccttcctgggccaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacaagggcggccagggcgagcggcacgtgctgatctttgacctgggcggcggcacctttgatgtgtccatcctgaccattgatgatggcatctttgaggtgaaggccacagctggggacacccacctgggcggagaagattttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaaggccctgagagatgccaagatggacaaggccaagatccatgacatcgtgctggtgggcggcagcacccgcatccccaaggtgcagaggctgctgcaggactacttcaacggccgggacctgaacaagagcatcaacccagatgaggccgtggcctatggagctgctgtgcaggccgccatcctgatgggagacaagtctgagaaggtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgacctgaccggcatccccccagccccccggggcgtgccccagatcgaggtgacctttgatattgatgccaacggcatcctgaatgtgacagccatggacaagagcacaggcaaggtgaacaagatcaccatcaccaatgacaagggccgcctgagcaaggaggagattgaaagaatggtgctggatgctgagaagtacaaggccgaggatgaggtgcagcgggagaagattgctgccaagaatgccctggagagctatgccttcaacatgaagtctgtggtgtctgatgagggcctgaagggcaagatcagcgagagtgacaagaacaagatcctggacaagtgcaatgagctgctgtcctggctggaggtgaaccagctggccgagaaggatgaatttgaccacaagaggaaggagctgaagcagatgtgcaaccccatcatcaccaagctgtaccagggcggctgcaccggccctgcctgtggcaccggctacgtgcccggccgcccagccaccggccccaccatcgaggaggtggactag

SEQ ID NO: 19885 - DNA, 1599 bp, Artificial Sequence
  Description of Artificial Sequence: Synthetic coding sequence
atggccacagccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctgccaagaaccaggtggccatgaacccccagaacacagtgtttgatgccaagaggctcatcggcaggaagttcaatgaccctgtggtgcaggccgacatgaagctgtggcccttccaggtgatcaatgaaggaggcaagcccaaggtgctggtgtcctacaagggggagaacaaggccttctacccagaggagatcagctccatggtgctgaccaagctgaaggagacagctgaggccttcctgggccaccctgtgaccaatgctgtgatcaccgtgcctgcctacttcaatgacagccagaggcaggccaccaaggatgctggggtgattgctggcctgaatgtgctgcgcatcatcaatgagcccacagctgctgccatcgcctacggcctggacaagggcggccagggcgagcggcacgtgctgatctttgacctgggcggcggcacctttgatgtgtccatcctgaccattgatgatggcatctttgaggtgaaggccacagctggggacacccacctgggcggagaagattttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaaggccctgagagatgccaagatggacaaggccaagatccatgacatcgtgctggtgggcggcagcacccgcatccccaaggtgcagaggctgctgcaggactacttcaacggccgggacctgaacaagagcatcaacccagatgaggccgtggcctatggagctgctgtgcaggccgccatcctgatgggagacaagtctgagaaggtgcaggacctgctgctgctggatgtggcccccctgagcctgggcctggagacagctgggggcgtgatgacagccctgatcaagaggaacagcaccatccccaccaagcagacccagatcttcaccacctacagcgacaaccagcccggggtgctgatccaggtgtatgaaggagagcgggccatgaccaaggacaacaacctgctgggccgctttgacctgaccggcatccccccagccccccggggcgtgccccagatcgaggtgacctttgatattgatgccaacggcatcctgaatgtgacagccatggacaagagcacaggcaaggtgaacaagatcaccatcaccaatgacaagggccgcctgagcaaggaggagattgaaagaatggtgctggatgctgagaagtacaaggccgaggatgtgtag

SEQ ID NO: 19886 - DNA, 1926 bp, Artificial Sequence; identical to SEQ ID NO: 19884
  Description of Artificial Sequence: Synthetic coding sequence

SEQ ID NO: 19887 - DNA, 699 bp, Artificial Sequence
  Description of Artificial Sequence: Synthetic coding sequence
gccaagggcatcgccatcggcatcgacctgggcaccacctacagctgtgtgggcgtcttccagcacggcaaggtggagatcatcgccaatgaccagggcaacagaaccacccccagctatgtggccttcacagacacagagcggctgattggagatgctggggtgattgctggcctgaatgtgctgcgcatcatcaatgagcccacagctgctgccatcgcctacggcctggacaagggcggccagggcgagcggcacgtgctgatctttgacctgggcggcggcacctttgatgtgtccatcctgaccattgatgatggcatctttgaggtgaaggccacagctggggacacccacctgggcggagaagattttgacaaccggctggtgagccactttgtggaggagttcaagaggaagcacaagaaggacatcagccagaacaagagagctgtgcggcggctgaggacagcctgtgagcgggccaagaggaccctgagcagcagcacccaggccaacctggagattgacagcctgtatgagggcatcgacttctacaccagcatcacccgggccaggtttgaggagctgtgtgccgacctcttccggggcaccctggagcctgtggagaagggggcccccccagccagcccccgctgcagcggctgcttccgcaccacctccatggatgtgatctag

SEQ ID NO: 19888 - DNA, 1074 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccctgccacagaggcccgctaccgccgggagggcgcccgcttcatctttgatgtgggcacccggctgggcctgcactatgacaccctggccaccggcatcatctacttccaccgcttctacatgttccacagcttcaagcagttccccaggtatgtgactggagcctgctgcctcttcctggccggcaaggtggaggagacccccaagaagtgcaaggacatcatcaagacagcccggagcctgctgaatgatgtgcagtttggccagtttggagatgaccccaaggaggaggtgatggtgctggagcgcatcctgctgcagaccatcaagtttgacctgcaggtggagcacccctaccagttcctgctgaagtatgccaagcagctgaagggggacaagaacaagatccagaagctggtgcagatggcctggacctttgtgaatgacaggaccagcctgtgcaccaccctgagcctgcagtgggagcctgagatcatcgctgtggccgtgatgtacctggccggccgcctgtgcaagtttgagatccaggagtggaccagcaagcccatgtaccgccgctggtgggagcagtttgtgcaggatgtgcctgtggatgtgctggaggacatctgccaccagatcctggacctgtacagccagggcaagcagcagatgccccaccacaccccccaccagctgcagcagccccccagcctgcagcccaccccccaggtgccccaggtgcagcagagccagcccagccagagcagcgagcccagccagccccagcagaaggaccccccactcatcctgctgcagggctgggcctgccggcagcctgccacccacctgctgcccagccccctggaggacagcctgctgtgcccccggcccttcccccacccagcctgcctgcagctgggcggctggggcggccagcccggctag

SEQ ID NO: 19889 - DNA, 2565 bp, Artificial Sequence
  Description of Artificial Sequence: Synthetic coding sequence
atgccaccctgcagcggaggagatggcagcaccccacctggccccagcctgcgggaccgggactgcccagcccagagcgctgagtacccccgggaccggctggacccccggcccggcagccccagcgaggccagcagcccccccttcctgcggagccgggcccctgtgaactggtaccaggagaaggcccaggtgttcctgtggcacctgatggtgtctggcagcaccaccctgctgtgcctgtggaagcagcccttccacgtgtctgccttccctgtgacagccagcctggccttccggcagagccagggcgccggccagcacctgtacaaggacctgcagcccttcatcctgctgcggctgctgatgcctgaggagacccagacccaggaccagcccatggaggaggaggaggtggagacctttgccttccaggccgagatcgcccagctgatgagcctcatcatcaacaccttctacagcaacaaggagatcttcctgcgggagctgatcagcaacagcagtgatgccctggacaagatccgctatgagagcctgacagaccccagcaagctggacagcggcaaggagctgcacatcaacctgatccccaacaagcaggacaggaccctgaccatcgtggacaccggcatcggcatgaccaaggctgacctgatcaacaacctgggcaccatcgccaagagcggcaccaaggccttcatggaggccctgcaggccggggctgacatctccatgattggccagtttggagtgggcttctacagcgcctacctggtggccgagaaggtgaccgtcatcaccaagcacaatgatgatgagcagtatgcctgggagagcagcgctgggggcagcttcaccgtgaggacagacaccggggagcccatgggccggggcaccaaggtgatcctgcacctgaaggaggaccagacagagtacctggaggagcggcgcatcaaggagatcgtgaagaagcacagccagttcatcggctaccccatcaccctgtttgtggagaaggagcgggacaaggaggtgtctgatgatgaagctgaggagaaggaggacaaggaggaggagaaggagaaggaggagaaggagagcgaggacaagccagaaattgaagatgtgggcagtgatgaggaggaggagaagaaggatggagacaagaagaagaagaagaagatcaaggagaagtacatcgaccaggaggagctgaacaagaccaagcccatctggaccagaaatccagatgacatcaccaatgaggagtatggagagttctacaagagcctgaccaatgactgggaggaccacctggccgtgaagcacttctctgtggagggccagctggagttccgggccctgctgtttgtgccccggcgggccccctttgacctgtttgaaaataggaagaagaagaacaacatcaagctgtatgtgcggcgggtcttcatcatggacaactgtgaggagctgatccctgagtacctgaacttcatccggggcgtggtggacagcgaggacctgcccctgaacatcagccgggagatgctgcagcagagcaagatcctgaaggtgatcaggaagaacctggtgaagaagtgcctggagctgttcacagagctggccgaggacaaggagaactacaagaagttctatgagcagttcagcaagaacatcaagctgggcatccacgaggacagccagaacaggaagaagctgtctgagctgctgcgctactacaccagcgccagcggagatgagatggtgtccctgaaggactactgcaccaggatgaaggagaaccagaagcacatctactacatcactggagagaccaaggaccaggtggccaacagcgcctttgtggagcggctgaggaagcacggcctggaggtgatctacatgattgagcccattgatgagtactgtgtgcagcagctgaaggagtttgagggcaagaccctggtgtctgtgaccaaggagggcctggagctgcctgaagatgaggaggagaagaagaagcaggaggagaagaagaccaagtttgagaacctgtgcaagatcatgaaggacatcctggagaagaaggtggagaaggtggtggtgagcaaccggctggtgaccagcccctgctgcatcgtgaccagcacctacggctggacagccaacatggagcgcatcatgaaggcccaggccctgcgggacaacagcaccatgggctacatggccgccaagaagcacctggagatcaacccagaccacagcatcatcgagaccctgcggcagaaggccgaggccgacaagaatgacaagtctgtgaaggacctggtgatcctgctgtatgaaacagccctgctgagcagcggcttcagcctggaggacccccagacccacgccaaccgcatctacaggatgatcaagctgggcctgggcattgatgaagatgaccccacagcagatgacaccagcgctgctgtgacagaggagatgccacccctggagggagatgatgacaccagcaggatggaggaggtggactag

SEQ ID NO: 19890 - DNA, 1242 bp, Artificial Sequence
  Description of Artificial Sequence: Synthetic coding sequence
atgggccggggcaccaaggtgatcctgcacctgaaggaggaccagacagagtacctggaggagcggcgcatcaaggagatcgtgaagaagcacagccagttcatcggctaccccatcaccctgtttgtggagaaggagcgggacaaggaggtgtctgatgatgaggccgaggagaaggaggacaaggaggaggagaaggagaaggaggagaaggagagcgaggacaagccagaaattgaagatgtgggcagtgatgaggaggaggagaagaaggatggagacaagaagaagaagaagaagatcaaggagaagtacatcgaccaggaggagctgaacaagaccaagcccatctggaccaggaacccagatgacatcaccaatgaggagtatggagagttctacaagagcctgaccaatgactgggaggaccacctggccgtgaagcacttctctgtggagggccagctggagttccgggccctgctgtttgtgccccggcgggccccctttgacctgtttgagaacaggaagaagaagaacaacatcaagctgtatgtgagaagagtcttcatcatggacaactgtgaggagctgatccctgagtacctgaacttcatccggggcgtggtggacagcgaggacctgcccctgaacatcagccgggagatgctgcagcagagcaagatcctgaaggtgatcaggaagaacctggtgaagaagtgcctggagctgttcacagagctggccgaggacaaggagaactacaagaagttctatgagcagttcagcaagaacatcaagctgggcatccacgaggacagccagaacaggaagaagctgtctgagctgctgcgctactacaccagcgccagcggagatgagatggtgtccctgaaggactactgcaccaggatgaaggagaaccagaagcacatctactacatcaccggggagaccaaggaccaggtggccaacagcgcctttgtggagcggctgaggaagcacggcctggaggtgatctacatgattgagcccattgatgagtactgtgtgcagcagctgaaggagtttgagggcaagaccctggtgtctgtgaccaaggagggcctggagctgcctgaagatgaggaggagaagaagaagcaggaggagaagaagaccaagtttgagaacctgtgcaagatcatgaaggacatcctggagaagaaggtggagaaggtgtgtgagtacagcatctcctag

SEQ ID NO: 19891 - DNA, 2412 bp, Artificial Sequence
  Description of Artificial Sequence: Synthetic coding sequence
atgagggccctgtgggtgctgggcctgtgctgcgtgctgctgaccttcggctctgtgcgggcagatgatgaggtggatgtggatggcaccgtggaggaggacctgggcaagagccgggagggcagcaggacagatgatgaggtggtgcagcgggaggaggaggccatccagctggatggcctgaatgccagccagatccgggagctgcgggagaagtctgagaagtttgccttccaggccgaggtgaacaggatgatgaagctgatcatcaacagcctgtacaagaacaaggagatcttcctgcgggagctgatcagcaatgccagtgatgccctggacaagatccgcctcatcagcctgacagatgaaaatgccctgtctggaaatgaggagctgactgtgaagatcaagtgtgacaaggagaagaacctgctgcacgtgacagacaccggggtgggcatgacccgggaggagctggtgaagaacctgggcaccatcgccaagagcggcaccagcgagttcctgaacaagatgacagaggcccaggaggatggccagagcaccagcgagctgattggccagtttggagtgggcttctacagcgccttcctggtggccgacaaggtgattgtgaccagcaagcacaacaatgacacccagcacatctgggagagtgacagcaatgagttctctgtgattgctgacccccggggcaacaccctgggccggggcaccaccatcaccctggtgctgaaggaggaggccagtgactacctggagctggacaccatcaagaacctggtgaagaagtacagccagttcatcaacttccccatctacgtgtggagcagcaagacagagaccgtggaggagcccatggaggaggaggaggccgccaaggaggagaaggaggagagtgatgatgaggccgctgtggaggaggaggaggaggagaagaagcccaagaccaagaaggtggagaagacagtgtgggactgggagctgatgaatgacatcaagcccatctggcagaggcccagcaaggaggtggaggaggatgagtacaaggccttctacaagagcttcagcaaggagagtgatgaccccatggcctacatccacttcaccgctgagggggaggtgaccttcaagagcatcctgtttgtgcccaccagcgccccccggggcctgtttgatgaatatggcagcaagaagagtgactacatcaagctgtatgtgcggcgggtcttcatcacagatgacttccatgacatgatgcccaagtacctgaactttgtgaagggcgtggtggacagtgatgacctgcccctgaatgtgtcccgggagaccctgcagcagcacaagctgctgaaggtgatcaggaagaagctggtgaggaagaccctggacatgatcaagaagattgctgatgacaagtacaatgacaccttctggaaggagtttggcaccaacatcaagctgggcgtgattgaggaccacagcaacagaacccggctggccaagctgctgcgcttccagagcagccaccaccccacagacatcaccagcctggaccagtatgtggagaggatgaaggagaagcaggacaagatctacttcatggccggcagcagcaggaaggaggccgagagcagcccctttgtggagcggctgctgaagaagggctatgaagtcatctacctgacagagcctgtggatgagtactgcatccaggccctgcctgagtttgatggcaagcgcttccagaatgtggccaaggagggcgtgaagtttgatgaaagtgagaagaccaaggagagccgggaggccgtggagaaggagtttgagcccctgctgaactggatgaaggacaaggccctgaaggacaagattgagaaggctgtggtgtcccagaggctgacagagagcccctgtgccctggtggccagccagtatggctggagcggcaacatggagcgcatcatgaaggcccaggcctaccagacaggcaaggacatcagcaccaactactatgccagccagaagaagacctttgagatcaaccccaggcaccccctcatccgggacatgctgcggcgcatcaaggaggatgaagatgacaagacagtgctggacctggccgtggtgctgtttgaaacagccaccctgcggagcggctacctgctgcctgacaccaaggcctatggagacagaattgaaagaatgctgcggctgagcctgaacattgatcctgatgccaaggtggaggaggagcctgaggaggagcctgaggagacagctgaggacaccacagaggacacagagcaggatgaagatgaggagatggatgtgggcacagatgaggaggaggagacagccaaggagagcacagctgagaaggatgagctgtag

SEQ ID NO: 19892 - DNA, 1662 bp, Artificial Sequence
  Description of Artificial Sequence: Synthetic coding sequence
atgagggccctgtgggtgctgggcctgtgctgcgtgctgctgaccttcggctctgtgcgggcagatgatgaggtggatgtggatggcaccgtggaggaggacctgggcaagagccgggagggcagcaggacagatgatgaggccgccaaggaggagaaggaggagagtgatgatgaggccgctgtggaggaggaggaggaggagaagaagcccaagaccaagaaggtggagaagacagtgtgggactgggagctgatgaatgacatcaagcccatctggcagaggcccagcaaggaggtggaggaggatgagtacaaggccttctacaagagcttcagcaaggagagtgatgaccccatggcctacatccacttcaccgctgagggggaggtgaccttcaagagcatcctgtttgtgcccaccagcgccccccggggcctgtttgatgaatatggcagcaagaagagtgactacatcaagctgtatgtgcggcgggtcttcatcacagatgacttccatgacatgatgcccaagtacctgaactttgtgaagggcgtggtggacagtgatgacctgcccctgaatgtgtcccgggagaccctgcagcagcacaagctgctgaaggtgatcaggaagaagctggtgaggaagaccctggacatgatcaagaagattgctgatgacaagtacaatgacaccttctggaaggagtttggcaccaacatcaagctgggcgtgattgaggaccacagcaacagaacccggctggccaagctgctgcgcttccagagcagccaccaccccacagacatcaccagcctggaccagtatgtggagaggatgaaggagaagcaggacaagatctacttcatggccggcagcagcaggaaggaggccgagagcagcccctttgtggagcggctgctgaagaagggctatgaagtcatctacctgacagagcctgtggatgagtactgcatccaggccctgcctgagtttgatggcaagcgcttccagaatgtggccaaggagggcgtgaagtttgatgaaagtgagaagaccaaggagagccgggaggccgtggagaaggagtttgagcccctgctgaactggatgaaggacaaggccctgaaggacaagattgagaaggctgtggtgtcccagaggctgacagagagcccctgtgccctggtggccagccagtatggctggagcggcaacatggagcgcatcatgaaggcccaggcctaccagacaggcaaggacatcagcaccaactactatgccagccagaagaagacctttgagatcaaccccaggcaccccctcatccgggacatgctgcggcgcatcaaggaggatgaagatgacaagacagtgctggacctggccgtggtgctgtttgaaacagccaccctgcggagcggctacctgctgcctgacaccaaggcctatggagacagaattgaaagaatgctgcggctgagcctgaacattgatcctgatgccaaggtggaggaggagcctgaggaggagcctgaggagacagctgaggacaccacagaggacacagagcaggatgaagatgaggagatggatgtgggcacagatgaggaggaggagacagccaaggagagcacagctgagaaggatgagctgtag

SEQ ID NO: 19893 - DNA, 948 bp, Artificial Sequence
  Description of Artificial Sequence: Synthetic coding sequence
atgagggccctgtgggtgctgggcctgtgctgcgtgctgctgaccttcggctctgtgcgggcagatgatgaggtggatgtggatggcaccgtggaggaggacctgggcaagagccgggagggcagcaggacagatgatgaggtggtgcagcgggaggaggaggccatccagctggatggcctgaatgccagccagatccgggagctgcgggagaagtctgagaagtttgccttccaggccgaggtgaacaggatgatgaagctgatcatcaacagcctgtacaagaacaaggagatcttcctgcgggagctgatcagcaatgccagtgatgccctggacaagatccgcctcatcagcctgacagatgaaaatgccctgtctggaaatgaggagctgactgtgaagatcaagtgtgacaaggagaagaacctgctgcacgtgacagacaccggggtgggcatgacccgggaggagctggtgaagaacctgggcaccatcgccaagagcggcaccagcgagttcctgaacaagatgacagaggcccaggaggatggccagagcaccagcgagctgattggccagtttggagtgggcttctacagcgccttcctggtggccgacaaggtgattgtgaccagcaagcacaacaatgacacccagcacatctgggagagtgacagcaatgagttctctgtgattgctgacccccggggcaacaccctgggccggggcaccaccatcaccctggtgctgaaggaggaggccagtgactacctggagctggacaccatcaagaacctggtgaagaagtacagccagttcatcaacttccccatctacgtgtggagcagcaagacagagaccgtggaggagcccatggaggaggaggaggccgccaaggaggagaaggaggagagtgatgatgaggccgccgccaggagaagatag

SEQ ID NO: 19894 - DNA, 483 bp, Artificial Sequence
  Description of Artificial Sequence: Synthetic coding sequence
atgtctgaggtgcggcccctgagccgggacatcctgatggagaccctgctgtatgagcagctgctggagccccccaccatggaggtgctgggcatgacagattctgaggaggacctggaccccatggaggactttgacagcctggagtgcatggagggcagtgatgccctggccctgcggctggcctgcattggagatgagatggatgtgtccctgcgggccccccggctggcccagctgtctgaggtggccatgcacagcctgggcctggccttcatctatgaccagacagaggacatcagagatgtgctgcggagcttcatggatggcttcaccaccctgaaggagaacatcatgaggttctggaggagccccaaccctggctcctgggtgtcctgtgagcaggtgctgctggccctgctgctgctgctggccctgctgctgcccctgctgagcggcggcctgcacctgctgctgaagtag

SEQ ID NO: 19895 - DNA, 564 bp, Artificial Sequence
  Description of Artificial Sequence: Synthetic coding sequence
atggagcggccccagcctgacagcatgccccaggacctgtctgaggccctgaaggaggccaccaaggaggtgcacacccaggctgaaaatgctgagttcatgaggaacttccagaagggccaggtgaccagagatggcttcaagctggtgatggccagcctgtaccacatctacgtggccctggaggaggagattgaaagaaacaaggagagccctgtgtttgcccctgtgtacttccctgaggagctgcacaggaaggccgccctggagcaggacctggccttctggtacggcccccgctggcaggaggtgatcccctacaccccagccatgcagcgctacgtgaagaggctgcacgaggtgggccgcacagagcctgagctgctggtggcccacgcctacacccgctacctgggggacctgagcggcggccaggtgctgaagaagatcgcccagaaggccctggacctgcccagcagcggggagggcctggccttcttcaccttccccaacatcgccagcgccaccaagttcaagcagctgtaccgcagcaggatgaactag

SEQ ID NO: 19896 - DNA, 1581 bp, Artificial Sequence
  Description of Artificial Sequence: Synthetic coding sequence
ctgggcggccgcagcagctgtgaggaccccggctgccccagagatgaggagcgggcccccaggatgggctgcatgaagagcaagttcctgcaggtgggcggcaacaccttcagcaagacagagaccagcgccagcccccactgccctgtgtatgtgcctgaccccaccagcaccatcaagccaggccccaacagccacaacagcaacaccccaggcatccgggaggccggcagcgaggacatcatcgtggtggccctgtatgactatgaggccatccaccacgaggacctgtccttccagaagggggaccagatggtggtgctggaggagagcggggagtggtggaaggcccggagcctggccaccaggaaggagggctacatccccagcaactacgtggcccgggtggacagcctggagacagaggagtggttcttcaagggcatcagcaggaaggatgctgagcggcagctgctggcccctggcaacatgctgggcagcttcatgatccgggacagcgagaccaccaagggcagctacagcctgtctgtgcgggactatgacccccggcagggcgacacagtgaagcactacaagatccgcaccctggacaatggaggcttctacatcagccccaggagcaccttcagcaccctgcaggagctggtggaccactacaagaagggaaatgatggcctgtgccagaagctgtctgtgccctgcatgagcagcaagccccagaagccctgggagaaggatgcctgggagatcccccgggagagcctgaagctggagaagaagctgggcgccggccagtttggagaggtgtggatggccacctacaacaagcacaccaaggtggccgtgaagaccatgaagccaggctccatgtctgtggaggccttcctggccgaggccaacgtgatgaagaccctgcagcacgacaagctggtgaagctgcatgctgtggtgaccaaggagcccatctacatcatcacagagttcatggccaagggcagcctgctggacttcctgaagagtgatgagggcagcaagcagcccctgcccaagctgattgacttcagcgcccagattgctgagggcatggccttcatcgagcagaggaactacatccaccgggacctgcgggccgccaacatcctggtgtctgccagcctggtgtgcaagattgctgactttggcctggcccgggtgattgaagataatgagtacacagcccgggagggcgccaagttccccatcaagtggacagcccctgaggccatcaactttggcagcttcaccatcaagagtgatgtgtggagctttggcatcctgctgatggagatcgtgacctacggccgcatcccctacccaggcatgagcaaccctgaggtgatccgggccctggagcggggctacaggatgcccaggcctgagaactgcccagaggagctgtacaacatcatgatgcgctgctggaagaacagacctgaggagcggcccacctttgagtacatccagagcgtgctggatgacttctacacagccacagagagccagtaccagcagcagccctag

SEQ ID NO: 19897 - DNA, 1578 bp, Artificial Sequence
  Description of Artificial Sequence: Synthetic coding sequence
ctgggcggccgcagcagctgtgaggaccccggctgccccagagatgaggagcgggcccccaggatgggctgcatgaagagcaagttcctgcaggtgggcggcaacaccttcagcaagacagagaccagcgccagcccccactgccctgtgtatgtgcctgaccccaccagcaccatcaagccaggccccaacagccacaacagcaacaccccaggcatccgggagggcagcgaggacatcatcgtggtggccctgtatgactatgaggccatccaccacgaggacctgtccttccagaagggggaccagatggtggtgctggaggagagcggggagtggtggaaggcccggagcctggccaccaggaaggagggctacatccccagcaactacgtggcccgggtggacagcctggagacagaggagtggttcttcaagggcatcagcaggaaggatgctgagcggcagctgctggcccctggcaacatgctgggcagcttcatgatccgggacagcgagaccaccaagggcagctacagcctgtctgtgcgggactatgacccccggcagggcgacacagtgaagcactacaagatccgcaccctggacaatggaggcttctacatcagccccaggagcaccttcagcaccctgcaggagctggtggaccactacaagaagggaaatgatggcctgtgccagaagctgtctgtgccctgcatgagcagcaagccccagaagccctgggagaaggatgcctgggagatcccccgggagagcctgaagctggagaagaagctgggcgccggccagtttggagaggtgtggatggccacctacaacaagcacaccaaggtggccgtgaagaccatgaagccaggctccatgtctgtggaggccttcctggccgaggccaacgtgatgaagaccctgcagcacgacaagctggtgaagctgcatgctgtggtgaccaaggagcccatctacatcatcacagagttcatggccaagggcagcctgctggacttcctgaagagtgatgagggcagcaagcagcccctgcccaagctgattgacttcagcgcccagattgctgagggcatggccttcatcgagcagaggaactacatccaccgggacctgcgggccgccaacatcctggtgtctgccagcctggtgtgcaagattgctgactttggcctggcccgggtgattgaggacaatgagtacacagcccgggagggcgccaagttccccatcaagtggacagcccctgaggccatcaactttggcagcttcaccatcaagagtgatgtgtggagctttggcatcctgctgatggagatcgtgacctacggccgcatcccctacccaggcatgagcaaccctgaggtgatccgggccctggagcggggctacaggatgcccaggcctgagaactgcccagaggagctgtacaacatcatgatgcgctgctggaagaacagacctgaggagcggcccacctttgagtacatccagagcgtgctggatgacttctacacagccacagagagccagtaccagcagcagccctag

SEQ ID NO: 19898 - DNA, 1515 bp, Artificial Sequence
  Description of Artificial Sequence: Synthetic coding sequence
atgggctgcatgaagagcaagttcctgcaggtgggcggcaacaccttcagcaagacagagaccagcgccagcccccactgccctgtgtatgtgcctgaccccaccagcaccatcaagccaggccccaacagccacaacagcaacaccccaggcatccgggagggcagcgaggacatcatcgtggtggccctgtatgactatgaggccatccaccacgaggacctgtccttccagaagggggaccagatggtggtgctggaggagagcggggagtggtggaaggcccggagcctggccaccaggaaggagggctacatccccagcaactacgtggcccgggtggacagcctggagacagaggagtggttcttcaagggcatcagcaggaaggatgctgagcggcagctgctggcccctggcaacatgctgggcagcttcatgatccgggacagcgagaccaccaagggcagctacagcctgtctgtgcgggactatgacccccggcagggcgacacagtgaagcactacaagatccgcaccctggacaatggaggcttctacatcagccccaggagcaccttcagcaccctgcaggagctggtggaccactacaagaagggaaatgatggcctgtgccagaagctgtctgtgccctgcatgagcagcaagccccagaagccctgggagaaggatgcctgggagatcccccgggagagcctgaagctggagaagaagctgggcgccggccagtttggagaggtgtggatggccacctacaacaagcacaccaaggtggccgtgaagaccatgaagccaggctccatgtctgtggaggccttcctggccgaggccaacgtgatgaagaccctgcagcacgacaagctggtgaagctgcatgctgtggtgaccaaggagcccatctacatcatcacagagttcatggccaagggcagcctgctggacttcctgaagagtgatgagggcagcaagcagcccctgcccaagctgattgacttcagcgcccagattgctgagggcatggccttcatcgagcagaggaactacatccaccgggacctgcgggccgccaacatcctggtgtctgccagcctggtgtgcaagattgctgactttggcctggcccgggtgattgaagataatgagtacacagcccgggagggcgccaagttccccatcaagtggacagcccctgaggccatcaactttggcagcttcaccatcaagagtgatgtgtggagctttggcatcctgctgatggagatcgtgacctacggccgcatcccctacccaggcatgagcaaccctgaggtgatccgggccctggagcggggctacaggatgcccaggcctgagaactgcccagaggagctgtacaacatcatgatgcgctgctggaagaacagacctgaggagcggcccacctttgagtacatccagagcgtgctggatgacttctacacagccacagagagccagtaccagcagcagccctag

SEQ ID NO: 19899 - DNA, 1518 bp, Artificial Sequence
  Description of Artificial Sequence: Synthetic coding sequence
atgggctgcatgaagagcaagttcctgcaggtgggcggcaacaccttcagcaagacagagaccagcgccagcccccactgccctgtgtatgtgcctgaccccaccagcaccatcaagccaggccccaacagccacaacagcaacaccccaggcatccgggaggccggcagcgaggacatcatcgtggtggccctgtatgactatgaggccatccaccacgaggacctgtccttccagaagggggaccagatggtggtgctggaggagagcggggagtggtggaaggcccggagcctggccaccaggaaggagggctacatccccagcaactacgtggcccgggtggacagcctggagacagaggagtggttcttcaagggcatcagcaggaaggatgctgagcggcagctgctggcccctggcaacatgctgggcagcttcatgatccgggacagcgagaccaccaagggcagctacagcctgtctgtgcgggactatgacccccggcagggcgacacagtgaagcactacaagatccgcaccctggacaatggaggcttctacatcagccccaggagcaccttcagcaccctgcaggagctggtggaccactacaagaagggaaatgatggcctgtgccagaagctgtctgtgccctgcatgagcagcaagccccagaagccctgggagaaggatgcctgggagatcccccgggagagcctgaagctggagaagaagctgggcgccggccagtttggagaggtgtggatggccacctacaacaagcacaccaaggtggccgtgaagaccatgaagccaggctccatgtctgtggaggccttcctggccgaggccaacgtgatgaagaccctgcagcacgacaagctggtgaagctgcatgctgtggtgaccaaggagcccatctacatcatcacagagttcatggccaagggcagcctgctggacttcctgaagagtgatgagggcagcaagcagcccctgcccaagctgattgacttcagcgcccagattgctgagggcatggccttcatcgagcagaggaactacatccaccgggacctgcgggccgccaacatcctggtgtctgccagcctggtgtgcaagattgctgactttggcctggcccgggtgattgaggacaatgagtacacagcccgggagggcgccaagttccccatcaagtggacagcccctgaggccatcaactttggcagcttcaccatcaagagtgatgtgtggagctttggcatcctgctgatggagatcgtgacctacggccgcatcccctacccaggcatgagcaaccctgaggtgatccgggccctggagcggggctacaggatgcccaggcctgagaactgcccagaggagctgtacaacatcatgatgcgctgctggaagaacagacctgaggagcggcccacctttgagtacatccagagcgtgctggatgacttctacacagccacagagagccagtaccagcagcagccctag

SEQ ID NO: 19900 - DNA, 1521 bp, Artificial Sequence
  Description of Artificial Sequence: Synthetic coding sequence
atgatgggctgcatgaagagcaagttcctgcaggtgggcggcaacaccttcagcaagacagagaccagcgccagcccccactgccctgtgtatgtgcctgaccccaccagcaccatcaagccaggccccaacagccacaacagcaacaccccaggcatccgggaggccggcagcgaggacatcatcgtggtggccctgtatgactatgaggccatccaccacgaggacctgtccttccagaagggggaccagatggtggtgctggaggagagcggggagtggtggaaggcccggagcctggccaccaggaaggagggctacatccccagcaactacgtggcccgggtggacagcctggagacagaggagtggttcttcaagggcatcagcaggaaggatgctgagcggcagctgctggcccctggcaacatgctgggcagcttcatgatccgggacagcgagaccaccaagggcagctacagcctgtctgtgcgggactatgacccccggcagggcgacacagtgaagcactacaagatccgcaccctggacaatggaggcttctacatcagccccaggagcaccttcagcaccctgcaggagctggtggaccactacaagaagggaaatgatggcctgtgccagaagctgtctgtgccctgcatgagcagcaagccccagaagccctgggagaaggatgcctgggagatcccccgggagagcctgaagctggagaagaagctgggcgccggccagtttggagaggtgtggatggccacctacaacaagcacaccaaggtggccgtgaagaccatgaagccaggctccatgtctgtggaggccttcctggccgaggccaacgtgatgaagaccctgcagcacgacaagctggtgaagctgcatgctgtggtgaccaaggagcccatctacatcatcacagagttcatggccaagggcagcctgctggacttcctgaagagtgatgagggcagcaagcagcccctgcccaagctgattgacttcagcgcccagattgctgagggcatggccttcatcgagcagaggaactacatccaccgggacctgcgggccgccaacatcctggtgtctgccagcctggtgtgcaagattgctgactttggcctggcccgggtgattgaagataatgagtacacagcccgggagggcgccaagttccccatcaagtggacagcccctgaggccatcaactttggcagcttcaccatcaagagtgatgtgtggagctttggcatcctgctgatggagatcgtgacctacggccgcatcccctacccaggcatgagcaaccctgaggtgatccgggccctggagcggggctacaggatgcccaggcctgagaactgcccagaggagctgtacaacatcatgatgcgctgctggaagaacagacctgaggagcggcccacctttgagtacatccagagcgtgctggatgacttctacacagccacagagagccagtaccagcagcagccctag

SEQ ID NO: 19901 - DNA, 1518 bp, Artificial Sequence; identical to SEQ ID NO: 19899
  Description of Artificial Sequence: Synthetic coding sequence

SEQ ID NO: 19902 - DNA, 1632 bp, Artificial Sequence
  Description of Artificial Sequence: Synthetic coding sequence
atgctgctgcggagcaagccagccctgcccccacccctgatgctgctgctgctgggccccctgggccccctgagccctggggccctgcccaggcctgcccaggcccaggatgtggtggacctggacttcttcacccaggagcccctgcacctggtgagccccagcttcctgtctgtgaccattgatgccaacctggccacagacccccgcttcctgatcctgctgggcagccccaagctgcggaccctggcccggggcctgagccctgcctacctgcgctttggaggcaccaagacagacttcctgatctttgaccccaagaaggagagcacctttgaggagaggagctactggcagagccaggtgaaccaggacatctgcaagtatggcagcatccccccagatgtggaggagaagctgcggctggagtggccctaccaggagcagctgctgctgcgggagcactaccagaagaagttcaagaacagcacctacagccgcagctctgtggatgtgctgtacacctttgccaactgcagcggcctggacctgatcttcggcctgaatgccctgctgaggacagctgacctgcagtggaacagcagcaatgcccagctgctgctggactactgcagcagcaagggctacaacatctcctgggagctgggcaatgagcccaacagcttcctgaagaaggctgacatcttcatcaatggcagccagctgggggaggacttcatccagctgcacaagctgctgaggaagagcaccttcaagaatgccaagctgtatggcccagatgtgggccagcccaggaggaagacagccaagatgctgaagagcttcctgaaggccggcggggaggtgattgacagcgtgacctggcaccactactacctgaatggaagaacagccaccaaggaggacttcctgaacccagatgtgctggacatcttcatcagctctgtgcagaaggtgttccaggtggtggagagcaccaggcctgggaagaaggtgtggctgggggagaccagcagcgcctacggcggcggggcccccctgctgagtgacacctttgctgctggcttcatgtggctggacaagctgggcctgagcgccaggatgggcatcgaggtggtgatgaggcaggtgttcttcggggccggcaactaccacctggtggatgagaactttgaccccctgcctgactactggctgagcctgctcttcaagaagctggtgggcaccaaggtgctgatggcctctgtgcagggcagcaagaggaggaagctgcgggtgtacctgcactgcaccaacacagacaacccccgctacaaggagggggacctgaccctgtatgccatcaacctgcacaacgtgaccaagtacctgcggctgccctaccccttcagcaacaagcaggtggacaagtacctgctgcggcccctgggcccccacggcctgctgagcaagtctgtgcagctgaatggcctgaccctgaagatggtggatgaccagaccctgccccccctgatggagaagcccctgcggcccggcagcagcctgggcctgcctgccttctcctacagcttcttcgtcatcagaaatgccaaggtggccgcctgcatctag

SEQ ID NO: 19903 - DNA, 1632 bp, Artificial Sequence; identical to SEQ ID NO: 19902
  Description of Artificial Sequence: Synthetic coding sequence

SEQ ID NO: 19904 - DNA, 294 bp, Artificial Sequence
  Description of Artificial Sequence: Synthetic coding sequence
atgctgctgctgctgggccccctgggccccctgagccctggggccctgcccaggcctgcccaggcccaggatgtggtggacctggacttcttcacccaggagcccctgcacctggtgagccccagcttcctgtctgtgaccaggcctgggaagaaggtgtggctgggggagaccagcagcgcctacggcggcggggcccccctgctgagtgacacctttgctgctggcttcatgtggctggacaagctgggcctgagcgccaggatgggcatcgaggtggtgatgaggcagtag

SEQ ID NO: 19905 - DNA, 1410 bp, Artificial Sequence
  Description of Artificial Sequence: Synthetic coding sequence
atgctgctgcggagcaagccagccctgcccccacccctgatgctgctgctgctgggccccctgggccccctgagccctggggccctgcccaggcctgcccaggcccaggatgtggtggacctggacttcttcacccaggagcccctgcacctggtgagccccagcttcctgtctgtgaccattgatgccaacctggccacagacccccgcttcctgatcctgctgggcagccccaagctgcggaccctggcccggggcctgagccctgcctacctgcgctttggaggcaccaagacagacttcctgatctttgaccccaagaaggagagcacctttgaggagaggagctactggcagagccaggtgaaccaggacatctgcaagtatggcagcatccccccagatgtggaggagaagctgcggctggagtggccctaccaggagcagctgctgctgcgggagcactaccagaagaagttcaagaacagcacctacagccgcagctctgtggatgtgctgtacacctttgccaactgcagcggcctggacctgatcttcggcctgaatgccctgctgaggacagctgacctgcagtggaacagcagcaatgcccagctgctgctggactactgcagcagcaagggctacaacatctcctgggagctgggcaatgagcccaacagcttcctgaagaaggctgacatcttcatcaatggcagccagctgggggaggacttcatccagctgcacaagctgctgaggaagagcaccttcaagaatgccaagctgtatggcccagatgtgggccagcccaggaggaagacagccaagatgctgaagagcttcctgaaggccggcggggaggtgattgacagcgtgacctggcaccactactacctgaatggaagaacagccaccaaggaggacttcctgaacccagatgtgctggacatcttcatcagctctgtgcagaaggtgttccaggactactggctgagcctgctcttcaagaagctggtgggcaccaaggtgctgatggcctctgtgcagggcagcaagaggaggaagctgcgggtgtacctgcactgcaccaacacagacaacccccgctacaaggagggggacctgaccctgtatgccatcaacctgcacaacgtgaccaagtacctgcggctgccctaccccttcagcaacaagcaggtggacaagtacctgctgcggcccctgggcccccacggcctgctgagcaagtctgtgcagctgaatggcctgaccctgaagatggtggatgaccagaccctgccccccctgatggagaagcccctgcggcccggcagcagcctgggcctgcctgccttctcctacagcttcttcgtcatcagaaatgccaaggtggccgcctgcatctag

SEQ ID NO: 19906 - DNA, 1458 bp, Artificial Sequence
  Description of Artificial Sequence: Synthetic coding sequence
atgctgctgcggagcaagccagccctgcccccacccctgatgctgctgctgctgggccccctgggccccctgagccctggggccctgcccaggcctgcccaggcccaggatgtggtggacctggacttcttcacccaggagcccctgcacctggtgagccccagcttcctgtctgtgaccattgatgccaacctggccacagacccccgcttcctgatcctgctgggcagccccaagctgcggaccctggcccggggcctgagccctgcctacctgcgctttggaggcaccaagacagacttcctgatctttgaccccaagaaggagagcacctttgaggagaggagctactggcagagccaggtgaaccaggacatctgcaagtatggcagcatccccccagatgtggaggagaagctgcggctggagtggccctaccaggagcagctgctgctgcgggagcactaccagaagaagttcaagaacagcacctacagcaagcccaacagcttcctgaagaaggctgacatcttcatcaatggcagccagctgggggaggacttcatccagctgcacaagctgctgaggaagagcaccttcaagaatgccaagctgtatggcccagatgtgggccagcccaggaggaagacagccaagatgctgaagagcttcctgaaggccggcggggaggtgattgacagcgtgacctggcaccactactacctgaatggaagaacagccaccaaggaggacttcctgaacccagatgtgctggacatcttcatcagctctgtgcagaaggtgttccaggtggtggagagcaccaggcctgggaagaaggtgtggctgggggagaccagcagcgcctacggcggcggggcccccctgctgagtgacacctttgctgctggcttcatgtggctggacaagctgggcctgagcgccaggatgggcatcgaggtggtgatgaggcaggtgttcttcggggccggcaactaccacctggtggatgagaactttgaccccctgcctgactactggctgagcctgctcttcaagaagctggtgggcaccaaggtgctgatggcctctgtgcagggcagcaagaggaggaagctgcgggtgtacctgcactgcaccaacacagacaacccccgctacaaggagggggacctgaccctgtatgccatcaacctgcacaacgtgaccaagtacctgcggctgccctaccccttcagcaacaagcaggtggacaagtacctgctgcggcccctgggcccccacggcctgctgagcaagtctgtgcagctgaatggcctgaccctgaagatggtggatgaccagaccctgccccccctgatggagaagcccctgcggcccggcagcagcctgggcctgcctgccttctcctacagcttcttcgtcatcagaaatgccaaggtggccgcctgcatctag

SEQ ID NO: 19907 - DNA, 1062 bp, Artificial Sequence
  Description of Artificial Sequence: Synthetic coding sequence
atggagaagaccctggagaccgtgcccctggagaggaagaagcgggagaaggagcagttcaggaagctgttcatcggcggcctgagctttgagaccacagaggagagcctgaggaactactatgagcagtggggcaagctgacagactgtgtggtgatgagggaccctgccagcaagaggagccggggcttcggctttgtgaccttcagctccatggccgaggtggatgctgccatggccgcccggccccacagcattgatggccgggtggtggagcccaagagagctgtggcccgggaggagagcggcaagccaggggcccacgtgacagtgaagaagctgtttgtgggcggcatcaaggaggacacagaggagcaccacctgcgggactactttgaggagtatggcaagattgacaccatcgagatcatcacagaccggcagagcggcaagaagaggggctttggatttgtgacctttgatgaccatgaccctgtggacaagatcgtgctgcagaagtaccacaccatcaatggccacaatgctgaggtgaggaaggccctgagccggcaggagatgcaggaggtgcagagcagccgcagcggccggggcggcaactttggatttggagacagccggggcggcggcggcaactttggacctggccctggcagcaacttccggggcggcagtgatggctacggcagcggccggggctttggagatggctacaacggctatggaggcggccctgggggcggcaactttggaggcagccctggctacggcggcggccggggcggctatggaggcggcggccctggctacggcaaccagggcggcggctatggaggcggctatgacaactacggcggcggcaactacggcagcggcaactacaatgactttggaaactacaaccagcagcccagcaactacggccccatgaagagcggcaactttggaggcagcaggaacatgggcggcccctatggaggcggcaactacggccctgggggcagcggcggcagcggcggctatggaggccgcagccgctactag

SEQ ID NO: 19908 - DNA, 1026 bp, Artificial Sequence
  Description of Artificial Sequence: Synthetic coding sequence
atggagcgggagaaggagcagttcaggaagctgttcatcggcggcctgagctttgagaccacagaggagagcctgaggaactactatgagcagtggggcaagctgacagactgtgtggtgatgagggaccctgccagcaagaggagccggggcttcggctttgtgaccttcagctccatggccgaggtggatgctgccatggccgcccggccccacagcattgatggccgggtggtggagcccaagagagctgtggcccgggaggagagcggcaagccaggggcccacgtgacagtgaagaagctgtttgtgggcggcatcaaggaggacacagaggagcaccacctgcgggactactttgaggagtatggcaagattgacaccatcgagatcatcacagaccggcagagcggcaagaagaggggctttggatttgtgacctttgatgaccatgaccctgtggacaagatcgtgctgcagaagtaccacaccatcaatggccacaatgctgaggtgaggaaggccctgagccggcaggagatgcaggaggtgcagagcagccgcagcggccggggcggcaactttggatttggagacagccggggcggcggcggcaactttggacctggccctggcagcaacttccggggcggcagtgatggctacggcagcggccggggctttggagatggctacaacggctatggaggcggccctgggggcggcaactttggaggcagccctggctacggcggcggccggggcggctatggaggcggcggccctggctacggcaaccagggcggcggctatggaggcggctatgacaactacggcggcggcaactacggcagcggcaactacaatgactttggaaactacaaccagcagcccagcaactacggccccatgaagagcggcaactttggaggcagcaggaacatgggcggcccctatggaggcggcaactacggccctgggggcagcggcggcagcggcggctatggaggccgcagccgctactag

SEQ ID NO: 19909 - DNA, 1062 bp, Artificial Sequence; identical to SEQ ID NO: 19907
  Description of Artificial Sequence: Synthetic coding sequence

SEQ ID NO: 19910 - DNA, 750 bp, Artificial Sequence
  Description of Artificial Sequence: Synthetic coding sequence
atggagcgggagaaggagcagttcaggaagctgttcatcggcggcctgagctttgagaccacagaggagagcctgaggaactactatgagcagtggggcaagctgacagactgtgtggtgatgagggaccctgccagcaagaggagccggggcttcggctttgtgaccttcagctccatggccgaggtggatgctgccatggccgcccggccccacagcattgatggccgggtggtggagcccaagagagctgtggcccgggaggagagcggcaagccaggggcccacgtgacagtgaagaagctgtttgtgggcggcatcaaggaggacacagaggagcaccacctgcgggactactttgaggagtatggcaagattgacaccatcgagatcatcacagaccggcagagcggcaagaagaggggctttggatttgtgacctttgatgaccatgaccctgtggacaagatcgtgctgcagaagtaccacaccatcaatggccacaatgctgaggtgaggaaggccctgagccggcaggagatgcaggaggacctggaggtggccatcctggaggtggcccctgtgatggaggaggaggaggaggacatggtggtggaggacctggacatggccaccagggtgggcgccacagaggtggtgatgaccaccatggaggaggagatcatggaggtggagatcaccatgatcctggagatcatcaccagcaacctgctgaccaccgtgcagtag

SEQ ID NO: 19911 - DNA, 846 bp, Artificial Sequence
  Description of Artificial Sequence: Synthetic coding sequence
atgtctgaggagcagtttggaggagatggagctgctggaaatggaggcggccggcgggccggggagcaggagggcgccatggtggccgccacccagggcgctgctgcccgggaggccgagcccggccctggagctgagccccggctggaggcccccaagggagctgagagcgagggcgccaagattgatgccagcaagaatgaagaagatgagggcaagatgttcatcggcggcctgtcctgggacaccaccaagaaggacctgaaggactacttcagcaagtttggagaggtggtggactgcaccctgaagctggaccccatcaccggccgcagccggggctttggatttgtgctcttcaaggagagcgagagcgtggacaaggtgatggaccagaaggagcacaagctgaatggcaaggtgattgaccccaagagggccaaggccatgaagaccaaggagcctgtgaagaagatctttgtgggcggcctgagcccagacaccccagaggagaagatccgggagtactttggaggctttggagaggtggagagcattgagctgcccatggacaacaagaccaacaagagaagaggcttctgcttcatcaccttcaaggaggaggagcctgtgaagaagatcatggagaagaagtaccacaacgtgggcctgagcaaatgtgagatcaaggtggccatgagcaaggagcagtaccagcagcagcagcagtggggcagccggggcggctttgctggccgggcccggggccggggcggggaccagcagagcggctacggcaaggtgtcccggcggggcggccaccagaacagctacaagccctactag

SEQ ID NO: 19912 - DNA, 1068 bp, Artificial Sequence
  Description of Artificial Sequence: Synthetic coding sequence
atgtctgaggagcagtttggaggagatggagctgctgctgctgccacagctgctgtgggcggcagcgctggggagcaggagggcgccatggtggccgccacccagggcgctgctgctgctgctggcagcggggccggcactggaggcggcacagccagcggcggcacagagggcggcagcgctgagagcgagggcgccaagattgatgccagcaagaatgaagaagatgagggccacagcaacagcagccccaggcacagcgaggccgccacagcccagcgggaggagtggaagatgtttattggaggcctgtcctgggacaccaccaagaaggacctgaaggactacttcagcaagtttggagaggtggtggactgcaccctgaagctggaccccatcaccggccgcagccggggcttcggctttgtgctcttcaaggagagcgagagcgtggacaaggtgatggaccagaaggagcacaagctgaatggcaaggtgattgaccccaagagggccaaggccatgaagaccaaggagcctgtgaagaagatctttgtgggcggcctgagcccagacaccccagaggagaagatccgggagtactttggaggctttggagaggtggagagcattgagctgcccatggacaacaagaccaacaagaggcggggcttctgcttcatcaccttcaaggaggaggagcctgtgaagaagatcatggagaagaagtaccacaacgtgggcctgagcaaatgtgagatcaaggtggccatgagcaaggagcagtaccagcagcagcagcagtggggcagcagaggaggctttgctggccgggcccggggccggggcggcggccccagccagaactggaaccagggctacagcaactactggaaccagggctacggcaactacggctacaacagccagggctacggcggctatggaggctatgactacacaggctacaacaactactacggctatggagactacagcaaccagcagagcggctacggcaaggtgtcccggcggggcggccaccagaacagctacaagccctactag

SEQ ID NO: 19913 - DNA, 1011 bp, Artificial Sequence
  Description of Artificial Sequence: Synthetic coding sequence
atgtctgaggagcagtttggaggagatggagctgctgctgctgccacagctgctgtgggcggcagcgctggggagcaggagggcgccatggtggccgccacccagggcgctgctgctgctgctggcagcggggccggcactggaggcggcacagccagcggcggcacagagggcggcagcgctgagagcgagggcgccaagattgatgccagcaagaatgaagaagatgagggcaagatgttcatcggcggcctgtcctgggacaccaccaagaaggacctgaaggactacttcagcaagtttggagaggtggtggactgcaccctgaagctggaccccatcaccggccgcagccggggctttggatttgtgctcttcaaggagagcgagagcgtggacaaggtgatggaccagaaggagcacaagctgaatggcaaggtgattgaccccaagagggccaaggccatgaagaccaaggagcctgtgaagaagatctttgtgggcggcctgagcccagacaccccagaggagaagatccgggagtactttggaggctttggagaggtggagagcattgagctgcccatggacaacaagaccaacaagagaagaggcttctgcttcatcaccttcaaggaggaggagcctgtgaagaagatcatggagaagaagtaccacaacgtgggcctgagcaaatgtgagatcaaggtggccatgagcaaggagcagtaccagcagcagcagcagtggggcagccggggcggctttgctggccgggcccggggccggggcggcggccccagccagaactggaaccagggctacagcaactactggaaccagggctacggcaactacggctacaacagccagggctatggaggctacggcggctatgactacacaggctacaacaactactacggctacggggactacagcaaccagcagagcggctacggcaaggtgtccagaagaggaggccaccagaacagctacaagccctactag

SEQ ID NO: 19914 - DNA, 921 bp, Artificial Sequence
  Description of Artificial Sequence: Synthetic coding sequence
atgtctgaggagcagtttggaggagatggagctgctgctgctgccacagctgctgtgggcggcagcgctggggagcaggagggcgccatggtggccgccacccagggcgctgctgctgctgctggcagcggggccggcactggaggcggcacagccagcggcggcacagagggcggcagcgctgagagcgagggcgccaagattgatgccagcaagaatgaagaagatgagggccacagcaacagcagccccaggcacagcgaggccgccacagcccagcgggaggagtggaagatgtttattggaggcctgtcctgggacaccaccaagaaggacctgaaggactacttcagcaagtttggagaggtggtggactgcaccctgaagctggaccccatcaccggccgcagccggggcttcggctttgtgctcttcaaggagagcgagagcgtggacaaggtgatggaccagaaggagcacaagctgaatggcaaggtgattgaccccaagagggccaaggccatgaagaccaaggagcctgtgaagaagatctttgtgggcggcctgagcccagacaccccagaggagaagatccgggagtactttggaggctttggagaggtggagagcattgagctgcccatggacaacaagaccaacaagaggcggggcttctgcttcatcaccttcaaggaggaggagcctgtgaagaagatcatggagaagaagtaccacaacgtgggcctgagcaaatgtgagatcaaggtggccatgagcaaggagcagtaccagcagcagcagcagtggggcagcagaggaggctttgctggccgggcccggggccggggcggggaccagcagagcggctacggcaaggtgtccagaagaggaggccaccagaacagctacaagccctactag

SEQ ID NO: 19915 - DNA, 468 bp, Artificial Sequence
  Description of Artificial Sequence: Synthetic coding sequence
atgtctgaggagcagtttggaggagatggagctgctgctgctgccacagctgctgtgggcggcagcgctggggagcaggagggcgccatggtggccgccacccagggcgctgctgctgctgctggcagcggggccggcactggaggcggcacagccagcggcggcacagagggcggcagcgctgagagcgagggcgccaagattgatgccagcaagaatgaagaagatgagggcaagatgttcatcggcggcctgtcctgggacaccaccaagaaggacctgaaggactacttcagcaagtttggagaggtggtggactgcaccctgaagctggaccccatcaccggccgcagccggggctttggatttgtgctcttcaaggagagcgagagcgtggacaaggtgatggaccagaaggagcacaagctgaatggcaaggtgattgaccccaagagggccaaggcctag

SEQ ID NO: 19916 - DNA, 666 bp, Artificial Sequence
  Description of Artificial Sequence: Synthetic coding sequence
atgtctgaggagcagtttggaggagatggagctgctgctgctgccacagctgctgtgggcggcagcgctggggagcaggagggcgccatggtggccgccacccagggcgctgctgctgctgctggcagcggggccggcactggaggcggcacagccagcggcggcacagagggcggcagcgctgagagcgagggcgccaagattgatgccagcaagaatgaagaagatgagggccacagcaacagcagccccaggcacagcgaggccgccacagcccagcgggaggagtggaagatgtttattggaggcctgtcctgggacaccaccaagaaggacctgaaggactacttcagcaagtttggagaggtggtggactgcaccctgaagctggaccccatcaccggccgcagccggggcttcggctttgtgctcttcaaggagagcgagagcgtggacaaggtgatggaccagaaggagcacaagctgaatggcaaggtgattgaccccaagagggccaaggccatgaagaccaaggagcctgtgaagaagatctttgtgggcggcctgagcccagacaccccagaggagaagatccgggagtactttggaggctttggagaggtggagagcattgagctgcccatggacaacaagaccaacaagtag

SEQ ID NO: 19917 - DNA, 633 bp, Artificial Sequence
  Description of Artificial Sequence: Synthetic coding sequence
tgaaagatgtttattggaggcctgtcctgggacaccaccaagaaggacctgaaggactacttcagcaagtttggagaggtggtggactgcaccctgaagctggaccccatcaccggccgcagccggggcttcggctttgtgctcttcaaggagagcgagagcgtggacaaggtgatggaccagaaggagcacaagctgaatggcaaggtgattgaccccaagagggccaaggccatgaagaccaaggagcctgtgaagaagatctttgtgggcggcctgagcccagacaccccagaggagaagatccgggagtactttggaggctttggagaggtggagagcattgagctgcccatggacaacaagaccaacaagaggcggggcttctgcttcatcaccttcaaggaggaggagcctgtgaagaagatcatggagaagaagtaccacaacgtgggcctgagcaaatgtgagatcaaggtggccatgagcaaggagcagtaccagcagcagcagcagtggggcagcagaggaggctttgctggccgggcccggggccggggcggggaccagcagagcggctacggcaaggtgtccagaagaggaggccaccagaacagctacaagccctactag

SEQ ID NO: 19918 - DNA, 606 bp, Artificial Sequence
  Description of Artificial Sequence: Synthetic coding sequence
atggaccagaaggagcacaagctgaatggcaaggtgattgaccccaagagggccaaggccatgaagaccaaggagcctgtgaagaagatctttgtgggcggcctgagcccagacaccccagaggagaagatccgggagtactttggaggctttggagaggtggagagcattgagctgcccatggacaacaagaccaacaagaggcggggcttctgcttcatcaccttcaaggaggaggagcctgtgaagaagatcatggagaagaagtaccacaacgtgggcctgagcaaatgtgagatcaaggtggccatgagcaaggagcagtaccagcagcagcagcagtggggcagcagaggaggctttgctggccgggcccggggccggggcggcggccccagccagaactggaaccagggctacagcaactactggaaccagggctacggcaactacggctacaacagccagggctacggcggctatggaggctatgactacacaggctacaacaactactacggctatggagactacagcaaccagcagagcggctacggcaaggtgtcccggcggggcggccaccagaacagctacaagccctactag

SEQ ID NO: 19919 - DNA, 912 bp, Artificial Sequence
  Description of Artificial Sequence: Synthetic coding sequence
atgtctgaggagcagtttggaggagatggagctgctgctgctgccacagctgctgccagcggcggcacagaaggaggcagcgctgagagcgagggcgccaagattgatgccagcaagaatgaggaggatgagggcaagatgtttattggaggcctgtcctgggacaccaccaagaaggacctgaaggactacttcagcaagtttggagaggtggtggactgcaccctgaagctggaccccatcaccggccgcagccggggcttcggctttgtgctcttcaaggagagcgagagcgtggacaaggtgatggaccagaaggagcacaagctgaatggcaaggtgattgaccccaagagggccaaggccatgaagaccaaggagcctgtgaagaagatctttgtgggcggcctgagcccagacaccccagaggagaagatccgggagtactttggaggctttggagaggtggagagcattgagctgcccatggacaacaagaccaacaagaggcggggcttctgcttcatcaccttcaaggaggaggagcctgtgaagaagatcatggagaagaagtaccacaacgtgggcctgagcaaatgtgagatcaaggtggccatgagcaaggagcagtaccagcagcagcagcagtggggcagcagaggaggctttgctggccgggcccggggccggggcggcggccccagccagaactggaaccagggctacagcaactactggaaccagggctacggcaactacggctacaacagccagggctacggcggctatggaggctatgactacacaggctacaacaactactacggctatggagactacagcaaccagcagagcggctacggcaaggtgtcccggcggggcggccaccagaacagctacaagccctactag

SEQ ID NO: 19920 - DNA, 1974 bp, Artificial Sequence
  Description of Artificial Sequence: Synthetic coding sequence
atgccccgctacacagtgcacgtgcggggggagtggctggccgtgccctgccaggatgcccagctgactgtgggctggctgggccgggaggccgtgcggcgctacatcaagaacaagccagacaatggaggcttcacctctgtggatgatgcccacttcctggtgcggcgctgcaagggcctgggcctgctggacaatgaagatcggctggaggtggccctggagaacaatgaatttgtggaggtggtgattgaaggagatgccatgagcccagacttcatccccagccagcctgagggcgtgtacctgtacagcaagtaccgggagcctgagaagtacatcgagctggatggagaccggctgaccacagaggacctggtgaacctgggcaagggccgctacaagatcaagctgacccccacagctgagaagagggtgcagaagagccgggaggtgattgacagcatcatcaaggagaagacagtggtgtatggcatcaccaccggctttgggaagtttgccaggacagtcatccccatcaacaagctgcaggagctgcaggtgaacctggtgcgcagccacagcagcggcgtgggcaagcccctgagccctgagcgctgcaggatgctgctggccctgcgcatcaacgtgctggccaagggctacagcggcatcagcctggagaccctgaagcaggtgattgagatgtttaatgccagctgcctgccctacgtgcctgagaagggcaccgtgggcgccagcggggacctggcccccctgagccacctggccctgggcctggtgggggagggcaagatgtggagccccaagagcggctgggcagatgccaagtatgtgctggaggcccacggcctgaagcctgtgatcctgaagcccaaggagggcctggccctgatcaatggcacccagatgatcaccagcctgggctgtgaggccgtggagcgggccagcgccatcgcccggcaggccgacatcgtggccgccctgaccctggaggtgctgaagggcaccaccaaggcctttgacacagacatccacgccctgcggccccaccggggccagatcgaggtggccttccgcttccgcagcctgctggacagcgaccaccaccccagcgagattgctgagagccaccgcttctgtgacagagtgcaggatgcctacaccctgcgctgctgcccccaggtgcacggcgtggtgaatgacaccatcgcctttgtgaagaacatcatcaccacagagctgaacagcgccacagacaaccccatggtgtttgccaacagaggagagaccgtgtctgggggcaacttccatggagagtacccagccaaggccctggactacctggccatcggcatccacgagctggccgccatcagcgagaggagaattgagcggctgtgcaaccccagcctgtctgagctgcctgccttcctggtggccgagggcggcctgaacagcggcttcatgattgcccactgcacagctgctgccctggtgtctgagaacaaggccctgtgccaccccagctctgtggacagcctgagcaccagcgctgccacagaagatcatgtgtccatgggcggctgggccgccaggaaggccctgcgggtcatcgagcacgtggagcaggtgctggccatcgagctgctggccgcctgccagggcatcgagttcctgcggcccctgaagaccaccacccccctggagaaggtgtatgacctggtgcgctctgtggtgcggccctggatcaaggaccgcttcatggccccagacatcgaggccgcccaccggctgctgctggagcagaaggtgtgggaggtggccgccccctacatcgagaagtacaggatggagcacatccctgagagccggcccctgagccccacagccttcagcctgcagttcctgcacaagaagagcaccaagatccctgagagcgaggacctgtag

SEQ ID NO: 19921 - DNA, 1776 bp, Artificial Sequence
  Description of Artificial Sequence: Synthetic coding sequence
atgccccgctacacagtgcacgtgcggggggagtggctggccgtgccctgccaggatgcccagctgactgtgggctggctgggccgggaggccgtgcggcgctacatcaagaacaagccagacaatggaggcttcacctctgtggatgatgcccacttcctggtgcggcgctgcaagggcctgggcctgctggacaatgaagatcggctggaggtggccctggagaacaatgaatttgtggaggtggtgattgaaggagatgccatgagcccagacttcatccccagccagcctgagggcgtgtacctgtacagcaagtaccgggagcctgagaagtacatcgagctggatggagaccggctgaccacagaggacctggtgaacctgggcaagggccgctacaagatcaagctgacccccacagctgagaagagggtgcagaagagccgggaggtgattgacagcatcatcaaggagaagacagtggtgtatggcatcaccaccggctttgggaagtttgccaggacagtcatccccatcaacaagctgcaggagctgcaggtgaacctggtgcgcagccacagcagcggcgtgggcaagcccctgagccctgagcgctgcaggatgctgctggccctgcgcatcaacgtgctggccaagggctacagcggcatcagcctggagaccctgaagcaggtgattgagatgtttaatgccagctgcctgccctacgtgcctgagaagggcaccgtgggcgccagcggggacctggcccccctgagccacctggccctgggcctggtgggggagggcaagatgtggagccccaagagcggctgggcagatgccaagtatgtgctggaggcccacggcctgaagcctgtgatcctgaagcccaaggagggcctggccctgatcaatggcacccagatgatcaccagcctgggctgtgaggccgtggagcgggccagcgccatcgcccggcaggccgacatcgtggccgccctgaccctggaggtgctgaagggcaccaccaaggcctttgacacagacatccacgccctgcggccccaccggggccagatcgaggtggccttccgcttccgcagcctgctggacagcgaccaccaccccagcgagattgctgagagccaccgcttctgtgacagagtgcaggatgcctacaccctgcgctgctgcccccaggtgcacggcgtggtgaatgacaccatcgcctttgtgaagaacatcatcaccacagagctgaacagcgccacagacaaccccatggtgtttgccaacagaggagagaccgtgtctgggggcaacttccatggagagtacccagccaaggccctggactacctggccatcggcatccacgagctggccgccatcagcgagaggagaattgagcggctgtgcaaccccagcctgtctgagctgcctgccttcctggtggccgagggcggcctgaacagcggcttcatgattgcccactgcacagctgctgccctggtgtctgagaacaaggccctgtgccaccccagctctgtggacagcctgagcaccagcgctgccacagaagatcatgtgtccatgggcggctgggccgccaggaaggccctgcgggtcatcgagcacgtggagcaggtgctggccatcgagctgctggccgcctgccagggcatcgagttcctgcggcccctgaagaccaccacccccctggagaaggtgtatgacctggtgcgctctgtggtgcgctttgggaagtag

SEQ ID NO: 19922 - DNA, 1350 bp, Artificial Sequence
  Description of Artificial Sequence: Synthetic coding sequence
atgctgctggccctgcgcatcaacgtgctggccaagggctacagcggcatcagcctggagaccctgaagcaggtgattgagatgtttaatgccagctgcctgccctacgtgcctgagaagggcaccgtgggcgccagcggggacctggcccccctgagccacctggccctgggcctggtgggggagggcaagatgtggagccccaagagcggctgggcagatgccaagtatgtgctggaggcccacggcctgaagcctgtgatcctgaagcccaaggagggcctggccctgatcaatggcacccagatgatcaccagcctgggctgtgaggccgtggagcgggccagcgccatcgcccggcaggccgacatcgtggccgccctgaccctggaggtgctgaagggcaccaccaaggcctttgacacagacatccacgccctgcggccccaccggggccagatcgaggtggccttccgcttccgcagcctgctggacagcgaccaccaccccagcgagattgctgagagccaccgcttctgtgacagagtgcaggatgcctacaccctgcgctgctgcccccaggtgcacggcgtggtgaatgacaccatcgcctttgtgaagaacatcatcaccacagagctgaacagcgccacagacaaccccatggtgtttgccaacagaggagagaccgtgtctgggggcaacttccatggagagtacccagccaaggccctggactacctggccatcggcatccacgagctggccgccatcagcgagaggagaattgagcggctgtgcaaccccagcctgtctgagctgcctgccttcctggtggccgagggcggcctgaacagcggcttcatgattgcccactgcacagctgctgccctggtgtctgagaacaaggccctgtgccaccccagctctgtggacagcctgagcaccagcgctgccacagaagatcatgtgtccatgggcggctgggccgccaggaaggccctgcgggtcatcgagcacgtggagcaggtgctggccatcgagctgctggccgcctgccagggcatcgagttcctgcggcccctgaagaccaccacccccctggagaaggtgtatgacctggtgcgctctgtggtgcggccctggatcaaggaccgcttcatggccccagacatcgaggccgcccaccggctgctgctggagcagaaggtgtgggaggtggccgccccctacatcgagaagtacaggatggagcacatccctgagagccggcccctgagccccacagccttcagcctgcagttcctgcacaagaagagcaccaagatccctgagagcgaggacctgtag

SEQ ID NO: 19923 - DNA, 1260 bp, Artificial Sequence
  Description of Artificial Sequence: Synthetic coding sequence
atggccggctttggagccatggagaagttcctggtggagtacaagtctgctgtggagaagaagctggccgagtacaagtgcaacaccaacacagccatcgagctgaagctggtgcgcttccctgaggacctggagaatgacatccgcaccttcttccctgagtacacccaccagctgtttggagatgatgaaacagccttcggctacaagggcctgaagatcctgctgtactacatcgccggcagcctgagcaccatgttccgggtggagtatgccagcaaggtggatgaaaattttgactgtgtggaggctgatgatgtggagggcaagatccggcagatcatccccccaggcttctgcaccaacaccaatgacttcctgagcctgctggagaaggaggtggacttcaagcccttcggcaccctgctgcacacctacagcgtgctgagccccactggaggagagaacttcaccttccagatctacaaggctgacatgacctgccggggcttccgggagtaccacgagcggctgcagaccttcctgatgtggttcatcgagacagccagcttcattgatgtggatgatgagcgctggcactacttcctggtgtttgagaagtacaacaaggatggagccaccctgtttgccaccgtgggctacatgacagtgtacaactactacgtgtacccagacaagacccggccccgggtgtcccagatgctgatcctgacccccttccagggccagggccacggggcccagctgctggagaccgtgcaccgctactacacagagttccccaccgtgctggacatcacagctgaggaccccagcaagagctatgtgaagctgcgggactttgtgctggtgaagctgtgccaggacctgccctgcttcagccgggagaagctgatgcagggcttcaatgaagacatggccatcgaggcccagcagaagttcaagatcaacaagcagcacgccaggagagtgtatgagatcctgcggctgctggtgacagacatgtctgatgctgagcagtaccgcagctaccgcctggacatcaagagaagactcatcagcccctacaagaagaagcagagggacctggccaagatgaggaagtgcctgcggcctgaggagctgaccaaccagatgaaccagatcgagatctccatgcagcacgagcagctggaggagagcttccaggagctggtggaggactaccgccgggtgattgagcggctggcccaggagtag

SEQ ID NO: 19924 - DNA, 1005 bp, Artificial Sequence
  Description of Artificial Sequence: Synthetic coding sequence
atgttccgggtggagtatgccagcaaggtggatgagaactttgactgtgtggaggctgatgatgtggagggcaagatccggcagatcatccccccaggcttctgcaccaacaccaatgacttcctgagcctgctggagaaggaggtggacttcaagcccttcggcaccctgctgcacacctacagcgtgctgagccccactggaggagagaacttcaccttccagatctacaaggctgacatgacctgccggggcttccgggagtaccacgagcggctgcagaccttcctgatgtggttcattgaaacagccagcttcattgatgtggatgatgagcgctggcactacttcctggtgtttgagaagtacaacaaggatggagccaccctgtttgccaccgtgggctacatgacagtgtacaactactacgtgtacccagacaagacccggccccgggtgtcccagatgctgatcctgacccccttccagggccagggccatggagcccagctgctggagaccgtgcaccgctactacacagagttccccaccgtgctggacatcacagctgaggaccccagcaagagctatgtgaagctgcgggactttgtgctggtgaagctgtgccaggacctgccctgcttcagccgggagaagctgatgcagggcttcaatgaagacatggccatcgaggcccagcagaagttcaagatcaacaagcagcacgcccggcgggtgtatgagatcctgcggctgctggtgacagacatgtctgatgctgagcagtaccgcagctaccgcctggacatcaagaggaggctcatcagcccctacaagaagaagcagagggacctggccaagatgaggaagtgcctgcggcctgaggagctgaccaaccagatgaaccagatcgagatctccatgcagcacgagcagctggaggagagcttccaggagctggtggaggactacagaagagtcatcgagcggctggcccaggagtag

SEQ ID NO: 19925 - DNA, 870 bp, Artificial Sequence
  Description of Artificial Sequence: Synthetic coding sequence
atgacagtgtccttccacaagtacggggagtacttccctggcactggagacctgcgggacattggagctgggaagggcaagtactatgctgtgaactaccccctgagagatggcattgatgatgagagctatgaggccatcttcaagcctgtgatgagcaaggtgatggagatgttccagcccagcgctgtggtgctgcagtgtggcagtgacagcctgagcggggaccggctgggctgcttcaacctgaccatcaagggccacgccaagtgtgtggagtttgtgaagagcttcaacctgcccatgctgatgctgggcggcggcggctacaccatcagaaatgtggcccgctgctggacctatgaaacagctgtggccctggacacagagatccccaatgagctgccctacaatgactactttgagtacttcggccctgacttcaagctgcacatcagccccagcaacatgaccaaccagaacaccaatgagtacctggagaagatcaagcagaggctgtttgagaacctgaggatgctgccccacgcccctggggtgcagatgcaggccatcccagaagatgccatccctgaggagagcggagatgaagatgaagatgatcctgacaagaggatcagcatctgcagcagtgacaagagaattgcctgtgaggaggagttcagtgacagcgaggaggagggggagggcggcaggaagaacagcagcaacttcaagaaggccaagagggtgaagacagaagatgagaaggagaaggaccctgaggagaagaaggaggtgacagaggaggagaagaccaaggaggagaagccagaggccaagggcgtgaaggaggaggtgaagctggcctag

SEQ ID NO: 19926 - DNA, 1449 bp, Artificial Sequence
  Description of Artificial Sequence: Synthetic coding sequence
atggcccagacccagggcaccaggaggaaggtgtgctactactatgatggagatgtgggcaactactactacggccagggccaccccatgaagccccaccgcatccgcatgacccacaacctgctgctgaactacggcctgtacaggaagatggagatctaccggccccacaaggccaatgctgaggagatgaccaagtaccacagtgatgactacatcaagttcctgcggagcatccggccagacaacatgtctgagtacagcaagcagatgcagcgcttcaacgtgggggaggactgccctgtgtttgatggcctgtttgagttctgccagctgagcactggaggctctgtggccagcgctgtgaagctgaacaagcagcagacagacattgctgtgaactgggccggcggcctgcaccacgccaagaagtctgaggccagcggcttctgctacgtgaatgacatcgtgctggccatcctggagctgctgaagtaccaccagagggtgctgtacattgatattgacatccaccacggagatggagtggaggaggccttctacaccacagacagagtgatgacagtgtccttccacaagtatggagagtacttccctggcaccggggacctgcgggacatcggggccggcaagggcaagtactatgctgtgaactaccccctgagagatggcattgatgatgagagctatgaggccatcttcaagcctgtgatgagcaaggtgatggagatgttccagcccagcgctgtggtgctgcagtgtggcagtgacagcctgagcggggaccggctgggctgcttcaacctgaccatcaagggccacgccaagtgtgtggagtttgtgaagagcttcaacctgcccatgctgatgctgggcggcggcggctacaccatcagaaatgtggcccgctgctggacctatgaaacagctgtggccctggacacagagatccccaatgagctgccctacaatgactactttgagtactttggaccagacttcaagctgcacatcagccccagcaacatgaccaaccagaacaccaatgagtacctggagaagatcaagcagaggctgtttgagaacctgaggatgctgccccacgcccctggggtgcagatgcaggccatcccagaagatgccatccctgaggagagcggagatgaagatgaagatgatcctgacaagaggatcagcatctgcagcagtgacaagagaattgcctgtgaggaggagttcagtgacagcgaggaggagggggagggcggcaggaagaacagcagcaacttcaagaaggccaagagggtgaagacagaagatgagaaggagaaggaccctgaggagaagaaggaggtgacagaggaggagaagaccaaggaggagaagccagaggccaagggcgtgaaggaggaggtgaagctggcctag

SEQ ID NO: 19927 - DNA, 636 bp, Artificial Sequence
  Description of Artificial Sequence: Synthetic coding sequence
atggcccagacccagggcaccaggaggaaggtgtgctactactatgatggagatgtgggcaactactactacggccagggccaccccatgaagccccaccgcatccgcatgacccacaacctgctgctgaactacggcctgtacaggaagatggagatctaccggccccacaaggccaatgctgaggagatgaccaagtaccacagtgatgactacatcaagttcctgcggagcatccggccagacaacatgtctgagtacagcaagcagatgcagaggagcagcgctgtgaagctgaacaagcagcagacagacattgctgtgaactgggccggcggcctgcaccacgccaagaagtctgaggccagcggcttctgctacgtgaatgacatcgtgctggccatcctggagctgctgaagtaccaccagagggtgctgtacatcgacatcgacatccaccacggagatggagtggaggaggccttctacaccacagacagagtgatgacagtgtccttccacaagtacggggagtacttccctggcactggagacctgcgggacattggagctgggaagggcaagtactatgctgtgaactaccccctgagagatggcattgatgatgagagctag

SEQ ID NO: 19928 - DNA, 1044 bp, Artificial Sequence
  Description of Artificial Sequence: Synthetic coding sequence
atgctgcacaccacccagctgtaccagcacgtgcctgagacccgctggcccatcgtgtacagcccccgctacaacatcaccttcatgggcctggagaagctgcacccctttgatgctgggaagtggggcaaggtgatcaacttcctgaaggaggagaagctgctgagtgacagcatgctggtggaggcccgggaggccagcgaggaggacctgctggtggtgcacacccggcgctacctgaatgagctgaagtggagctttgctgtggccaccatcacagagatcccccctgtgatcttcctgcccaacttcctggtgcagaggaaggtgctgcggcccctgcggacccagacaggaggcaccatcatggccggcaagctggccgtggagcggggctgggccatcaacgtgggcggcggcttccaccactgcagcagtgacagaggaggcggcttctgtgcctatgctgacatcaccctggccatcaagttcctgtttgagcgggtggagggcatcagccgggccaccatcatcgacctggatgcccaccagggcaatggccacgagcgggacttcatggatgacaagagggtgtacatcatggatgtgtacaacagacacatctacccaggggacagatttgccaagcaggccatccggaggaaggtggagctggagtggggcacagaagatgatgagtacctggacaaggtggagaggaacatcaagaagagcctgcaggagcacctgcctgatgtggtggtgtacaatgccggcacagacatcctggagggggaccggctgggcggcctgagcatcagccctgctggcatcgtgaagagagatgagctggtgttcaggatggtgcggggccggcgggtgcccatcctgatggtgaccagcggcggctaccagaagaggacagcccgcatcatcgctgacagcatcctgaacctgtttggcctgggcctgattggccctgagagccccagcgtgtctgcccagaacagcgacacccccctgctgcccccagctgtgccctag

SEQ ID NO: 19929 - DNA, 711 bp, Artificial Sequence
  Description of Artificial Sequence: Synthetic coding sequence
atgggcctggagaagctgcacccctttgatgctgggaagtggggcaaggtgatcaacttcctgaaggaggagaagctgctgagtgacagcatgctggtggaggcccgggaggccagcgaggaggacctgctggtggtgcacacccggcgctacctgaatgagctgaagtggagctttgctgtggccaccatcacagagatcccccctgtgatcttcctgcccaacttcctggtgcagaggaaggtgctgcggcccctgcggacccagacaggaggcaccatcatgggcgtggccagcaccacagccccagccaccgtggccggggcctctgtgcccatgaggaccagccgcagccccagcagcttctgcctgtctgtgtggagggccagccctggcctgcccagcctcatcctgatgcccatccgggccatgggcatgtctgagacctcctggaccacctctgtgtgcacctcctggatgagcaccacagccaccagcacccagggcacagccctgcccagccggcccagcggcggccgctggagctggagcggggcccagaggatgatgagcacctggatccgctggaggggcaccagcaggaaccccagccgcagcacctgccccacctggtggtacaccatgcaggcccccaccagcagccggggcacagccctgggcggctgccccagcgcccagagggccagctag

SEQ ID NO: 19930 - DNA, 960 bp, Artificial Sequence
  Description of Artificial Sequence: Synthetic coding sequence
atgggcctggagaagctgcacccctttgatgctgggaagtggggcaaggtgatcaacttcctgaaggaggagaagctgctgagtgacagcatgctggtggaggcccgggaggccagcgaggaggacctgctggtggtgcacacccggcgctacctgaatgagctgaagtggagctttgctgtggccaccatcacagagatcccccctgtgatcttcctgcccaacttcctggtgcagaggaaggtgctgcggcccctgcggacccagacaggaggcaccatcatggccggcaagctggccgtggagcggggctgggccatcaacgtgggcggcggcttccaccactgcagcagtgacagaggaggcggcttctgtgcctatgctgacatcaccctggccatcaagttcctgtttgagcgggtggagggcatcagccgggccaccatcatcgacctggatgcccaccagggcaatggccacgagcgggacttcatggatgacaagagggtgtacatcatggatgtgtacaacagacacatctacccaggggacagatttgccaagcaggccatccggaggaaggtggagctggagtggggcacagaagatgatgagtacctggacaaggtggagaggaacatcaagaagagcctgcaggagcacctgcctgatgtggtggtgtacaatgccggcacagacatcctggagggggaccggctgggcggcctgagcatcagccctgctggcatcgtgaagagagatgagctggtgttcaggatggtgcggggccggcgggtgcccatcctgatggtgaccagcggcggctaccagaagaggacagcccgcatcatcgctgacagcatcctgaacctgtttggcctgggcctgattggccctgagagccccagcgtgtctgcccagaacagcgacacccccctgctgcccccagctgtgccctag

SEQ ID NO: 19931 - DNA, 468 bp, Artificial Sequence
  Description of Artificial Sequence: Synthetic coding sequence
atggatgacaagagggtgtacatcatggatgtgtacaacagacacatctacccaggggacagatttgccaagcaggccatccggaggaaggtggagctggagtggggcacagaagatgatgagtacctggacaaggtggagaggaacatcaagaagagcctgcaggagcacctgcctgatgtggtggtgtacaatgccggcacagacatcctggagggggaccggctgggcggcctgagcatcagccctgctggcatcgtgaagagagatgagctggtgttcaggatggtgcggggccggcgggtgcccatcctgatggtgaccagcggcggctaccagaagaggacagcccgcatcatcgctgacagcatcctgaacctgtttggcctgggcctgattggccctgagagccccagcgtgtctgcccagaacagcgacacccccctgctgcccccagctgtgccctag

SEQ ID NO: 19932 - DNA, 891 bp, Artificial Sequence
  Description of Artificial Sequence: Synthetic coding sequence
atgggcctggagaagctgcacccctttgatgctgggaagtggggcaaggtgatcaacttcctgaaggaggagaagctgctgagtgacagcatgctggtggaggcccgggaggccagcgaggaggacctgctggtggtgcacacccggcgctacctgaatgagctgaagaggaaggtgctgcggcccctgcggacccagacaggaggcaccatcatggccggcaagctggccgtggagcggggctgggccatcaacgtgggcggcggcttccaccactgcagcagtgaccggggcggcggcttctgtgcctatgctgacatcaccctggccatcaagttcctgtttgagcgggtggagggcatcagccgggccaccatcatcgacctggatgcccaccagggcaatggacatgagcgggacttcatggatgacaagagggtgtacatcatggatgtgtacaacagacacatctacccaggggacagatttgccaagcaggccatccggaggaaggtggagctggagtggggcacagaagatgatgagtacctggacaaggtggagaggaacatcaagaagagcctgcaggagcacctgcctgatgtggtggtgtacaatgccggcacagacatcctggagggggaccggctgggcggcctgagcatcagccctgctggcatcgtgaagagagatgagctggtgttcaggatggtgcggggcagaagagtgcccatcctgatggtgaccagcggcggctaccagaagaggacagcccgcatcatcgctgacagcatcctgaacctgtttggcctgggcctcatcggccctgagagccccagcgtgtctgcccagaacagcgacacccccctgctgcccccagctgtgccctag

SEQ ID NO: 19933 - DNA, 1377 bp, Artificial Sequence
  Description of Artificial Sequence: Synthetic coding sequence
atgaagccccaccgcatccgcatgacccacaacctgctgctgaactacggcctgtacaggaagatggagatctaccggccccacaaggccacagctgaggagatgaccaagtaccacagtgatgagtacatcaagttcctgcggagcatccggccagacaacatgtctgagtacagcaagcagatgcagcgcttcaacgtgggggaggactgccctgtgtttgatggcctgtttgagttctgccagctgagcactggaggctctgtggccggggctgtgaagctgaaccggcagcagacagacatggctgtgaactgggccggcggcctgcaccacgccaagaagtctgaggccagcggcttctgctacgtgaatgacatcgtgctggccatcctggagctgctgaagtaccaccagagggtgctgtacatcgacatcgacatccaccacggagatggagtggaggaggccttctacaccacagacagagtgatgacagtgtccttccacaagtacggggagtacttccctggcactggagacctgcgggacattggagctgggaagggcaagtactatgctgtgaacttccccatgagagatggcattgatgatgagagctatggccagatcttcaagcccatcatcagcaaggtgatggagatgtaccagcccagcgctgtggtgctgcagtgtggggctgacagcctgagcggggaccggctgggctgcttcaacctgactgtgaagggccacgccaagtgtgtggaggtggtgaagaccttcaacctgcccctgctgatgctgggcggcggcggctacaccatcagaaatgtggcccgctgctggacctatgaaacagctgtggccctggactgtgagatccccaatgagctgccctacaatgactactttgagtacttcggccctgacttcaagctgcacatcagccccagcaacatgaccaaccagaacaccccagagtacatggagaagatcaagcagaggctgtttgagaacctgaggatgctgccccacgcccctggggtgcagatgcaggccatcccagaagatgctgtgcatgaggacagcggagatgaagatggagaggaccctgacaagaggatcagcatccgggccagtgacaagagaattgcctgtgatgaggagttcagtgacagtgaagatgaaggagagggcggcagaagaaatgtggccgaccacaagaagggggccaagaaggccagaattgaggaggacaagaaggagacagaggacaagaagacagatgtgaaggaggaggacaagagcaaggacaacagcggggagaagacagacaccaagggcaccaagtctgagcagctgagcaacccctag

SEQ ID NO: 19934 - DNA, 1749 bp, Artificial Sequence
  Description of Artificial Sequence: Synthetic coding sequence
atgaggagccccccctgtggcctgctgcgctggtttggaggccccctgctggcctcctggtgccgctgccacctgcgcttccgggccttcggcaccagcgctggctggtaccgggccttccctgcccccccacccctgctgcccccagcctgccccagcccccgggactaccggccccacgtgtccctgagccccttcctgagccggcccagcagaggaggcagcagcagcagcagcagcagcagaagaagaagccctgtggccgctgtggccggggagcccatggcctacagccagggcggcggcaagaagaaggtgtgctactactatgatggagacatcggcaactactactacggccagggccaccccatgaagccccaccgcatccgcatgacccacaacctgctgctgaactacggcctgtacaggaagatggagatctaccggccccacaaggccacagctgaggagatgaccaagtaccacagtgatgagtacatcaagttcctgcggagcatccggccagacaacatgtctgagtacagcaagcagatgcagcgcttcaacgtgggggaggactgccctgtgtttgatggcctgtttgagttctgccagctgagcactggaggctctgtggccggggctgtgaagctgaaccggcagcagacagacatggctgtgaactgggccggcggcctgcaccacgccaagaagtctgaggccagcggcttctgctacgtgaatgacatcgtgctggccatcctggagctgctgaagtaccaccagagggtgctgtacatcgacatcgacatccaccacggagatggagtggaggaggccttctacaccacagacagagtgatgacagtgtccttccacaagtacggggagtacttccctggcactggagacctgcgggacattggagctgggaagggcaagtactatgctgtgaacttccccatgagagatggcattgatgatgagagctatggccagatcttcaagcccatcatcagcaaggtgatggagatgtaccagcccagcgctgtggtgctgcagtgtggggctgacagcctgagcggggaccggctgggctgcttcaacctgactgtgaagggccacgccaagtgtgtggaggtggtgaagaccttcaacctgcccctgctgatgctgggcggcggcggctacaccatcagaaatgtggcccgctgctggacctatgaaacagctgtggccctggactgtgagatccccaatgagctgccctacaatgactactttgagtacttcggccctgacttcaagctgcacatcagccccagcaacatgaccaaccagaacaccccagagtacatggagaagatcaagcagaggctgtttgagaacctgaggatgctgccccacgcccctggggtgcagatgcaggccatcccagaagatgctgtgcatgaggacagcggagatgaagatggagaggaccctgacaagaggatcagcatccgggccagtgacaagagaattgcctgtgatgaggagttcagtgacagtgaagatgaaggagagggcggcagaagaaatgtggccgaccacaagaagggggccaagaaggccagaattgaggaggacaagaaggagacagaggacaagaagacagatgtgaaggaggaggacaagagcaaggacaacagcggggagaagacagacaccaagggcaccaagtctgagcagctgagcaacccctag

SEQ ID NO: 19935 - DNA, 1467 bp, Artificial Sequence
  Description of Artificial Sequence: Synthetic coding sequence
atggcctacagccagggcggcggcaagaagaaggtgtgctactactatgatggagacatcggcaactactactacggccagggccaccccatgaagccccaccgcatccgcatgacccacaacctgctgctgaactacggcctgtacaggaagatggagatctaccggccccacaaggccacagctgaggagatgaccaagtaccacagtgatgagtacatcaagttcctgcggagcatccggccagacaacatgtctgagtacagcaagcagatgcagcgcttcaacgtgggggaggactgccctgtgtttgatggcctgtttgagttctgccagctgagcactggaggctctgtggccggggctgtgaagctgaaccggcagcagacagacatggctgtgaactgggccggcggcctgcaccacgccaagaagtctgaggccagcggcttctgctacgtgaatgacatcgtgctggccatcctggagctgctgaagtaccaccagagggtgctgtacatcgacatcgacatccaccacggagatggagtggaggaggccttctacaccacagacagagtgatgacagtgtccttccacaagtacggggagtacttccctggcactggagacctgcgggacattggagctgggaagggcaagtactatgctgtgaacttccccatgagagatggcattgatgatgagagctatggccagatcttcaagcccatcatcagcaaggtgatggagatgtaccagcccagcgctgtggtgctgcagtgtggggctgacagcctgagcggggaccggctgggctgcttcaacctgactgtgaagggccacgccaagtgtgtggaggtggtgaagaccttcaacctgcccctgctgatgctgggcggcggcggctacaccatcagaaatgtggcccgctgctggacctatgaaacagctgtggccctggactgtgagatccccaatgagctgccctacaatgactactttgagtacttcggccctgacttcaagctgcacatcagccccagcaacatgaccaaccagaacaccccagagtacatggagaagatcaagcagaggctgtttgagaacctgaggatgctgccccacgcccctggggtgcagatgcaggccatcccagaagatgctgtgcatgaggacagcggagatgaagatggagaggaccctgacaagaggatcagcatccgggccagtgacaagagaattgcctgtgatgaggagttcagtgacagtgaagatgaaggagagggcggcagaagaaatgtggccgaccacaagaagggggccaagaaggccagaattgaggaggacaagaaggagacagaggacaagaagacagatgtgaaggaggaggacaagagcaaggacaacagcggggagaagacagacaccaagggcaccaagtctgagcagctgagcaacccctag

SEQ ID NO: 19936 - DNA, 1377 bp, Artificial Sequence; identical to SEQ ID NO: 19933
  Description of Artificial Sequence: Synthetic coding sequence

SEQ ID NO: 19937 - DNA, 1287 bp, Artificial Sequence
  Description of Artificial Sequence: Synthetic coding sequence
atggccaagacagtggcctacttctatgaccctgatgtgggcaacttccactacggggccggccaccccatgaagccccaccggctggccctgacccacagcctggtgctgcactacggcctgtacaagaagatgattgtgttcaagccctaccaggccagccagcacgacatgtgccgcttccacagcgaggactacatcgacttcctgcagagggtgagccccaccaacatgcagggcttcaccaagagcctgaatgccttcaacgtgggagatgactgccctgtgtttcctggcctgtttgagttctgcagccgctacaccggggccagcctgcagggcgccacccagctgaacaacaagatctgtgacatcgccatcaactgggccggcggcctgcaccacgccaagaagtttgaggccagcggcttctgctacgtgaatgacatcgtcatcggcatcctggagctgctgaagtaccacccccgggtgctgtacattgatattgacatccaccacggagatggagtgcaggaggccttctacctgacagacagagtgatgacagtgtccttccacaagtatggcaactacttcttccctggcactggagacatgtatgaggtgggcgctgagagcggccgctactactgcctgaatgtgcccctgagagatggcattgatgaccagagctacaagcacctgttccagcccgtcatcaaccaggtggtggacttctaccagcccacctgcatcgtgctgcagtgtggggctgacagcctgggctgtgaccggctgggctgcttcaacctgagcatccggggccacggggagtgtgtggagtatgtgaagagcttcaacatccccctgctggtgctgggcggcggcggctacacagtgagaaatgtggcccgctgctggacctatgagaccagcctgctggtggaggaggccatcagcgaggagctgccctacagcgagtactttgagtactttgccccagacttcaccctgcacccagatgtgtccaccagaattgagaaccagaacagccggcagtacctggaccagatccggcagaccatctttgagaacctgaagatgctgaaccacgcccccagcgtgcagatccatgatgtgcctgctgacctgctgacctatgacagaacagatgaagcagatgctgaggagcggggccctgaggagaactacagcaggcctgaggccccaaatgagttctatgatggagaccatgacaatgacaaggagagtgatgtggagatctag

SEQ ID NO: 19938 - DNA, 3255 bp, Artificial Sequence
  Description of Artificial Sequence: Synthetic coding sequence
atgagcagccagagccacccagatggcctgagcggccgggaccagcctgtggagctgctgaacccagcccgggtgaaccacatgcccagcacagtggatgtggccacagccctgcccctgcaggtggcccccagcgctgtgcccatggacctgcggctggaccaccagttcagcctgcctgtggccgagcccgccctgcgggagcagcagctgcagcaggagctgctggccctgaagcagaagcagcagatccagaggcagatcctgattgctgagttccagaggcagcacgagcagctgagccggcagcacgaggcccagctgcacgagcacatcaagcagcagcaggagatgctggccatgaagcaccagcaggagctgctggagcaccagaggaagctggagcggcaccggcaggagcaggagctggagaagcagcaccgggagcagaagctgcagcagctgaagaacaaggagaagggcaaggagagcgctgtggccagcacagaggtgaagatgaagctgcaggagtttgtgctgaacaagaagaaggccctggcccacaggaacctgaaccactgcatcagcagtgacccccgctactggtacggcaagacccagcacagcagcctggaccagagcagccccccccagagcggcgtgtccaccagctacaaccaccctgtgctgggcatgtatgatgccaaggatgacttccccctgaggaagacagccagcgagcccaacctgaagctgcggagccggctgaagcagaaggtggccgagaggaggagcagccccctgctgcggaggaaggatggccctgtggtgacagccctgaagaagaggcccctggatgtgacagacagcgcctgcagcagcgcccctggcagcggccccagcagccccaacaacagcagcggctctgtgtctgcagaaaatggcatcgccccagctgtgcccagcatcccagctgagaccagcctggcccaccggctggtggcccgggagggcagcgctgcccccctgcccctgtacaccagccccagcctgcccaacatcaccctgggcctgcctgccaccggccccagcgctggaacagctggccagcaggatgctgagcggctgaccctgcctgccctgcagcagaggctgagcctcttccctggcacccacctgaccccctacctgagcaccagccccctggagagagatggaggagctgcccacagccccctgctgcagcacatggtgctgctggagcagcccccagcccaggcccccctggtgacaggcctgggcgccctgcccctgcacgcccagagcctggtgggcgctgacagagtgagccccagcatccacaagctgcggcagcaccggcccctgggccgcacccagagcgcccccctgccccagaatgcccaggccctgcagcacctggtgatccagcagcagcaccagcagttcctggagaagcacaagcagcagttccagcagcagcagctgcagatgaacaagatcatccccaagcccagcgagcccgcccggcagcctgagagccaccctgaggagacagaggaggagctgcgggagcaccaggccctgctggatgagccctacctggaccggctgcccggccagaaggaggcccacgcccaggccggcgtgcaggtgaagcaggagcccattgaaagtgatgaggaggaggccgagcccccccgggaggtggagcccggccagaggcagcccagcgagcaggagctgctcttccggcagcaggccctgctgctggagcagcagaggatccaccagctgaggaactaccaggcctccatggaggccgccggcatccctgtgtcctttggaggccaccggcccctgagccgggcccagagcagccctgccagcgccaccttccctgtgtctgtgcaggagccccccaccaagccccgcttcaccaccggcctggtgtatgacaccctgatgctgaagcaccagtgcacctgtggcagcagcagcagccaccctgagcacgccggccgcatccagagcatctggagccggctgcaggagaccggcctgcggggcaaatgtgagtgcatccggggcaggaaggccaccctggaggagctgcagacagtgcacagcgaggcccacaccctgctgtatggcaccaaccccctgaaccggcagaagctggacagcaagaagctgctgggcagcctggcctctgtgtttgtgcggctgccctgtggcggcgtgggcgtggacagcgacaccatctggaatgaggtgcacagcgctggggccgcccggctggccgtgggctgtgtggtggagctggtgttcaaggtggccactggagagctgaagaatggatttgctgtggtgcggcccccaggccaccacgccgaggagagcacccccatgggcttctgctacttcaacagcgtggccgtggccgccaagctgctgcagcagaggctgtctgtgtccaagatcctgattgtggactgggatgtgcaccacggcaatggcacccagcaggccttctacagcgaccccagcgtgctgtacatgagcctgcacagatatgatgatggcaacttcttccctggcagcggggccccagatgaggtgggcaccggccctggggtgggcttcaacgtgaacatggccttcaccggcggcctggacccccccatgggagatgctgagtacctggccgccttcagaacagtggtgatgcccatcgccagcgagtttgccccagatgtggtgctggtgagcagcggctttgatgctgtggagggccaccccacccccctgggcggctacaacctgagcgcccgctgcttcggctacctgaccaagcagctgatgggcctggccggcggccgcatcgtgctggccctggagggcggccatgacctgacagccatctgtgatgccagcgaggcctgtgtgtctgccctgctgggcaatgagctggaccccctgcctgagaaggtgctgcagcagaggcccaatgccaatgctgtgcgctccatggagaaggtgatggagatccacagcaagtactggcgctgcctgcagaggaccaccagcacagctggccgcagcctgattgaggcccagacctgtgaaaatgaggaggccgagaccgtgacagccatggccagcctgtctgtgggcgtgaagccagctgagaagaggccagatgaggagcccatggaggaggagccccccctgtag

SEQ ID NO: 19939 - DNA, 1941 bp, Artificial Sequence
  Description of Artificial Sequence: Synthetic coding sequence
atgctggccatgaagcaccagcaggagctgctggagcaccagaggaagctggagcggcaccggcaggagcaggagctggagaagcagcaccgggagcagaagctgcagcagctgaagaacaaggagaagggcaaggagagcgctgtggccagcacagaggtgaagatgaagctgcaggagtttgtgctgaacaagaagaaggccctggcccacaggaacctgaaccactgcatcagcagtgacccccgctactggtacggcaagacccagcacagcagcctggaccagagcagccccccccagagcggcgtgtccaccagctacaaccaccctgtgctgggcatgtatgatgccaaggatgacttccccctgaggaagacagccagcgagcccaacctgaagctgcggagccggctgaagcagaaggtggccgagcggcgcagcagccccctgctgcggaggaaggatggccctgtggtgacagccctgaagaagaggcccctggatgtgacagattctgcctgcagcagcgcccctggcagcggccccagcagccccaacaacagcagcggctctgtgtctgcagaaaatggaattgccccagctgtgcccagcatcccagctgagaccagcctggcccaccggctggtggcccgggagggcagcgctgcccccctgcccctgtacaccagccccagcctgcccaacatcaccctgggcctgcctgccaccggccccagcgctggaacagctggccagcaggatgctgagcggctgaccctgcctgccctgcagcagaggctgagcctcttccctggcacccacctgaccccctacctgagcaccagccccctggagagagatggaggagctgcccacagccccctgctgcagcacatggtgctgctggagcagcccccagcccaggcccccctggtgacaggcctgggcgccctgcccctgcacgcccagagcctggtgggcgctgacagagtgagccccagcatccacaagctgcggcagcaccggcccctgggccgcacccagagcgcccccctgccccagaatgcccaggccctgcagcacctggtgatccagcagcagcaccagcagttcctggagaagcacaagcagcagttccagcagcagcagctgcagatgaacaagatcatccccaagcccagcgagcccgcccggcagcctgagagccaccctgaggagacagaggaggagctgcgggagcaccaggccctgctggatgagccctacctggaccggctgcccggccagaaggaggcccacgcccaggccggcgtgcaggtgaagcaggagcccatcgagagtgatgaggaggaggccgagcccccccgggaggtggagcccggccagaggcagcccagcgagcaggagctgctcttccggcagcaggccctgctgctggagcagcagaggatccaccagctgaggaactaccaggcctccatggaggccgccggcatccctgtgtcctttggaggccaccggcccctgagccgggcccagagcagccctgccagcgccaccttccctgtgtctgtgcaggagccccccaccaagccccgcttcaccaccggcctggtgtatgacaccctgatgctgaagcaccagtgcacctgtggcagcagcagcagccaccctgagcacgccggccgcatccagagcatctggagccggctgcaggagaccggcctgcggggcaaatgtgagtgcatccggggcaggaaggccaccctggaggagctgcagacagtgcacagcgaggcccacaccctgctgtatggcaccaaccccctgaaccggcagaagctggacagcaagaagctgctgggcagcctggcctctgtgtttgtgcggctgccctgtggcggcgtgggcgtgtctgtgcccctgatgtgcaagtag

SEQ ID NO: 19940 - DNA, 2919 bp, Artificial Sequence
  Description of Artificial Sequence: Synthetic coding sequence
atgctggccatgaagcaccagcaggagctgctggagcaccagaggaagctggagcggcaccggcaggagcaggagctggagaagcagcaccgggagcagaagctgcagcagctgaagaacaaggagaagggcaaggagagcgctgtggccagcacagaggtgaagatgaagctgcaggagtttgtgctgaacaagaagaaggccctggcccacaggaacctgaaccactgcatcagcagtgacccccgctactggtacggcaagacccagcacagcagcctggaccagagcagccccccccagagcggcgtgtccaccagctacaaccaccctgtgctgggcatgtatgatgccaaggatgacttccccctgaggaagacagccagcgagcccaacctgaagctgcggagccggctgaagcagaaggtggccgagcggcgcagcagccccctgctgcggaggaaggatggccctgtggtgacagccctgaagaagaggcccctggatgtgacagattctgcctgcagcagcgcccctggcagcggccccagcagccccaacaacagcagcggctctgtgtctgcagaaaatggaattgccccagctgtgcccagcatcccagctgagaccagcctggcccaccggctggtggcccgggagggcagcgctgcccccctgcccctgtacaccagccccagcctgcccaacatcaccctgggcctgcctgccaccggccccagcgctggaacagctggccagcaggatgctgagcggctgaccctgcctgccctgcagcagaggctgagcctcttccctggcacccacctgaccccctacctgagcaccagccccctggagagagatggaggagctgcccacagccccctgctgcagcacatggtgctgctggagcagcccccagcccaggcccccctggtgacagactggtacctgagcggcctgggcgccctgcccctgcacgcccagagcctggtgggcgctgacagagtgagccccagcatccacaagctgcggcagcaccggcccctgggccgcacccagagcgcccccctgccccagaatgcccaggccctgcagcacctggtgatccagcagcagcaccagcagttcctggagaagcacaagcagcagttccagcagcagcagctgcagatgaacaagatcatccccaagcccagcgagcccgcccggcagcctgagagccaccctgaggagacagaggaggagctgcgggagcaccaggccctgctggatgagccctacctggaccggctgcccggccagaaggaggcccacgcccaggccggcgtgcaggtgaagcaggagcccattgaaagtgatgaggaggaggccgagcccccccgggaggtggagcccggccagaggcagcccagcgagcaggagctgctcttccggcagcaggccctgctgctggagcagcagaggatccaccagctgaggaactaccaggcctccatggaggccgccggcatccctgtgtcctttggaggccaccggcccctgagccgggcccagagcagccctgccagcgccaccttccctgtgtctgtgcaggagccccccaccaagccccgcttcaccaccggcctggtgtatgacaccctgatgctgaagcaccagtgcacctgtggcagcagcagcagccaccctgagcacgccggccgcatccagagcatctggagccggctgcaggagaccggcctgcggggcaaatgtgagtgcatccggggcaggaaggccaccctggaggagctgcagacagtgcacagcgaggcccacaccctgctgtatggcaccaaccccctgaaccggcagaagctggacagcaagaagctgctgggcagcctggcctctgtgtttgtgcggctgccctgtggcggcgtgggcgtggacagcgacaccatctggaatgaggtgcacagcgctggggccgcccggctggccgtgggctgtgtggtggagctggtgttcaaggtggccactggagagctgaagaatggatttgctgtggtgcggcccccaggccaccacgccgaggagagcacccccatgggcttctgctacttcaacagcgtggccgtggccgccaagctgctgcagcagaggctgtctgtgtccaagatcctgattgtggactgggatgtgcaccacggcaatggcacccagcaggccttctacagcgaccccagcgtgctgtacatgagcctgcacagatatgatgatggcaacttcttccctggcagcggggccccagatgaggtgggcaccggccctggggtgggcttcaacgtgaacatggccttcaccggcggcctggacccccccatgggagatgctgagtacctggccgccttcagaacagtggtgatgcccatcgccagcgagtttgccccagatgtggtgctggtgagcagcggctttgatgctgtggagggccaccccacccccctgggcggctacaacctgagcgcccgctgcttcggctacctgaccaagcagctgatgggcctggccggcggccgcatcgtgctggccctggagggcggccatgacctgacagccatctgtgatgccagcgaggcctgtgtgtctgccctgctgggcaatgagctggaccccctgcctgagaaggtgctgcagcagaggcccaatgccaatgctgtgcgctccatggagaaggtgatggagatccacagcaagtactggcgctgcctgcagaggaccaccagcacagctggccgcagcctgattgaggcccagacctgtgaaaatgaggaggccgagaccgtgacagccatggccagcctgtctgtgggcgtgaagccagctgagaagaggccagatgaggagcccatggaggaggagccccccctgtag

SEQ ID NO: 19941 - DNA, 2214 bp, Artificial Sequence
  Description of Artificial Sequence: Synthetic coding sequence
atggatgtggccacagccctgcccctgcaggtggcccccagcgctgtgcccatggacctgcggctggaccaccagttcagcctgcctgtggccgagcccgccctgcgggagcagcagctgcagcaggagctgctggccctgaagcagaagcagcagatccagaggcagatcctgattgctgagttccagaggcagcacgagcagctgagccggcagcacgaggcccagctgcacgagcacatcaagcagcagcaggagatgctggccatgaagcaccagcaggagctgctggagcaccagaggaagctggagcggcaccggcaggagcaggagctggagaagcagcaccgggagcagaagctgcagcagctgaagaacaaggagaagggcaaggagagcgctgtggccagcacagaggtgaagatgaagctgcaggagtttgtgctgaacaagaagaaggccctggcccacaggaacctgaaccactgcatcagcagtgacccccgctactggtacggcaagacccagcacagcagcctggaccagagcagccccccccagagcggcgtgtccaccagctacaaccaccctgtgctgggcatgtatgatgccaaggatgacttccccctgaggaagacagccagcgagcccaacctgaagctgcggagccggctgaagcagaaggtggccgagcggcgcagcagccccctgctgcggaggaaggatggccctgtggtgacagccctgaagaagaggcccctggatgtgacagattctgcctgcagcagcgcccctggcagcggccccagcagccccaacaacagcagcggctctgtgtctgcagaaaatggaattgccccagctgtgcccagcatcccagctgagaccagcctggcccaccggctggtggcccgggagggcagcgctgcccccctgcccctgtacaccagccccagcctgcccaacatcaccctgggcctgcctgccaccggccccagcgctggaacagctggccagcaggatgctgagcggctgaccctgcctgccctgcagcagaggctgagcctcttccctggcacccacctgaccccctacctgagcaccagccccctggagagagatggaggagctgcccacagccccctgctgcagcacatggtgctgctggagcagcccccagcccaggcccccctggtgacagactggtacctgagcggcctgggcgccctgcccctgcacgcccagagcctggtgggcgctgacagagtgagccccagcatccacaagctgcggcagcaccggcccctgggccgcacccagagcgcccccctgccccagaatgcccaggccctgcagcacctggtgatccagcagcagcaccagcagttcctggagaagcacaagcagcagttccagcagcagcagctgcagatgaacaagatcatccccaagcccagcgagcccgcccggcagcctgagagccaccctgaggagacagaggaggagctgcgggagcaccaggccctgctggatgagccctacctggaccggctgcccggccagaaggaggcccacgcccaggccggcgtgcaggtgaagcaggagcccattgaaagtgatgaggaggaggccgagcccccccgggaggtggagcccggccagaggcagcccagcgagcaggagctgctcttccggcagcaggccctgctgctggagcagcagaggatccaccagctgaggaactaccaggcctccatggaggccgccggcatccctgtgtcctttggaggccaccggcccctgagccgggcccagagcagccctgccagcgccaccttccctgtgtctgtgcaggagccccccaccaagccccgcttcaccaccggcctggtgtatgacaccctgatgctgaagcaccagtgcacctgtggcagcagcagcagccaccctgagcacgccggccgcatccagagcatctggagccggctgcaggagaccggcctgcggggcaaatgtgagtgcatccggggcaggaaggccaccctggaggagctgcagacagtgcacagcgaggcccacaccctgctgtatggcaccaaccccctgaaccggcagaagctggacagcaagaagctgctgggcagcctggcctctgtgtttgtgcggctgccctgtggcggcgtgggcgtgtctgtgcccctgatgtgcaagtag

SEQ ID NO: 19942 - DNA, 2007 bp, Artificial Sequence
  Description of Artificial Sequence: Synthetic coding sequence
atggtgctgctggagcagcccccagcccaggcccccctggtgacaggcctgggcgccctgcccctgcacgcccagagcctggtgggcgctgacagagtgagccccagcatccacaagctgcggcagcaccggcccctgggccgcacccagagcgcccccctgccccagaatgcccaggccctgcagcacctggtgatccagcagcagcaccagcagttcctggagaagcacaagcagcagttccagcagcagcagctgcagatgaacaagatcatccccaagcccagcgagcccgcccggcagcctgagagccaccctgaggagacagaggaggagctgcgggagcaccaggccctgctggatgagccctacctggaccggctgcccggccagaaggaggcccacgcccaggccggcgtgcaggtgaagcaggagcccattgaaagtgatgaggaggaggccgagcccccccgggaggtggagcccggccagaggcagcccagcgagcaggagctgctcttccggcagcaggccctgctgctggagcagcagaggatccaccagctgaggaactaccaggcctccatggaggccgccggcatccctgtgtcctttggaggccaccggcccctgagccgggcccagagcagccctgccagcgccaccttccctgtgtctgtgcaggagccccccaccaagccccgcttcaccaccggcctggtgtatgacaccctgatgctgaagcaccagtgcacctgtggcagcagcagcagccaccctgagcacgccggccgcatccagagcatctggagccggctgcaggagaccggcctgcggggcaaatgtgagtgcatccggggcaggaaggccaccctggaggagctgcagacagtgcacagcgaggcccacaccctgctgtatggcaccaaccccctgaaccggcagaagctggacagcaagaagctgctgggcagcctggcctctgtgtttgtgcggctgccctgtggcggcgtgggcgtggacagcgacaccatctggaatgaggtgcacagcgctggggccgcccggctggccgtgggctgtgtggtggagctggtgttcaaggtggccactggagagctgaagaatggatttgctgtggtgcggcccccaggccaccacgccgaggagagcacccccatgggcttctgctacttcaacagcgtggccgtggccgccaagctgctgcagcagaggctgtctgtgtccaagatcctgattgtggactgggatgtgcaccacggcaatggcacccagcaggccttctacagcgaccccagcgtgctgtacatgagcctgcacagatatgatgatggcaacttcttccctggcagcggggccccagatgaggtgggcaccggccctggggtgggcttcaacgtgaacatggccttcaccggcggcctggacccccccatgggagatgctgagtacctggccgccttcagaacagtggtgatgcccatcgccagcgagtttgccccagatgtggtgctggtgagcagcggctttgatgctgtggagggccaccccacccccctgggcggctacaacctgagcgcccgctgcttcggctacctgaccaagcagctgatgggcctggccggcggccgcatcgtgctggccctggagggcggccatgacctgacagccatctgtgatgccagcgaggcctgtgtgtctgccctgctgggcaatgagctggaccccctgcctgagaaggtgctgcagcagaggcccaatgccaatgctgtgcgctccatggagaaggtgatggagatccacagcaagtactggcgctgcctgcagaggaccaccagcacagctggccgcagcctgattgaggcccagacctgtgaaaatgaggaggccgagaccgtgacagccatggccagcctgtctgtgggcgtgaagccagctgagaagaggccagatgaggagcccatggaggaggagccccccctgtag

SEQ ID NO: 19943 - DNA, 90 bp, Artificial Sequence
  Description of Artificial Sequence: Synthetic coding sequence
atgagcagccagagccacccagatggcctgagcggccgggaccagcctgtggagctgctgaacccagcccgggtgaaccacatgccctag

SEQ ID NO: 19944 - DNA, 3648 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctggccgacacctatgattctgtgtacctgcaccccaacagctacagctgtgcctgcctggccagcggctctgtgctgcggctggtggatgctgtgctgggcgctgagatcagaaatggcatggccatcatccggcccccaggccaccacgcccagcacagcctgatggatggctactgcatgttcaaccacgtggccgtggccgcccgctatgcccagcagaagcaccgcatcagaagagtgctgattgtggactgggatgtgcaccacggccagggcacccagttcacctttgaccaggaccccagcgtgctgtacttcagcatccacagatatgagcagggccgcttctggccccacctgaaggccagcaactggagcaccactggatttggccagggccagggctacaccatcaacgtgccctggaaccaggtgggcatgagagatgctgactacatcgccgccttcctgcacgtgctgctgcctgtggccctggagttccagccccagctggtgctggtggccgccggctttgatgccctgcagggcgaccccaagggggagatggccgccaccccagctggctttgcccagctgacccacctgctgatgggcctggccggcggcaagctgatcctgagcctggagggcggctacaacctgcgggccctggccgagggcgtgtctgccagcctgcacaccctgctgggggacccctgccccatgctggagagccctggggccccctgccgcagcgcccaggcctctgtgtcctgtgccctggaggccctggagcccttctgggaggtgctggtgcgcagcacagagaccgtggagcgggacaacatggaggaggacaacgtggaggagagcgaggaggagggcccctgggagccccctgtgctgcccatcctgacctggcctgtgctgcagagcaggacaggcctggtgtatgaccagaacatgatgaaccactgcaacctgtgggacagccaccaccctgaggtgccccagaggatcctgcgcatcatgtgccgcctggaggagctgggcctggccggccgctgcctgaccctgacccccaggcctgccacagaggccgagctgctgacctgccacagcgcagaatatgtgggccacctgcgggccacagagaagatgaagacccgggagctgcaccgggagagcagcaactttgacagcatctacatctgccccagcacctttgcctgtgcccagctggccactggagctgcctgccgcctggtggaggccgtgctgtctggagaggtgctgaatggagctgctgtggtgcggcccccaggccaccacgccgagcaggatgctgcctgtggcttctgcttcttcaacagcgtggccgtggccgcccggcatgcccagaccatcagcggccacgccctgcgcatcctgattgtggactgggatgtgcaccacggcaatggcacccagcacatgtttgaagatgaccccagcgtgctgtatgtgtccctgcacagatatgaccacggcaccttcttccccatgggagatgagggcgccagcagccagatcggccgggctgctggcaccggcttcaccgtgaatgtggcctggaatggccccaggatgggagatgctgactacctggccgcctggcaccggctggtgctgcccatcgcctatgagttcaaccctgagctggtgctggtgtctgctggctttgatgctgcccggggggaccccctgggcggctgccaggtgtccccagagggctacgcccacctgacccacctgctgatgggcctggccagcggccgcatcatcctgatcctggagggcggctacaacctgaccagcatcagcgagagcatggccgcctgcaccaggagcctgctgggggaccccccacccctgctgaccctgcccaggcctcccctgagcggggccctggccagcatcacagagaccatccaggtgcaccggcgctactggaggagcctgcgggtgatgaaggtggaggaccgggagggccccagcagcagcaagctggtgaccaagaaggccccccagcctgccaagccccggctggccgagaggatgaccacccgggagaagaaggtgctggaggccggcatgggcaaggtgaccagcgccagctttggagaggagagcaccccaggccagaccaacagcgagacagctgtggtggccctgacccaggaccagcccagcgaggccgccactggaggagccaccctggcccagaccatcagcgaggccgccatcggcggggccatgctgggccagaccaccagcgaggaggccgtgggcggggccaccccagaccagaccaccagcgaggagaccgtgggcggggccatcctggaccagaccaccagtgaagatgctgtgggcggggccaccctgggccagaccaccagcgaggaggccgtgggcggggccaccctggcccagaccaccagcgaggccgccatggagggcgccaccctggaccagaccaccagcgaggaggcccctgggggcacagagctgatccagacccccctggccagcagcacagaccaccagaccccacccaccagccctgtgcagggcaccaccccccagatcagccccagcaccctcatcggcagcctgcggaccctggagctgggcagcgagagccagggcgccagcgagagccaggcccctggagaggagaacctgctgggggaggccgccggcggccaggacatggctgacagcatgctgatgcagggcagccggggcctgacagaccaggccatcttctatgctgtgacccccctgccctggtgcccccacctggtggccgtgtgccccatcccagctgctggcctggatgtgacccagccctgtggggactgtggcaccatccaggagaactgggtgtgcctgagctgctaccaggtgtactgcggccgctacatcaatggccacatgctgcagcaccacggcaacagcggccaccccctggtgctgagctacatcgacctgagcgcctggtgctactactgccaggcctacgtgcaccaccaggccctgctggatgtgaagaacatcgcccaccagaacaagtttggagaggacatgccccacccccactag

SEQ ID NO: 19945 - DNA, 633 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctggccgacacctatgattctgtgtacctgcaccccaacagctacagctgtgcctgcctggccagcggctctgtgctgcggctggtggatgctgtgctgggcgctgagatcagaaatggcatggccatcatctag

SEQ ID NO: 19946 - DNA, 3648 bp, Artificial Sequence; identical to SEQ ID NO: 19944
  Description of Artificial Sequence: Synthetic coding sequence

SEQ ID NO: 19947 - DNA, 633 bp, Artificial Sequence; identical to SEQ ID NO: 19945
  Description of Artificial Sequence: Synthetic coding sequence

SEQ ID NO: 19948 - DNA, 891 bp, Artificial Sequence
  Description of Artificial Sequence: Synthetic coding sequence
atgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctggccgacacctatgacagcgtgtacctgcaccccaacagctacagctgtgcctgcctggccagcggctctgtgctgcggctggtggatgctgtgctgggcgctgagatcagaaatggcatggccatcatccggcccccaggccaccacgcccagcacagcctgatggatggctactgcatgttcaaccacgtggccgtggccgcccgctatgcccagcagaagcaccgcatccggcgggtgctgattgtggactgggatgtgcaccacggccagggcacccagttcacctttgaccaggaccccagcgtgctgtacttcagcatccacagatatgagcagggccgcttctggccccacctgaaggccagcaactggagcaccaccggcttcggccagggccagggctacaccatcaacgtgccctggaaccaggtgggcatgagagatgctgactacatcgccgccttcctgcacgtgctgctgcctgtggccctggaggtgctgggcatctggggcgtgctgggcggcggcgtggccctgaaggtgcggctgtag

SEQ ID NO: 19949 - DNA, 429 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgtag

SEQ ID NO: 19950 - DNA, 810 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctggccgacacctatgattctgtgtacctgcaccccaacagctacagctgtgcctgcctggccagcggctctgtgctgcggctggtggatgctgtgctgggcgctgagatcagaaatggcatggccatcatccggcccccaggccaccacgcccagcacagcctgatggatggctactgcatgttcaaccacgtggccgtggccgcccgctatgcccagcagaagcaccgcatcagaagagtgctgattgtggactgggatgtgcaccacggccagggcacccagttcacctttgaccaggaccccaggtag

SEQ ID NO: 19951 - DNA, 2454 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctggccgacacctatgattctgtgtacctgcaccccaacagctacagctgtgcctgcctggccagcggctctgtgctgcggctggtggatgctgtgctgggcgctgagatcagaaatggcatggccatcatccggcccccaggccaccacgcccagcacagcctgatggatggctactgcatgttcaaccacgtggccgtggccgcccgctatgcccagcagaagcaccgcatcagaagagtgctgattgtggactgggatgtgcaccacggccagggcacccagttcacctttgaccaggaccccagcgtgctgtacttcagcatccacagatatgagcagggccgcttctggccccacctgaaggccagcaactggagcaccactggatttggccagggccagggctacaccatcaacgtgccctggaaccaggtgggcatgagagatgctgactacatcgccgccttcctgcacgtgctgctgcctgtggccctggagttccagccccagctggtgctggtggccgccggctttgatgccctgcagggcgaccccaagggggagatggccgccaccccagctggctttgcccagctgacccacctgctgatgggcctggccggcggcaagctgatcctgagcctggagggcggctacaacctgcgggccctggccgagggcgtgtctgccagcctgcacaccctgctgggggacccctgccccatgctggagagccctggggccccctgccgcagcgcccaggcctctgtgtcctgtgccctggaggccctggagcccttctgggaggtgctggtgcgcagcacagagaccgtggagcgggacaacatggaggaggacaacgtggaggagagcgaggaggagggcccctgggagccccctgtgctgcccatcctgacctggcctgtgctgcagagcaggacaggcctggtgtatgaccagaacatgatgaaccactgcaacctgtgggacagccaccaccctgaggtgccccagaggatcctgcgcatcatgtgccgcctggaggagctgggcctggccggccgctgcctgaccctgacccccaggcctgccacagaggccgagctgctgacctgccacagcgcagaatatgtgggccacctgcgggccacagagaagatgaagacccgggagctgcaccgggagagcagcaactttgacagcatctacatctgccccagcacctttgcctgtgcccagctggccactggagctgcctgccgcctggtggaggccgtgctgtctggagaggtgctgaatggagctgctgtggtgcggcccccaggccaccacgccgagcaggatgctgcctgtggcttctgcttcttcaacagcgtggccgtggccgcccggcatgcccagaccatcagcggccacgccctgcgcatcctgattgtggactgggatgtgcaccacggcaatggcacccagcacatgtttgaagatgaccccagcgtgctgtatgtgtccctgcacagatatgaccacggcaccttcttccccatgggagatgagggcgccagcagccagatcggccgggctgctggcaccggcttcaccgtgaatgtggcctggaatggccccaggatgggagatgctgactacctggccgcctggcaccggctggtgctgcccatcgcctatgagttcaaccctgagctggtgctggtgtctgctggctttgatgctgcccggggggaccccctgggcggctgccaggtgtccccagagggctacgcccacctgaccctgcccatcgcctgcctgcggggcaccaccaccccagcccagaaggagcggggggccgcccagtggccccaggagggcgctgacatcatgaggatcaccctggccggcggggagctgaccggccgccacggcaaggtggcctacgtgatcaagtacaagctgtag

SEQ ID NO: 19952 - DNA, 156 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagtag

SEQ ID NO: 19953 - DNA, 516 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctggccgacacctactag

SEQ ID NO: 19954 - DNA, 486 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaatag

SEQ ID NO: 19955 - DNA, 504 bp, Artificial Sequence
  Description of Artificial Sequence: Synthetic coding sequence
atgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctgtag

SEQ ID NO: 19956 - DNA, 3690 bp, Artificial Sequence
  Description of Artificial Sequence: Synthetic coding sequence
atgtctggggccaacagaggccggggccaggccagcagcaccatgaccagcacaggccaggacagcaccaccacccggcagaggaggagccggcagaacccccagagccccccccaggacagctctgtgaccagcaagaggaacatcaagaagggagctgtgcccaggagcatccccaacctggccgaggtgaagaagaagggcaagatgaagaagctgggccaggccatggaggaggacctgattgtgggcctgcagggcatggacctgaacctggaggccgaggccctggccggcaccggcctggtgctggatgagcagctgaatgagttccactgcctgtgggatgacagcttccctgagggccctgagcggctgcacgccatcaaggagcagctgatccaggagggcctgctggacagatgtgtgtccttccaggccaggtttgctgagaaggaggagctgatgctggtgcacagcctggagtacatcgacctgatggagaccacccagtacatgaatgaaggagagctgcgggtgctggccgacacctatgattctgtgtacctgcaccccaacagctacagctgtgcctgcctggccagcggctctgtgctgcggctggtggatgctgtgctgggcgctgagatcagaaatggcatggccatcatccggcccccaggccaccacgcccagcacagcctgatggatggctactgcatgttcaaccacgtggccgtggccgcccgctatgcccagcagaagcaccgcatcagaagagtgctgattgtggactgggatgtgcaccacggccagggcacccagttcacctttgaccaggaccccagcgtgctgtacttcagcatccacagatatgagcagggccgcttctggccccacctgaaggccagcaactggagcaccactggatttggccagggccagggctacaccatcaacgtgccctggaaccaggtgggcatgagagatgctgactacatcgccgccttcctgcacgtgctgctgcctgtggccctggagttccagccccagctggtgctggtggccgccggctttgatgccctgcagggcgaccccaagggggagatggccgccaccccagctggctttgcccagctgacccacctgctgatgggcctggccggcggcaagctgatcctgagcctggagggcggctacaacctgcgggccctggccgagggcgtgtctgccagcctgcacaccctgctgggggacccctgccccatgctggagagccctggggccccctgccgcagcgcccaggcctctgtgtcctgtgccctggaggccctggagcccttctgggaggtgctggtgcgcagcacagagaccgtggagcgggacaacatggaggaggacaacgtggaggagagcgaggaggagggcccctgggagccccctgtgctgcccatcctgacctggcctgtgctgcagagcaggacaggcctggtgtatgaccagaacatgatgaaccactgcaacctgtgggacagccaccaccctgaggtgccccagaggatcctgcgcatcatgtgccgcctggaggagctgggcctggccggccgctgcctgaccctgacccccaggcctgccacagaggccgagctgctgacctgccacagcgcagaatatgtgggccacctgcgggccacagagaagatgaagacccgggagctgcaccgggagagcagcaactttgacagcatctacatctgccccagcacctttgcctgtgcccagctggccactggagctgcctgccgcctggtggaggccgtgctgtctggagaggtgctgaatggagctgctgtggtgcggcccccaggccaccacgccgagcaggatgctgcctgtggcttctgcttcttcaacagcgtggccgtggccgcccggcatgcccagaccatcagcggccacgccctgcgcatcctgattgtggactgggatgtgcaccacggcaatggcacccagcacatgtttgaagatgaccccagcgtgctgtatgtgtccctgcacagatatgaccacggcaccttcttccccatgggagatgagggcgccagcagccagatcggccgggctgctggcaccggcttcaccgtgaatgtggcctggaatggccccaggatgggagatgctgactacctggccgcctggcaccggctggtgctgcccatcgcctatgagttcaaccctgagctggtgctggtgtctgctggctttgatgctgcccggggggaccccctgggcggctgccaggtgtccccagagggctacgcccacctgacccacctgctgatgggcctggccagcggccgcatcatcctgatcctggagggcggctacaacctgaccagcatcagcgagagcatggccgcctgcaccaggagcctgctgggggaccccccacccctgctgaccctgcccaggcctcccctgagcggggccctggccagcatcacagagaccatccaggtgcaccggcgctactggaggagcctgcgggtgatgaaggtggaggaccgggagggccccagcagcagcaagctggtgaccaagaaggccccccagcctgccaagccccggctggccgagaggatgaccacccgggagaagaaggtgctggaggccggcatgggcaaggtgaccagcgccagctttggagaggagagcaccccaggccagaccaacagcgagacagctgtggtggccctgacccaggaccagcccagcgaggccgccactggaggagccaccctggcccagaccatcagcgaggccgccatcggcggggccatgctgggccagaccaccagcgaggaggccgtgggcggggccaccccagaccagaccaccagcgaggagaccgtgggcggggccatcctggaccagaccaccagtgaagatgctgtgggcggggccaccctgggccagaccaccagcgaggaggccgtgggcggggccaccctggcccagaccaccagcgaggccgccatggagggcgccaccctggaccagaccaccagcgaggaggcccctgggggcacagagctgatccagacccccctggccagcagcacagaccaccagaccccacccaccagccctgtgcagggcaccaccccccagatcagccccagcaccctcatcggcagcctgcggaccctggagctgggcagcgagagccagggcgccagcgagagccaggcccctggagaggagaacctgctgggggaggccgccggcggccaggacatggctgacagcatgctgatgcagggcagccggggcctgacagaccaggccatcttctatgctgtgacccccctgccctggtgcccccacctggtggccgtgtgccccatcccagctgctggcctggatgtgacccagccctgtggggactgtggcaccatccaggagaactgggtgtgcctgagctgctaccaggtgtactgcggccgctacatcaatggccacatgctgcagcaccacggcaacagcggccaccccctggtgctgagctacatcgacctgagcgcctggtgctactactgccaggcctacgtgcaccaccaggccctgctggatgtgaagaacatcgcccaccagaacaagtttggagaggacatgccccacccccactag

SEQ ID NO: 19957 - DNA, 2976 bp, Artificial Sequence
  Description of Artificial Sequence: Synthetic coding sequence
atgcacagccctggagcagatggcacccaggtgtcccctggggcccactactgcagccccactggagctggctgcccccggccctgtgccgacaccccaggcccccagccccagcccatggacctgcgggtgggccagaggcctcctgtggagcccccacctgagcccaccctgctggccctgcagaggccccagaggctgcaccaccacctgttcctggccggcctgcagcagcagaggtctgtggagcccatgaggctgtccatggacacccccatgcctgagctgcaggtgggcccccaggagcaggagctgcggcagctgctgcacaaggacaagagcaagaggtctgctgtggccagctctgtggtgaagcagaagctggccgaggtgatcctgaagaagcagcaggccgccctggagaggacagtgcaccccaacagccctggcatcccctaccgcaccctggagcccctggagacagaaggagccaccaggtccatgctgagcagcttcctgccccctgtgcccagcctgcccagcgaccccccagagcacttccccctgaggaagacagtgtctgagcccaacctgaagctgcgctacaagcccaagaagagcctggagaggaggaagaaccccctgctgaggaaggagagcgccccacccagcctgcggcggcggcctgctgagaccctgggggacagcagccccagcagcagcagcaccccagccagcggctgcagcagccccaatgacagcgagcacggccccaaccccatcctgggcagcgaggccctgctgggccagaggctgcggctgcaggagacctctgtggccccctttgccctgcccaccgtgtccctgctgcctgccatcaccctgggcctgcctgccccagcccgggctgacagcgacaggaggacccaccccaccctgggcccccggggccccatcctgggcagcccccacacccccctcttcctgccccacggcctggagcctgaggccggcggcaccctgcccagccggctgcagcccatcctgctgctggaccccagcggcagccacgcccccctgctgactgtgcccggcctgggccccctgcccttccactttgcccagagcctgatgaccacagagcggctgagcggcagcggcctgcactggcccctgagcaggaccaggtctgagcccctgcccccatctgccacagcccctcctcctcctggccccatgcagccccggctggagcagctgaagacccacgtgcaggtgatcaagaggtctgccaagcccagcgagaagccccggctgcggcagatccccagcgctgaggacctggagacagatggcggcggccctggccaggtggtggatgatggcctggagcaccgggagctgggccacggccagcctgaggcccggggccctgcccccctgcagcagcacccccaggtgctgctgtgggagcagcagaggctggccggccgcctgccccggggcagcactggagacacagtgctgctgcccctggcccagggcggccaccggcccctgagccgggcccagagcagccctgctgccccagccagcctgagcgcccctgagcccgccagccaggcccgggtgctgagcagcagcgagaccccagcccggaccctgcccttcaccaccggcctcatctatgattctgtgatgctgaagcaccagtgcagctgtggggacaacagccgccaccctgagcacgccggccgcatccagagcatctggagccggctgcaggagcggggcctgcggagccagtgtgagtgcctgcggggcaggaaggccagcctggaggagctgcagagcgtgcacagcgagcggcacgtgctgctgtatggcaccaaccccctgagccggctgaagctggacaacgggaagctggccggcctgctggcccagaggatgtttgtgatgctgccctgtggcggcgtgggcgtggacacagacaccatctggaatgagctgcacagcagcaatgctgcccgctgggccgccggctctgtgacagacctggccttcaaggtggccagccgggagctgaagaatggatttgctgtggtgcggcccccaggccaccacgccgaccacagcacagccatgggcttctgcttcttcaacagcgtggccatcgcctgccggcagctgcagcagcagagcaaggccagcaagatcctgattgtggactgggatgtgcaccacggcaatggcacccagcagaccttctaccaggaccccagcgtgctgtacatcagcctgcacagacatgatgatggcaacttcttccctggcagcggggctgtggatgaggtgggcgccggcagcggggagggcttcaacgtgaatgtggcctgggccggcggcctggacccccccatgggagaccctgagtacctggccgccttcagaattgtggtgatgcccatcgcccgggagttctccccagacctggtgctggtgtctgctggctttgatgctgctgagggccacccagcccccctgggcggctaccacgtgtctgccaagtgcttcggctacatgacccagcagctgatgaacctggccggcggcgctgtggtgctggccctggagggcggccatgacctgacagccatctgtgatgccagcgaggcctgtgtggccgccctgctgggcaacagagtggaccccctgtctgaggagggctggaagcagaagcccaacctgaatgccatccgcagcctggaggccgtcatccgggtgcacagcaagtactggggctgcatgcagaggctggccagctgcccagacagctgggtgccccgggtgcctggagctgacaaggaggaggtggaggccgtgacagccctggccagcctgtctgtgggcatcctggctgaagatcggcccagcgagcagctggtggaggaggaggagcccatgaacctgtag

SEQ ID NO: 19958 - DNA, 2865 bp, Artificial Sequence
  Description of Artificial Sequence: Synthetic coding sequence
atgcacagccctggagcagatggcacccaggtgtcccctggggcccactactgcagccccactggagctggctgcccccggccctgtgccgacaccccaggcccccagccccagcccatggacctgcgggtgggccagaggcctcctgtggagcccccacctgagcccaccctgctggccctgcagaggccccagaggctgcaccaccacctgttcctggccggcctgcagcagcagaggtctgtggagcccatgaggctgtccatggacacccccatgcctgagctgcaggtgggcccccaggagcaggagctgcggcagctgctgcacaaggacaagagcaagaggtctgctgtggccagctctgtggtgaagcagaagctggccgaggtgatcctgaagaagcagcaggccgccctggagaggacagtgcaccccaacagccctggcatcccctaccgcaccctggagcccctggagacagaaggagccaccaggtccatgctgagcagcttcctgccccctgtgcccagcctgcccagcgaccccccagagcacttccccctgaggaagacagtgtctgagcccaacctgaagctgcgctacaagcccaagaagagcctggagaggaggaagaaccccctgctgaggaaggagagcgccccacccagcctgcggcggcggcctgctgagaccctgggggacagcagccccagcagcagcagcaccccagccagcggctgcagcagccccaatgacagcgagcacggccccaaccccatcctgggcagcgaggccgacagcgacaggaggacccaccccaccctgggcccccggggccccatcctgggcagcccccacacccccctcttcctgccccacggcctggagcctgaggccggcggcaccctgcccagccggctgcagcccatcctgctgctggaccccagcggcagccacgcccccctgctgactgtgcccggcctgggccccctgcccttccactttgcccagagcctgatgaccacagagcggctgagcggcagcggcctgcactggcccctgagcaggaccaggtctgagcccctgccccccagcgccacagcccctcctcctcctggccccatgcagccccggctggagcagctgaagacccacgtgcaggtgatcaagaggtctgccaagcccagcgagaagccccggctgcggcagatccccagcgctgaggacctggagacagatggcggcggccctggccaggtggtggatgatggcctggagcaccgggagctgggccacggccagcctgaggcccggggccctgcccccctgcagcagcacccccaggtgctgctgtgggagcagcagaggctggccggccgcctgccccggggcagcactggagacacagtgctgctgcccctggcccagggcggccaccggcccctgagccgggcccagagcagccctgctgccccagccagcctgagcgcccctgagcccgccagccaggcccgggtgctgagcagcagcgagaccccagcccggaccctgcccttcaccaccggcctcatctatgacagcgtgatgctgaagcaccagtgcagctgtggggacaacagccgccaccctgagcacgccggccgcatccagagcatctggagccggctgcaggagcggggcctgcggagccagtgtgaatgtctgcggggcaggaaggccagcctggaggagctgcagagcgtgcacagcgagagacatgtgctgctgtatggcaccaaccccctgagccggctgaagctggacaatggcaagctggccggcctgctggcccagaggatgtttgtgatgctgccctgtggcggcgtgggcgtggacacagacaccatctggaatgagctgcacagcagcaatgctgcccgctgggccgccggctctgtgacagacctggccttcaaggtggccagccgggagctgaagaatggatttgctgtggtgcggcccccaggccaccacgccgaccacagcacagccatgggcttctgcttcttcaacagcgtggccatcgcctgccggcagctgcagcagcagagcaaggccagcaagatcctgattgtggactgggatgtgcaccacggcaatggcacccagcagaccttctaccaggaccccagcgtgctgtacatcagcctgcacagacatgatgatggcaacttcttccctggcagcggggctgtggatgaggtgggcgccggcagcggggagggcttcaacgtgaatgtggcctgggccggcggcctggacccccccatgggagaccctgagtacctggccgccttccgcatcgtggtgatgcccatcgcccgggagttctccccagacctggtgctggtgtctgctggctttgatgctgctgagggccacccagcccccctgggcggctaccacgtgtctgccaagtgcttcggctacatgacccagcagctgatgaacctggccggcggcgctgtggtgctggccctggagggcggccatgacctgacagccatctgtgatgccagcgaggcctgtgtggccgccctgctgggcaacagagtggaccccctgtctgaggagggctggaagcagaagcccaacctgaatgccatccgcagcctggaggccgtcatccgggtgcacagcaagtactggggctgcatgcagaggctggccagctgcccagacagctgggtgccccgggtgcctggagctgacaaggaggaggtggaggccgtgacagccctggccagcctgtctgtgggcatcctggccgaggaccggcccagcgagcagctggtggaggaggaggagcccatgaacctgtag

SEQ ID NO: 19959 - DNA, 3045 bp, Artificial Sequence
  Description of Artificial Sequence: Synthetic coding sequence
atgtctgacctgaggaagcgggagctgggcgccctcttcaccagccggggcaccggcggcgtggagtgggatggcacccaggtgtcccctggggcccactactgcagccccaccggggccggctgcccccggccctgtgccgacaccccaggcccccagccccagcccatggacctgcgggtgggccagaggcctcctgtggagcccccacctgagcccaccctgctggccctgcagaggccccagaggctgcaccaccacctgttcctggccggcctgcagcagcagaggtctgtggagcccatgaggctgtccatggacacccccatgcctgagctgcaggtgggcccccaggagcaggagctgcggcagctgctgcacaaggacaagagcaagaggtctgctgtggccagctctgtggtgaagcagaagctggccgaggtgatcctgaagaagcagcaggccgccctggagaggacagtgcaccccaacagccctggcatcccctaccgcaccctggagcccctggagacagagggcgccaccaggtccatgctgagcagcttcctgccccctgtgcccagcctgcccagcgaccccccagagcacttccccctgaggaagacagtgtctgagcccaacctgaagctgcgctacaagcccaagaagagcctggagaggaggaagaaccccctgctgaggaaggagagcgccccacccagcctgcggcggcggcctgctgagaccctgggggacagcagccccagcagcagcagcaccccagccagcggctgcagcagccccaatgattctgaacatggccccaaccccatcctgggcagcgaggccctgctgggccagaggctgcggctgcaggagacctctgtggccccctttgccctgcccaccgtgtccctgctgcctgccatcaccctgggcctgcctgccccagcccgggctgacagcgacaggaggacccaccccaccctgggcccccggggccccatcctgggcagcccccacacccccctcttcctgccccacggcctggagcctgaggccggcggcaccctgcccagccggctgcagcccatcctgctgctggaccccagcggcagccacgcccccctgctgactgtgcccggcctgggccccctgcccttccactttgcccagagcctgatgaccacagagcggctgagcggcagcggcctgcactggcccctgagcaggaccaggtctgagcccctgccccccagcgccacagcccctcctcctcctggccccatgcagccccggctggagcagctgaagacccacgtgcaggtgatcaagaggtctgccaagcccagcgagaagccccggctgcggcagatccccagcgctgaggacctggagacagatggcggcggccctggccaggtggtggatgatggcctggagcaccgggagctgggccacggccagcctgaggcccggggccctgcccccctgcagcagcacccccaggtgctgctgtgggagcagcagaggctggccggccgcctgccccggggcagcactggagacacagtgctgctgcccctggcccagggcggccaccggcccctgagccgggcccagagcagccctgctgccccagccagcctgagcgcccctgagcccgccagccaggcccgggtgctgagcagcagcgagaccccagcccggaccctgcccttcaccaccggcctcatctatgacagcgtgatgctgaagcaccagtgcagctgtggggacaacagccgccaccctgagcacgccggccgcatccagagcatctggagccggctgcaggagcggggcctgcggagccagtgtgaatgtctgcggggcaggaaggccagcctggaggagctgcagagcgtgcacagcgagagacatgtgctgctgtatggcaccaaccccctgagccggctgaagctggacaatggcaagctggccggcctgctggcccagaggatgtttgtgatgctgccctgtggcggcgtgggcgtggacacagacaccatctggaatgagctgcacagcagcaatgctgcccgctgggccgccggctctgtgacagacctggccttcaaggtggccagccgggagctgaagaatggatttgctgtggtgcggcccccaggccaccacgccgaccacagcacagccatgggcttctgcttcttcaacagcgtggccatcgcctgccggcagctgcagcagcagagcaaggccagcaagatcctgattgtggactgggatgtgcaccacggcaatggcacccagcagaccttctaccaggaccccagcgtgctgtacatcagcctgcacagacatgatgatggcaacttcttccctggcagcggggctgtggatgaggtgggcgccggcagcggggagggcttcaacgtgaatgtggcctgggccggcggcctggacccccccatgggagaccctgagtacctggccgccttccgcatcgtggtgatgcccatcgcccgggagttctccccagacctggtgctggtgtctgctggctttgatgctgctgagggccacccagcccccctgggcggctaccacgtgtctgccaagtgcttcggctacatgacccagcagctgatgaacctggccggcggcgctgtggtgctggccctggagggcggccatgacctgacagccatctgtgatgccagcgaggcctgtgtggccgccctgctgggcaacagagtggaccccctgtctgaggagggctggaagcagaagcccaacctgaatgccatccgcagcctggaggccgtcatccgggtgcacatgggcgccctgaccctgagccagatccctggccacggcagcagccagcagcaggccggcggggccttctcctggccaggccacccctgcagagctgctgtggtgatggtgaacacaggagctgcctgcagcgcctggccccctgtgcagaccccaggctgcctggagtgccagggcctgaccaagaagaagtggaggcagtag

SEQ ID NO: 19960 - DNA, 402 bp, Artificial Sequence
  Description of Artificial Sequence: Synthetic coding sequence
atgcacagccctggggccggctgcccccggccctgtgccgacaccccaggcccccagccccagcccatggacctgcgggtgggccagaggcctcctgtggagcccccacctgagcccaccctgctggccctgcagaggccccagaggctgcaccaccacctgttcctggccggcctgcagcagcagaggtctgtggagcccatgaggctgtccatggacacccccatgcctgagctgcaggtgggcccccaggagcaggagctgcggcagctgctgcacaaggacaagagcaagaggtctgctgtggccagctctgtggtgaagcagaagctggccgaggtgatcctgaagaagcagcaggccgccctggagaggacagtgcaccccaacagccctggatag

SEQ ID NO: 19961 - DNA, 2859 bp, Artificial Sequence
  Description of Artificial Sequence: Synthetic coding sequence
atggacctgcgggtgggccagaggcctcctgtggagcccccacctgagcccaccctgctggccctgcagaggccccagaggctgcaccaccacctgttcctggccggcctgcagcagcagaggtctgtggagcccatgaggctgtccatggacacccccatgcctgagctgcaggtgggcccccaggagcaggagctgcggcagctgctgcacaaggacaagagcaagaggtctgctgtggccagctctgtggtgaagcagaagctggccgaggtgatcctgaagaagcagcaggccgccctggagaggacagtgcaccccaacagccctggcatcccctaccgcaccctggagcccctggagacagagggcgccaccaggtccatgctgagcagcttcctgccccctgtgcccagcctgcccagcgaccccccagagcacttccccctgaggaagacagtgtctgagcccaacctgaagctgcgctacaagcccaagaagagcctggagaggaggaagaaccccctgctgaggaaggagagcgccccacccagcctgcggcggcggcctgctgagaccctgggggacagcagccccagcagcagcagcaccccagccagcggctgcagcagccccaatgattctgaacatggccccaaccccatcctgggcagcgaggccctgctgggccagaggctgcggctgcaggagacctctgtggccccctttgccctgcccaccgtgtccctgctgcctgccatcaccctgggcctgcctgccccagcccgggctgacagcgacaggaggacccaccccaccctgggcccccggggccccatcctgggcagcccccacacccccctcttcctgccccacggcctggagcctgaggccggcggcaccctgcccagccggctgcagcccatcctgctgctggaccccagcggcagccacgcccccctgctgactgtgcccggcctgggccccctgcccttccactttgcccagagcctgatgaccacagagcggctgagcggcagcggcctgcactggcccctgagcaggaccaggtctgagcccctgccccccagcgccacagcccctcctcctcctggccccatgcagccccggctggagcagctgaagacccacgtgcaggtgatcaagaggtctgccaagcccagcgagaagccccggctgcggcagatccccagcgctgaggacctggagacagatggcggcggccctggccaggtggtggatgatggcctggagcaccgggagctgggccacggccagcctgaggcccggggccctgcccccctgcagcagcacccccaggtgctgctgtgggagcagcagaggctggccggccgcctgccccggggcagcactggagacacagtgctgctgcccctggcccagggcggccaccggcccctgagccgggcccagagcagccctgctgccccagccagcctgagcgcccctgagcccgccagccaggcccgggtgctgagcagcagcgagaccccagcccggaccctgcccttcaccaccggcctcatctatgacagcgtgatgctgaagcaccagtgcagctgtggggacaacagccgccaccctgagcacgccggccgcatccagagcatctggagccggctgcaggagcggggcctgcggagccagtgtgaatgtctgcggggcaggaaggccagcctggaggagctgcagagcgtgcacagcgagagacatgtgctgctgtatggcaccaaccccctgagccggctgaagctggacaatggcaagctggccggcctgctggcccagaggatgtttgtgatgctgccctgtggcggcgtgggcgtggacacagacaccatctggaatgagctgcacagcagcaatgctgcccgctgggccgccggctctgtgacagacctggccttcaaggtggccagccgggagctgaagaatggatttgctgtggtgcggcccccaggccaccacgccgaccacagcacagccatgggcttctgcttcttcaacagcgtggccatcgcctgccggcagctgcagcagcagagcaaggccagcaagatcctgattgtggactgggatgtgcaccacggcaatggcacccagcagaccttctaccaggaccccagcgtgctgtacatcagcctgcacagacatgatgatggcaacttcttccctggcagcggggctgtggatgaggtgggcgccggcagcggggagggcttcaacgtgaatgtggcctgggccggcggcctggacccccccatgggagaccctgagtacctggccgccttccgcatcgtggtgatgcccatcgcccgggagttctccccagacctggtgctggtgtctgctggctttgatgctgctgagggccacccagcccccctgggcggctaccacgtgtctgccaagtgcttcggctacatgacccagcagctgatgaacctggccggcggcgctgtggtgctggccctggagggcggccatgacctgacagccatctgtgatgccagcgaggcctgtgtggccgccctgctgggcaacagagtggaccccctgtctgaggagggctggaagcagaagcccaacctgaatgccatccgcagcctggaggccgtcatccgggtgcacagcaagtactggggctgcatgcagaggctggccagctgcccagacagctgggtgccccgggtgcctggagctgacaaggaggaggtggaggccgtgacagccctggccagcctgtctgtgggcatcctggccgaggaccggcccagcgagcagctggtggaggaggaggagcccatgaacctgtag

SEQ ID NO: 19962 - DNA, 2925 bp, Artificial Sequence
  Description of Artificial Sequence: Synthetic coding sequence
atgcacagccctggggccggctgcccccggccctgtgccgacaccccaggcccccagccccagcccatggacctgcgggtgggccagaggcctcctgtggagcccccacctgagcccaccctgctggccctgcagaggccccagaggctgcaccaccacctgttcctggccggcctgcagcagcagaggtctgtggagcccatgaggctgtccatggacacccccatgcctgagctgcaggtgggcccccaggagcaggagctgcggcagctgctgcacaaggacaagagcaagaggtctgctgtggccagctctgtggtgaagcagaagctggccgaggtgatcctgaagaagcagcaggccgccctggagaggacagtgcaccccaacagccctggcatcccctaccgcaccctggagcccctggagacagagggcgccaccaggtccatgctgagcagcttcctgccccctgtgcccagcctgcccagcgaccccccagagcacttccccctgaggaagacagtgtctgagcccaacctgaagctgcgctacaagcccaagaagagcctggagaggaggaagaaccccctgctgaggaaggagagcgccccacccagcctgcggcggcggcctgctgagaccctgggggacagcagccccagcagcagcagcaccccagccagcggctgcagcagccccaatgattctgaacatggccccaaccccatcctgggcagcgaggccctgctgggccagaggctgcggctgcaggagacctctgtggccccctttgccctgcccaccgtgtccctgctgcctgccatcaccctgggcctgcctgccccagcccgggctgacagcgacaggaggacccaccccaccctgggcccccggggccccatcctgggcagcccccacacccccctcttcctgccccacggcctggagcctgaggccggcggcaccctgcccagccggctgcagcccatcctgctgctggaccccagcggcagccacgcccccctgctgactgtgcccggcctgggccccctgcccttccactttgcccagagcctgatgaccacagagcggctgagcggcagcggcctgcactggcccctgagcaggaccaggtctgagcccctgccccccagcgccacagcccctcctcctcctggccccatgcagccccggctggagcagctgaagacccacgtgcaggtgatcaagaggtctgccaagcccagcgagaagccccggctgcggcagatccccagcgctgaggacctggagacagatggcggcggccctggccaggtggtggatgatggcctggagcaccgggagctgggccacggccagcctgaggcccggggccctgcccccctgcagcagcacccccaggtgctgctgtgggagcagcagaggctggccggccgcctgccccggggcagcactggagacacagtgctgctgcccctggcccagggcggccaccggcccctgagccgggcccagagcagccctgctgccccagccagcctgagcgcccctgagcccgccagccaggcccgggtgctgagcagcagcgagaccccagcccggaccctgcccttcaccaccggcctcatctatgacagcgtgatgctgaagcaccagtgcagctgtggggacaacagccgccaccctgagcacgccggccgcatccagagcatctggagccggctgcaggagcggggcctgcggagccagtgtgaatgtctgcggggcaggaaggccagcctggaggagctgcagagcgtgcacagcgagagacatgtgctgctgtatggcaccaaccccctgagccggctgaagctggacaatggcaagctggccggcctgctggcccagaggatgtttgtgatgctgccctgtggcggcgtgggcgtggacacagacaccatctggaatgagctgcacagcagcaatgctgcccgctgggccgccggctctgtgacagacctggccttcaaggtggccagccgggagctgaagaatggatttgctgtggtgcggcccccaggccaccacgccgaccacagcacagccatgggcttctgcttcttcaacagcgtggccatcgcctgccggcagctgcagcagcagagcaaggccagcaagatcctgattgtggactgggatgtgcaccacggcaatggcacccagcagaccttctaccaggaccccagcgtgctgtacatcagcctgcacagacatgatgatggcaacttcttccctggcagcggggctgtggatgaggtgggcgccggcagcggggagggcttcaacgtgaatgtggcctgggccggcggcctggacccccccatgggagaccctgagtacctggccgccttccgcatcgtggtgatgcccatcgcccgggagttctccccagacctggtgctggtgtctgctggctttgatgctgctgagggccacccagcccccctgggcggctaccacgtgtctgccaagtgcttcggctacatgacccagcagctgatgaacctggccggcggcgctgtggtgctggccctggagggcggccatgacctgacagccatctgtgatgccagcgaggcctgtgtggccgccctgctgggcaacagagtggaccccctgtctgaggagggctggaagcagaagcccaacctgaatgccatccgcagcctggaggccgtcatccgggtgcacagcaagtactggggctgcatgcagaggctggccagctgcccagacagctgggtgccccgggtgcctggagctgacaaggaggaggtggaggccgtgacagccctggccagcctgtctgtgggcatcctggccgaggaccggcccagcgagcagctggtggaggaggaggagcccatgaacctgtag

SEQ ID NO: 19963 - DNA, 819 bp, Artificial Sequence
  Description of Artificial Sequence: Synthetic coding sequence
atggaggagcctgaggagcctgctgacagcggccagagcctggtgcctgtgtacatctacagcccagaatatgtgtccatgtgtgacagcctggccaagatccccaagagggcctccatggtgcacagcctgattgaggcctatgccctgcacaagcagatgagaattgtgaagcccaaggtggcctccatggaggagatggccaccttccacacagatgcctacctgcagcacctgcagaaggtgtcccaggagggagatgatgaccacccagacagcattgaatatggcctgggctatgactgcccagccacagagggcatctttgattatgctgctgccatcggcggggccaccatcacagctgcccagtgcctgattgatggcatgtgcaaggtggccatcaactggagcggcggctggcaccacgccaagaaggatgaggccagcggcttctgctacctgaatgatgctgtgctgggcatcctgcggctgcggaggaagtttgagcgcatcctgtatgtggacctggacctgcaccacggagatggagtggaggatgccttctccttcaccagcaaggtgatgacagtgtccctgcacaagttcagccctggcttcttccctgggaagagtgatgtgtctgatgtgggcctgggcaagggccgctactacagcgtgaatgtgcccatccaggacggcatccaggatgagaagtactaccagatctgtgagagcgtgaggaccagctgccccaagagcaggcctgtggaggccgctgctgctgcctgcctgccccacctgcacagcctggtgtag

SEQ ID NO: 19964 - DNA, 1134 bp, Artificial Sequence
  Description of Artificial Sequence: Synthetic coding sequence
atggaggagcctgaggagcctgctgacagcggccagagcctggtgcctgtgtacatctacagcccagaatatgtgtccatgtgtgacagcctggccaagatccccaagagggcctccatggtgcacagcctgattgaggcctatgccctgcacaagcagatgagaattgtgaagcccaaggtggcctccatggaggagatggccaccttccacacagatgcctacctgcagcacctgcagaaggtgtcccaggagggagatgatgaccacccagacagcattgaatatggcctgggctatgactgcccagccacagagggcatctttgattatgctgctgccatcggcggggccaccatcacagctgcccagtgcctgattgatggcatgtgcaaggtggccatcaactggagcggcggctggcaccacgccaagaaggatgaggccagcggcttctgctacctgaatgatgctgtgctgggcatcctgcggctgcggaggaagtttgagcgcatcctgtatgtggacctggacctgcaccacggagatggagtggaggatgccttctccttcaccagcaaggtgatgacagtgtccctgcacaagttcagccctggcttcttccctggcactggagatgtgtctgatgtgggcctgggcaagggccgctactacagcgtgaatgtgcccatccaggacggcatccaggatgagaagtactaccagatctgtgagagcgtgctgaaggaggtgtaccaggccttcaaccccaaggctgtggtgctgcagctgggcgctgacaccatcgccggggaccccatgtgcagcttcaacatgacccctgtgggcatcggcaagtgcctgaagtacatcctgcagtggcagctggccaccctcatcctgggcggcggcggctacaacctggccaacacagcccgctgctggacctacctgactggagtcatcctgggcaagaccctgagcagcgagatcccagaccacgagttcttcaccgcctacggccctgactatgtgctggagatcacccccagctgcaggccagacagaaatgagccccaccgcatccagcagatcctgaactacatcaagggcaacctgaagcacgtggtgtag

SEQ ID NO: 19965 - DNA, 861 bp, Artificial Sequence
  Description of Artificial Sequence: Synthetic coding sequence
atggaggagcctgaggagcctgctgacagcggccagagcctggtgcctgtgtacatctacagcccagaatatgtgtccatgtgtgacagcctggccaagatccccaagagggcctccatggtgcacagcctgattgaggcctatgccctgcacaagcagatgagagatgaggccagcggcttctgctacctgaatgatgctgtgctgggcatcctgcggctgcggaggaagtttgagcgcatcctgtatgtggacctggacctgcaccacggagatggagtggaggatgccttctccttcaccagcaaggtgatgacagtgtccctgcacaagttcagccctggcttcttccctggcactggagatgtgtctgatgtgggcctgggcaagggccgctactacagcgtgaatgtgcccatccaggacggcatccaggatgagaagtactaccagatctgtgagagcgtgctgaaggaggtgtaccaggccttcaaccccaaggctgtggtgctgcagctgggcgctgacaccatcgccggggaccccatgtgcagcttcaacatgacccctgtgggcatcggcaagtgcctgaagtacatcctgcagtggcagctggccaccctcatcctgggcggcggcggctacaacctggccaacacagcccgctgctggacctacctgactggagtcatcctgggcaagaccctgagcagcgagatcccagaccacgagttcttcaccgcctacggccctgactatgtgctggagatcacccccagctgcaggccagacagaaatgagccccaccgcatccagcagatcctgaactacatcaagggcaacctgaagcacgtggtgtag

SEQ ID NO: 19966 - DNA, 549 bp, Artificial Sequence
  Description of Artificial Sequence: Synthetic coding sequence
atgacagtgtccctgcacaagttcagccctggcttcttccctggcactggagatgtgtctgatgtgggcctgggcaagggccgctactacagcgtgaatgtgcccatccaggacggcatccaggatgagaagtactaccagatctgtgagagcgtgctgaaggaggtgtaccaggccttcaaccccaaggctgtggtgctgcagctgggcgctgacaccatcgccggggaccccatgtgcagcttcaacatgacccctgtgggcatcggcaagtgcctgaagtacatcctgcagtggcagctggccaccctcatcctgggcggcggcggctacaacctggccaacacagcccgctgctggacctacctgactggagtcatcctgggcaagaccctgagcagcgagatcccagaccacgagttcttcaccgcctacggccctgactatgtgctggagatcacccccagctgcaggccagacagaaatgagccccaccgcatccagcagatcctgaactacatcaagggcaacctgaagcacgtggtgtag

SEQ ID NO: 19967 - DNA, 441 bp, Artificial Sequence
  Description of Artificial Sequence: Synthetic coding sequence
atggaggagcctgaggagcctgctgacagcggccagagcctggtgcctgtgtacatctacagcccagaatatgtgtccatgtgtgacagcctggccaagatccccaagagggcctccatggtgcacagcctgattgaggcctatgccctgcacaagcagatgagaattgtgaagcccaaggtggcctccatggaggagatggccaccttccacacagatgcctacctgcagcacctgcagaaggtgtcccaggagggagatgatgaccacccagacagcattgaatatggcctgggctatgactgcccagccacagagggcatctttgattatgctgctgccatcggcggggccaccatcacagctgcccagtgcctgattgatggcatgtgcaaggtggccatcaactggagcggcggctggcaccacgccaagaagtag

SEQ ID NO: 19968 - DNA, 477 bp, Artificial Sequence
  Description of Artificial Sequence: Synthetic coding sequence
atggaggagcctgaggagcctgctgacagcggccagagcctggtgcctgtgtacatctacagcccagaatatgtgtccatgtgtgacagcctggccaagatccccaagagggcctccatggtgcacagcctgattgaggcctatgccctgcacaagcagatgagaattgtgaagcccaaggtggcctccatggaggagatggccaccttccacacagatgcctacctgcagcacctgcagaaggtgtcccaggagggagatgatgaccacccagacagcattgaatatggcctgggctatgactgcccagccacagagggcatctttgattatgctgctgccatcggcggggccaccatcacagctgcccagtgcctgattgatggcatgtgcaaggtggccatcaactggagcggcggctggcaccacgccaagaaggagacctgtgtgtatgtggccctgtacaaggccttctag

SEQ ID NO: 19969 - DNA, 420 bp, Artificial Sequence
  Description of Artificial Sequence: Synthetic coding sequence
atggaggagcctgaggagcctgctgacagcggccagagcctggtgcctgtgtacatctacagcccagaatatgtgtccatgtgtgacagcctggccaagatccccaagagggcctccatggtgcacagcctgattgaggcctatgccctgcacaagcagatgagagatgaggccagcggcttctgctacctgaatgatgctgtgctgggcatcctgcggctgcggaggaagtttgagcgcatcctgtatgtggacctggacctgcaccacggagatggcactggagatgtgtctgatgtgggcctgggcaagggccgctactacagcgtgaatgtgcccatccaggacggcatccaggatgagaagtactaccagatctgtgaaagatatgagcccccagcccccaaccctggcctgtag

SEQ ID NO: 19970 - DNA, 771 bp, Artificial Sequence
  Description of Artificial Sequence: Synthetic coding sequence
atggaggagcctgaggagcctgctgacagcggccagagcctggtgcctgtgtacatctacagcccagaatatgtgtccatgtgtgacagcctggccaagatccccaagagggcctccatggtgcacagcctgattgaggcctatgccctgcacaagcagatgagaattgtgaagcccaaggtggcctccatggaggagatggccaccttccacacagatgcctacctgcagcacctgcagaaggtgtcccaggagggagatgatgaccacccagacagcattgaatatggcctgggctatgactgcccagccacagagggcatctttgattatgctgctgccatcggcggggccaccatcacagctgcccagtgcctgattgatggcatgtgcaaggtggccatcaactggagcggcggctggcaccacgccaagaaggatgaggccagcggcttctgctacctgaatgatgctgtgctgggcatcctgcggctgcggaggaagtttgagcgcatcctgtatgtggacctggacctgcaccacggagatggagtggaggatgccttctccttcaccagcaaggtgatgacagtgtccctgcacaagttcagccctggcttcttccctggcactggagatgtgtctgatgtgggcctgggcaagggccgctactacagcgtgaatgtgcccatccaggacggcatccaggatgagaagtactaccagatctgtgaaagatatgagcccccagcccccaaccctggcctgtag

SEQ ID NO: 19971 - DNA, 831 bp, Artificial Sequence
  Description of Artificial Sequence: Synthetic coding sequence
atggccggccctgctgccctgtctgctgctgctgctgctgccctggccgccgccctgctgctgctgcggagagaagatcctggccctggagctggccccagcatggccgagacagaggccctgagcaagctgcgggaggacttcaggatgcagaacaagagcgtcttcatcctgggcgccagcggggagaccggccgggtgctgctgaaggagatcctggagcagggcctcttcagcaaggtgaccctcatcggccgcaggaagctgacctttgatgaggaggcctacaagaatgtgaaccaggaggtggtggactttgagaagctggatgattatgccagcgccttccagggccatgatgtgggcttctgctgcctgggcaccacccggggcaaggccggggctgagggctttgtgcgggtggaccgggactatgtgctgaagtctgctgagctggccaaggccggcggctgcaagcacttcaacctgctgagcagcaaaggagctgacaagagcagcaacttcctgtacctgcaggtgaagggggaggtggaggccaaggtggaggagctgaagtttgaccgctacagcgtcttccggcctggggtgctgctgtgtgaccggcaggagagcaggcctggagagtggctggtgaggaagttcttcggcagcctgcctgacagctgggccagcggccacagcgtgcctgtggtgacagtggtgcgggccatgctgaacaacgtggtgcggccccgggacaagcagatggagctgctggagaacaaggccatccatgacctgggcaaggcccacggcagcctgaagccctag

SEQ ID NO: 19972 - DNA, 729 bp, Artificial Sequence
  Description of Artificial Sequence: Synthetic coding sequence
atggccgagacagaggccctgagcaagctgcgggaggacttcaggatgcagaacaagagcgtcttcatcctgggcgccagcggggagaccggccgggtgctgctgaaggagatcctggagcagggcctcttcagcaaggtgaccctcatcggccgcaggaagctgacctttgatgaggaggcctacaagaatgtgaaccaggaggtggtggactttgagaagctggatgattatgccagcgccttccagggccatgatgtgggcttctgctgcctgggcaccacccggggcaaggccggggctgagggctttgtgcgggtggaccgggactatgtgctgaagtctgctgagctggccaaggccggcggctgcaagcacttcaacctgctgagcagcaaaggagctgacaagagcagcaacttcctgtacctgcaggtgaagggggaggtggaggccaaggtggaggagctgaagtttgaccgctacagcgtcttccggcctggggtgctgctgtgtgaccggcaggagagcaggcctggagagtggctggtgaggaagttcttcggcagcctgcctgacagctgggccagcggccacagcgtgcctgtggtgacagtggtgcgggccatgctgaacaacgtggtgcggccccgggacaagcagatggagctgctggagaacaaggccatccatgacctgggcaaggcccacggcagcctgaagccctag

SEQ ID NO: 19973 - DNA, 729 bp, Artificial Sequence; identical to SEQ ID NO: 19972
  Description of Artificial Sequence: Synthetic coding sequence

SEQ ID NO: 19974 - DNA, 729 bp, Artificial Sequence; identical to SEQ ID NO: 19972
  Description of Artificial Sequence: Synthetic coding sequence

SEQ ID NO: 19975 - DNA, 402 bp, Artificial Sequence
  Description of Artificial Sequence: Synthetic coding sequence
atggccgagacagaggccctgagcaagctgcgggaggacttcaggatgcagaacaagagcgtcttcatcctgggcgccagcggggagaccggccgggtgctgctgaaggagatcctggagcagggcctcttcagcaaggtgaccctcatcggccgcaggaagctgacctttgatgaggaggcctacaagaatgtgaaccaggaggtggtggactttgagaagctggatgattatgccagcgccttccagggccatgatgtgggcttctgctgcctgggcaccacccggggcaaggccggggctgtgaggaaggcctatgccctcttccccttctgctggcctgtgatcagccgcatcctcttcctgctgaccctcttcctgtgtgcctgctgcaatgcctag

SEQ ID NO: 19976 - DNA, 402 bp, Artificial Sequence; identical to SEQ ID NO: 19975
  Description of Artificial Sequence: Synthetic coding sequence

SEQ ID NO: 19977 - DNA, 402 bp, Artificial Sequence; identical to SEQ ID NO: 19975
  Description of Artificial Sequence: Synthetic coding sequence

SEQ ID NO: 19978 - DNA, 1080 bp, Artificial Sequence
  Description of Artificial Sequence: Synthetic coding sequence
atggccgagcacggggcccacttcaccgctgcctctgtggctgatgaccagcccagcatctttgaggtggtggcccaggacagcctgatgacagctgtgcggcctgccctgcagcacgtggtgaaggtgctggccgagagcaaccccacccactacggcttcctgtggcgctggtttgatgagatcttcaccctgctggacctgctgctgcagcagcactacctgagcaggaccagcgccagcttcagcgagaacttctacggcctgaagagaattgtgatgggagacacccacaagagccagaggctggccagcgctggcctgcccaagcagcagctgtggaagagcatcatgttcctggtgctgctgccctacctgaaggtgaagctggagaagctggtgagcagcctgcgggaggaggatgagtacagcatccacccccccagcagccgctggaagcgcttctaccgggccttcctggccgcctacccctttgtgaacatggcctgggagggctggttcctggtgcagcagctgcgctacatcctgggcaaggcccagcaccacagccccctgctgcggctggccggcgtgcagctgggccgcctgactgtgcaggacatccaggccctggagcacaagccagccaaggcctccatgatgcagcagcctgcccggtctgtgtctgagaagatcaacagcgccctgaagaaggctgtgggcggcgtggccctgagcctgagcacaggcctgtctgtgggcgtcttcttcctgcagttcctggactggtggtacagcagcgagaaccaggagaccatcaagagcctgacagccctgcccaccccacctcctcctgtgcacctggactacaacagcgacagccccctgctgcccaagatgaagacagtgtgccccctgtgcaggaagaccagggtgaatgacacagtgctggccaccagcggctacgtgttctgctaccgctgtgtgttccactacgtgcgcagccaccaggcctgccccatcaccggctaccccacagaggtgcagcacctgatcaagctgtacagccctgagaactag

SEQ ID NO: 19979 - DNA, 1374 bp, Artificial Sequence
  Description of Artificial Sequence: Synthetic coding sequence
atggtgtccaagctgaccagcctgcagcaggagctgctgagcgccctgctgagcagtggagtgaccaaggaggtgctggtgcaggccctggaggagctgctgcccagccccaactttggagtgaagctggagaccctgcccctgagccctggcagcggggctgagccagacaccaagcctgtgttccacaccctgaccaatggacatgccaagggccgcctgtctggagatgagggctctgaagatggagatgattatgacaccccacccatcctgaaggagctgcaggccctgaacacagaggaggccgctgagcagagagctgaggtggacaggatgctgtctgaggacccctggagggctgccaagatgatcaagggctacatgcagcagcacaacatcccccagcgggaggtggtggatgtgacaggcctgaaccagagccacctgagccagcacctgaacaagggcacccccatgaagacccagaagagagctgccctgtacacctggtacgtgaggaagcagcgggagatcctgcggcagttcagccagcagagccacggccctggccagagtgatgatgcctgcagcgagcccaccaacaagaagatgagaagaaaccgcttcaagtggggccctgccagccagcagatcctgtaccaggcctatgaccggcagaagaaccccagcaaggaggagcgggaggccctggtggaggagtgcaacagagctgagtgcctgcagaggggcgtgagccccagcaaggcccacggcctgggcagcaacctggtgacagaggtgcgggtgtacaactggtttgccaacagaaggaaggaggaggccttccggcagaagctggccatggatgcctacagcagcaaccagacccacagcctgaaccccctgctgagccacggcagcccccaccaccagcccagcagcagcccccccaacaagctgagcggcgtgcgctacagccagcagggcaacaatgagatcaccagcagcagcaccatcagccaccacggcaacagcgccatggtgaccagccagagcgtgctgcagcaggtgtccccagccagcctggaccccggccacaacctgctgagcccagatggcaagatgatctctgtgtctgggggcggcctgccccctgtgtccaccctgaccaacatccacagcctgagccaccacaacccccagcagagccagaacctgatcatgacccccctgtctggagtgatggccatcgcccagatgagcagcaccagcctggtgatgcccacccaccacctgctgcgggcccagcagcagggcccctgcttcccccaccaccaccccctgggcagctgccacggcaaggcccagtag

SEQ ID NO: 19980 - DNA, 1338 bp, Artificial Sequence
  Description of Artificial Sequence: Synthetic coding sequence
atgctgtctgaggacccctggagggctgccaagatgatcaagggctacatgcagcagcacaacatcccccagcgggaggtggtggatgtgacaggcctgaaccagagccacctgagccagcacctgaacaagggcacccccatgaagacccagaagagagctgccctgtacacctggtacgtgaggaagcagcgggagatcctgcggcagttcaaccagacagtgcagagcagcggcaacatgacagacaagagcagccaggaccagctgctcttcctgtttcctgagttcagccagcagagccacggccctggccagagtgatgatgcctgcagcgagcccaccaacaagaagatgagaagaaaccgcttcaagtggggccctgccagccagcagatcctgtaccaggcctatgaccggcagaagaaccccagcaaggaggagcgggaggccctggtggaggagtgcaacagagctgagtgcctgcagaggggcgtgagccccagcaaggcccacggcctgggcagcaacctggtgacagaggtgcgggtgtacaactggtttgccaacagaaggaaggaggaggccttccggcagaagctggccatggatgcctacagcagcaaccagacccacagcctgaaccccctgctgagccacggcagcccccaccaccagcccagcagcagcccccccaacaagctgagcggcgtgcgctacagccagcagggcaacaatgagatcaccagcagcagcaccatcagccaccacggcaacagcgccatggtgaccagccagagcgtgctgcagcaggtgtccccagccagcctggaccccggccacaacctgctgagcccagatggcaagatgatctctgtgtctgggggcggcctgccccctgtgtccaccctgaccaacatccacagcctgagccaccacaacccccagcagagccagaacctgatcatgacccccctgtctggagtgatggccatcgcccagagcctgaacaccagccaggcccagagcgtgcctgtgatcaacagcgtggccggcagcctggccgccctgcagcctgtgcagttcagccagcagctgcacagcccccaccagcagcccctgatgcagcagagccctggcagccacatggcccagcagcccttcatggctgctgtgacccagctgcagaacagccacatgtatgcccacaagcaggagcccccccagtacagccacaccagccgcttccccagcgccatggtggtgacagacaccagcagcatcagcaccctgaccaacatgagcagcagcaagcagtgccccctgcaggcctggtag

SEQ ID NO: 19981 - DNA, 1278 bp, Artificial Sequence
  Description of Artificial Sequence: Synthetic coding sequence
atggtgtccaagctgaccagcctgcagcaggagctgctgagcgccctgctgagcagtggagtgaccaaggaggtgctggtgcaggccctggaggagctgctgcccagccccaactttggagtgaagctggagaccctgcccctgagccctggcagcggggctgagccagacaccaagcctgtgttccacaccctgaccaatggacatgccaagggccgcctgtctggagatgagggctctgaagatggagatgattatgacaccccacccatcctgaaggagctgcaggccctgaacacagaggaggccgctgagcagagagctgaggtggacaggatgctgtctgaggacccctggagggctgccaagatgatcaagggctacatgcagcagcacaacatcccccagcgggaggtggtggatgtgacaggcctgaaccagagccacctgagccagcacctgaacaagggcacccccatgaagacccagaagagagctgccctgtacacctggtacgtgaggaagcagcgggagatcctgcggcagttcaaccagacagtgcagagcagcggcaacatgacagacaagagcagccaggaccagctgctcttcctgtttcctgagttcagccagcagagccacggccctggccagagtgatgatgcctgcagcgagcccaccaacaagaagatgagaagaaaccgcttcaagtggggccctgccagccagcagatcctgtaccaggcctatgaccggcagaagaaccccagcaaggaggagcgggaggccctggtggaggagtgcaacagagctgagtgcctgcagaggggcgtgagccccagcaaggcccacggcctgggcagcaacctggtgacagaggtgcgggtgtacaactggtttgccaacagaaggaaggaggaggccttccggcagaagctggccatggatgcctacagcagcaaccagacccacagcctgaaccccctgctgagccacggcagcccccaccaccagcccagcagcagcccccccaacaagctgagcggcgtgcgctacagccagcagggcaacaatgagatcaccagcagcagcaccatcagccaccacggcaacagcgccatggtgaccagccagagcgtgctgcagcaggtgtccccagccagcctggaccccggccacaacctgctgagcccagatggcaagatggacctgagcctgcggaggagatttgcccccagccagcacctggatgagtacccccagcccctgcccccatag

SEQ ID NO: 19982 - DNA, 1596 bp, Artificial Sequence
  Description of Artificial Sequence: Synthetic coding sequence
atggtgtccaagctgaccagcctgcagcaggagctgctgagcgccctgctgagcagtggagtgaccaaggaggtgctggtgcaggccctggaggagctgctgcccagccccaactttggagtgaagctggagaccctgcccctgagccctggcagcggggctgagccagacaccaagcctgtgttccacaccctgaccaatggacatgccaagggccgcctgtctggagatgagggctctgaagatggagatgattatgacaccccacccatcctgaaggagctgcaggccctgaacacagaggaggccgctgagcagagagctgaggtggacaggatgctgtctgaggacccctggagggctgccaagatgatcaagggctacatgcagcagcacaacatcccccagcgggaggtggtggatgtgacaggcctgaaccagagccacctgagccagcacctgaacaagggcacccccatgaagacccagaagagagctgccctgtacacctggtacgtgaggaagcagcgggagatcctgcggcagttcagccagcagagccacggccctggccagagtgatgatgcctgcagcgagcccaccaacaagaagatgagaagaaaccgcttcaagtggggccctgccagccagcagatcctgtaccaggcctatgaccggcagaagaaccccagcaaggaggagcgggaggccctggtggaggagtgcaacagagctgagtgcctgcagaggggcgtgagccccagcaaggcccacggcctgggcagcaacctggtgacagaggtgcgggtgtacaactggtttgccaacagaaggaaggaggaggccttccggcagaagctggccatggatgcctacagcagcaaccagacccacagcctgaaccccctgctgagccacggcagcccccaccaccagcccagcagcagcccccccaacaagctgagcggcgtgcgctacagccagcagggcaacaatgagatcaccagcagcagcaccatcagccaccacggcaacagcgccatggtgaccagccagagcgtgctgcagcaggtgtccccagccagcctggaccccggccacaacctgctgagcccagatggcaagatgatctctgtgtctgggggcggcctgccccctgtgtccaccctgaccaacatccacagcctgagccaccacaacccccagcagagccagaacctgatcatgacccccctgtctggagtgatggccatcgcccagagcctgaacaccagccaggcccagagcgtgcctgtgatcaacagcgtggccggcagcctggccgccctgcagcctgtgcagttcagccagcagctgcacagcccccaccagcagcccctgatgcagcagagccctggcagccacatggcccagcagcccttcatggctgctgtgacccagctgcagaacagccacatgtatgcccacaagcaggagcccccccagtacagccacaccagccgcttccccagcgccatggtggtgacagacaccagcagcatcagcaccctgaccaacatgagcagcagcaagcagtgccccctgcaggcctggtag

SEQ ID NO: 19983 - DNA, 843 bp, Artificial Sequence
  Description of Artificial Sequence: Synthetic coding sequence
atgaagttccgggccaagatcgtggatggagcctgcctgaaccacttcacccgcatcagcaacatgattgccaagctggccaagacctgcaccctgcgcatcagcccagacaagctgaacttcatcctgtgtgacaagctggccaatggaggagtgtccatgtggtgtgagctggagcaggagaacttcttcaatgagttccagatggagggcgtgtctgcagaaaataatgagatctacctggagctgaccagcgagaacctgagccgggccctgaagacagcccagaatgcccgggccctgaagatcaagctgaccaacaagcacttcccctgcctgactgtgtctgtggagctgctgtccatgagcagcagcagccgcatcgtgacccatgacatccccatcaaggtgatccccaggaagctgtggaaggacctgcaggagcctgtggtgcctgaccctgatgtgtccatctacctgcctgtgctgaagaccatgaagtctgtggtggagaagatgaagaacatcagcaaccacctggtgattgaggccaacctggatggagagctgaacctgaagattgaaacagagctggtgtgtgtgaccacccacttcaaggacctgggcaacccccccctggccagcgagagcacccatgaggacagaaatgtggagcacatggccgaggtgcacatcgacatcaggaagctgctgcagttcctggccggccagcaggtgaaccccaccaaggccctgtgcaacatcgtgaacaacaagatggtgcactttgacctgctgcatgaagatgtgtccctgcagtacttcatcccagccctgtcctag

SEQ ID NO: 19984 - DNA, 780 bp, Artificial Sequence
  Description of Artificial Sequence: Synthetic coding sequence
atgattgccaagctggccaagacctgcaccctgcgcatcagcccagacaagctgaacttcatcctgtgtgacaagctggccaacggcggcgtgtccatgtggtgtgagctggagcaggagaacttcttcaatgagttccagatggagggcgtgtctgctgagaacaatgagatctacctggagctgaccagcgagaacctgagccgggccctgaagacagcccagaatgcccgggccctgaagatcaagctgaccaacaagcacttcccctgcctgactgtgtctgtggagctgctgtccatgagcagcagcagcagaattgtgacccatgacatccccatcaaggtgatccccaggaagctgtggaaggacctgcaggagcctgtggtgcctgaccctgatgtgtccatctacctgcctgtgctgaagaccatgaagtctgtggtggagaagatgaagaacatcagcaaccacctggtgattgaggccaacctggatggagagctgaacctgaagattgaaacagagctggtgtgtgtgaccacccacttcaaggacctgggcaacccccccctggccagcgagagcacccatgaagatagaaatgtggagcacatggccgaggtgcacatcgacatcaggaagctgctgcagttcctggccggccagcaggtgaaccccaccaaggccctgtgcaacatcgtgaacaacaagatggtgcactttgacctgctgcatgaagatgtgtccctgcagtacttcatcccagccctgtcctag

SEQ ID NO: 19985 - DNA, 843 bp, Artificial Sequence; identical to SEQ ID NO: 19983
  Description of Artificial Sequence: Synthetic coding sequence

SEQ ID NO: 19986 - DNA, 780 bp, Artificial Sequence; identical to SEQ ID NO: 19984
  Description of Artificial Sequence: Synthetic coding sequence

SEQ ID NO: 19987 - DNA, 2130 bp, Artificial Sequence
  Description of Artificial Sequence: Synthetic coding sequence
atgtccttccccaaggcccccctgaagcgcttcaatgaccccagcggctgtgcccccagccctggggcctatgatgtgaagaccctggaggtgctgaagggccctgtgtccttccagaagagccagcgcttcaagcagcagaaggagagcaagcagaacctgaatgtggacaaggacaccaccctgcctgccagcgccaggaaggtgaagagcagcgagagcaagatccgggtgctgctgcaggagcggggggcccaggaccggcgcatccaggacctggagacagagctggagaagatggaggcccggctgaatgctgccctgcgggagaagaccagcctgagcgccaacaatgccaccctggagaagcagctgattgagctgaccaggaccaatgagctgctgaagagcaagttctctgaaaatggaaaccagaagaacctgcgcatcctgagcctggagctgatgaagctgaggaacaagcgggagaccaagatgaggggcatgatggccaagcaggagggcatggagatgaagctgcaggtgacccagaggagcctggaggagagccagggcaagatcgcccagctggagggcaagctggtgtccattgagaaggagaagattgatgagaagtcagaaacagagaagctgctggagtacatcgaggagatcagctgtgccagtgaccaggtggagaagtacaagctggacatcgcccagctggaggagaacctgaaggagaagaatgatgagatcctgagcctgaagcagagcctggaggagaacatcgtcatcctgagcaagcaggtggaggacctgaatgtgaagtgccagctgctggagaaggagaaggaggaccacgtgaacagaaaccgggagcacaatgaaaacctgaatgctgagatgcagaacctgaagcagaagttcatcctggagcagcaggagcgggagaagctgcagcagaaggagctgcagattgacagcctgctgcagcaggagaaggagctgagcagcagcctgcaccagaagctgtgcagcttccaggaggagatggtgaaggagaagaacctgtttgaggaggagctgaagcagaccctggatgagctggacaagctgcagcagaaggaggagcaggccgagcggctggtgaagcagctggaggaggaggccaagagcagagctgaggagctgaagctgctggaggagaagctgaagggcaaggaggccgagctggagaagagcagcgctgcccacacccaggccaccctgctgctgcaggagaagtatgacagcatggtgcagagcctggaggatgtgacagcccagtttgagagctacaaggccctgacagccagcgagattgaggacctgaagctggagaacagcagcctgcaggagaaggccgccaaggccggcaagaatgcagaagatgtgcagcaccagatcctggccacagagagcagcaaccaggagtatgtgaggatgctgctggacctgcagaccaagagcgccctgaaggagacagagatcaaggagatcaccgtgtccttcctgcagaagatcacagacctgcagaaccagctgaagcagcaggaggaggacttcaggaagcagctggaggatgaggagggcaggaaggccgagaaggagaacaccacagctgagctgacagaggagatcaacaagtggaggctgctgtatgaggagctgtacaacaagaccaagcccttccagctgcagctggatgcctttgaggtggagaagcaggccctgctgaatgagcacggggccgcccaggagcagctgaacaagatccgggacagctatgccaagctgctgggccaccagaacctgaagcagaagatcaagcacgtggtgaagctgaaggatgagaacagccagctgaagtctgaggtgtccaagctgcgctgccagctggccaagaagaagcagagcgagaccaagctgcaggaggagctgaacaaggtgctgggcatcaagcactttgaccccagcaaggccttccaccacgagagcaaggagaactttgccctgaagacccccctgaaggagggcaacaccaactgctaccgggcccccatggagtgccaggagagctggaagtag

SEQ ID NO: 19988 - DNA, 2175 bp, Artificial Sequence
  Description of Artificial Sequence: Synthetic coding sequence
atgtccttccccaaggcccccctgaagcgcttcaatgaccccagcggctgtgcccccagccctggggcctatgatgtgaagaccctggaggtgctgaagggccctgtgtccttccagaagagccagcgcttcaagcagcagaaggagagcaagcagaacctgaatgtggacaaggacaccaccctgcctgccagcgccaggaaggtgaagagcagcgagagcaaggagagccagaagaatgacaaggacctgaagatcctggagaaggagatccgggtgctgctgcaggagcggggggcccaggaccggcgcatccaggacctggagacagagctggagaagatggaggcccggctgaatgctgccctgcgggagaagaccagcctgagcgccaacaatgccaccctggagaagcagctgattgagctgaccaggaccaatgagctgctgaagagcaagttctctgaaaatggaaaccagaagaacctgcgcatcctgagcctggagctgatgaagctgaggaacaagcgggagaccaagatgaggggcatgatggccaagcaggagggcatggagatgaagctgcaggtgacccagaggagcctggaggagagccagggcaagatcgcccagctggagggcaagctggtgtccattgagaaggagaagattgatgagaagtcagaaacagagaagctgctggagtacatcgaggagatcagctgtgccagtgaccaggtggagaagtacaagctggacatcgcccagctggaggagaacctgaaggagaagaatgatgagatcctgagcctgaagcagagcctggaggagaacatcgtcatcctgagcaagcaggtggaggacctgaatgtgaagtgccagctgctggagaaggagaaggaggaccacgtgaacagaaaccgggagcacaatgaaaacctgaatgctgagatgcagaacctgaagcagaagttcatcctggagcagcaggagcgggagaagctgcagcagaaggagctgcagattgacagcctgctgcagcaggagaaggagctgagcagcagcctgcaccagaagctgtgcagcttccaggaggagatggtgaaggagaagaacctgtttgaggaggagctgaagcagaccctggatgagctggacaagctgcagcagaaggaggagcaggccgagcggctggtgaagcagctggaggaggaggccaagagcagagctgaggagctgaagctgctggaggagaagctgaagggcaaggaggccgagctggagaagagcagcgctgcccacacccaggccaccctgctgctgcaggagaagtatgacagcatggtgcagagcctggaggatgtgacagcccagtttgagagctacaaggccctgacagccagcgagattgaggacctgaagctggagaacagcagcctgcaggagaaggccgccaaggccggcaagaatgcagaagatgtgcagcaccagatcctggccacagagagcagcaaccaggagtatgtgaggatgctgctggacctgcagaccaagagcgccctgaaggagacagagatcaaggagatcaccgtgtccttcctgcagaagatcacagacctgcagaaccagctgaagcagcaggaggaggacttcaggaagcagctggaggatgaggagggcaggaaggccgagaaggagaacaccacagctgagctgacagaggagatcaacaagtggaggctgctgtatgaggagctgtacaacaagaccaagcccttccagctgcagctggatgcctttgaggtggagaagcaggccctgctgaatgaacatggagctgcccaggagcagctgaacaagatccgggacagctatgccaagctgctgggccaccagaacctgaagcagaagatcaagcacgtggtgaagctgaaggatgagaacagccagctgaagtctgaggtgtccaagctgcgctgccagctggccaagaagaagcagagcgagaccaagctgcaggaggagctgaacaaggtgctgggcatcaagcactttgaccccagcaaggccttccaccacgagagcaaagaaaattttgccctgaagacccccctgaaggagggcaacaccaactgctaccgggcccccatggagtgccaggagagctggaagtag

SEQ ID NO: 19989 - DNA, 2178 bp, Artificial Sequence
  Description of Artificial Sequence: Synthetic coding sequence
atgtccttccccaaggcccccctgaagcgcttcaatgaccccagcggctgtgcccccagccctggggcctatgatgtgaagaccctggaggtgctgaagggccctgtgtccttccagaagagccagcgcttcaagcagcagaaggagagcaagcagaacctgaatgtggacaaggacaccaccctgcctgccagcgccaggaaggtgaagagcagcgagagcaagaaggagagccagaagaatgacaaggacctgaagatcctggagaaggagatccgggtgctgctgcaggagcggggggcccaggaccggcgcatccaggacctggagacagagctggagaagatggaggcccggctgaatgctgccctgcgggagaagaccagcctgagcgccaacaatgccaccctggagaagcagctgattgagctgaccaggaccaatgagctgctgaagagcaagttctctgaaaatggaaaccagaagaacctgcgcatcctgagcctggagctgatgaagctgaggaacaagcgggagaccaagatgaggggcatgatggccaagcaggagggcatggagatgaagctgcaggtgacccagaggagcctggaggagagccagggcaagatcgcccagctggagggcaagctggtgtccattgagaaggagaagattgatgagaagtcagaaacagagaagctgctggagtacatcgaggagatcagctgtgccagtgaccaggtggagaagtacaagctggacatcgcccagctggaggagaacctgaaggagaagaatgatgagatcctgagcctgaagcagagcctggaggagaacatcgtcatcctgagcaagcaggtggaggacctgaatgtgaagtgccagctgctggagaaggagaaggaggaccacgtgaacagaaaccgggagcacaatgaaaacctgaatgctgagatgcagaacctgaagcagaagttcatcctggagcagcaggagcgggagaagctgcagcagaaggagctgcagattgacagcctgctgcagcaggagaaggagctgagcagcagcctgcaccagaagctgtgcagcttccaggaggagatggtgaaggagaagaacctgtttgaggaggagctgaagcagaccctggatgagctggacaagctgcagcagaaggaggagcaggccgagcggctggtgaagcagctggaggaggaggccaagagcagagctgaggagctgaagctgctggaggagaagctgaagggcaaggaggccgagctggagaagagcagcgctgcccacacccaggccaccctgctgctgcaggagaagtatgacagcatggtgcagagcctggaggatgtgacagcccagtttgagagctacaaggccctgacagccagcgagattgaggacctgaagctggagaacagcagcctgcaggagaaggccgccaaggccggcaagaatgcagaagatgtgcagcaccagatcctggccacagagagcagcaaccaggagtatgtgaggatgctgctggacctgcagaccaagagcgccctgaaggagacagagatcaaggagatcaccgtgtccttcctgcagaagatcacagacctgcagaaccagctgaagcagcaggaggaggacttcaggaagcagctggaggatgaggagggcaggaaggccgagaaggagaacaccacagctgagctgacagaggagatcaacaagtggaggctgctgtatgaggagctgtacaacaagaccaagcccttccagctgcagctggatgcctttgaggtggagaagcaggccctgctgaatgagcacggggccgcccaggagcagctgaacaagatccgggacagctatgccaagctgctgggccaccagaacctgaagcagaagatcaagcacgtggtgaagctgaaggatgagaacagccagctgaagtctgaggtgtccaagctgcgctgccagctggccaagaagaagcagagcgagaccaagctgcaggaggagctgaacaaggtgctgggcatcaagcactttgaccccagcaaggccttccaccacgagagcaaggagaactttgccctgaagacccccctgaaggagggcaacaccaactgctaccgggcccccatggagtgccaggagagctggaagtag

SEQ ID NO: 19990 - DNA, 2106 bp, Artificial Sequence
  Description of Artificial Sequence: Synthetic coding sequence
atgtccttccccaaggcccccctgaagcgcttcaatgaccccagcggctgtgcccccagccctggggcctatgatgtgaagaccctggaggtgctgaagggccctgtgtccttccagaagagccagcgcttcaagcagcagaaggagagcaagcagaacctgaatgtggacaaggacaccaccctgcctgccagcgccaggaaggtgaagagcagcgagagcaagaaggagagccagaagaatgacaaggacctgaagatcctggagaaggagatccgggtgctgctgcaggagcggggggcccaggaccggcgcatccaggacctggagacagagctggagaagcagctgattgagctgaccaggaccaatgagctgctgaagagcaagttctctgaaaatggaaaccagaagaacctgcgcatcctgagcctggagctgatgaagctgaggaacaagcgggagaccaagatgaggggcatgatggccaagcaggagggcatggagatgaagctgcaggtgacccagaggagcctggaggagagccagggcaagatcgcccagctggagggcaagctggtgtccattgagaaggagaagattgatgagaagtcagaaacagagaagctgctggagtacatcgaggagatcagctgtgccagtgaccaggtggagaagtacaagctggacatcgcccagctggaggagaacctgaaggagaagaatgatgagatcctgagcctgaagcagagcctggaggagaacatcgtcatcctgagcaagcaggtggaggacctgaatgtgaagtgccagctgctggagaaggagaaggaggaccacgtgaacagaaaccgggagcacaatgaaaacctgaatgctgagatgcagaacctgaagcagaagttcatcctggagcagcaggagcgggagaagctgcagcagaaggagctgcagattgacagcctgctgcagcaggagaaggagctgagcagcagcctgcaccagaagctgtgcagcttccaggaggagatggtgaaggagaagaacctgtttgaggaggagctgaagcagaccctggatgagctggacaagctgcagcagaaggaggagcaggccgagcggctggtgaagcagctggaggaggaggccaagagcagagctgaggagctgaagctgctggaggagaagctgaagggcaaggaggccgagctggagaagagcagcgctgcccacacccaggccaccctgctgctgcaggagaagtatgacagcatggtgcagagcctggaggatgtgacagcccagtttgagagctacaaggccctgacagccagcgagattgaggacctgaagctggagaacagcagcctgcaggagaaggccgccaaggccggcaagaatgcagaagatgtgcagcaccagatcctggccacagagagcagcaaccaggagtatgtgaggatgctgctggacctgcagaccaagagcgccctgaaggagacagagatcaaggagatcaccgtgtccttcctgcagaagatcacagacctgcagaaccagctgaagcagcaggaggaggacttcaggaagcagctggaggatgaggagggcaggaaggccgagaaggagaacaccacagctgagctgacagaggagatcaacaagtggaggctgctgtatgaggagctgtacaacaagaccaagcccttccagctgcagctggatgcctttgaggtggagaagcaggccctgctgaatgagcacggggccgcccaggagcagctgaacaagatccgggacagctatgccaagctgctgggccaccagaacctgaagcagaagatcaagcacgtggtgaagctgaaggatgagaacagccagctgaagtctgaggtgtccaagctgcgctgccagctggccaagaagaagcagagcgagaccaagctgcaggaggagctgaacaaggtgctgggcatcaagcactttgaccccagcaaggccttccaccacgagagcaaggagaactttgccctgaagacccccctgaaggagggcaacaccaactgctaccgggcccccatggagtgccaggagagctggaagtag

SEQ ID NO: 19991 - DNA, 1917 bp, Artificial Sequence
  Description of Artificial Sequence: Synthetic coding sequence
atgaccctgctgatccgggtgctgctgcaggagcggggggcccaggaccggcgcatccaggacctggagacagagctggagaagatggaggcccggctgaatgctgccctgcgggagaagaccagcctgagcgccaacaatgccaccctggagaagcagctgattgagctgaccaggaccaatgagctgctgaagagcaagttctctgaaaatggaaaccagaagaacctgcgcatcctgagcctggagctgatgaagctgaggaacaagcgggagaccaagatgaggggcatgatggccaagcaggagggcatggagatgaagctgcaggtgacccagaggagcctggaggagagccagggcaagatcgcccagctggagggcaagctggtgtccattgagaaggagaagattgatgagaagtcagaaacagagaagctgctggagtacatcgaggagatcagctgtgccagtgaccaggtggagaagtacaagctggacatcgcccagctggaggagaacctgaaggagaagaatgatgagatcctgagcctgaagcagagcctggaggagaacatcgtcatcctgagcaagcaggtggaggacctgaatgtgaagtgccagctgctggagaaggagaaggaggaccacgtgaacagaaaccgggagcacaatgaaaacctgaatgctgagatgcagaacctgaagcagaagttcatcctggagcagcaggagcgggagaagctgcagcagaaggagctgcagattgacagcctgctgcagcaggagaaggagctgagcagcagcctgcaccagaagctgtgcagcttccaggaggagatggtgaaggagaagaacctgtttgaggaggagctgaagcagaccctggatgagctggacaagctgcagcagaaggaggagcaggccgagcggctggtgaagcagctggaggaggaggccaagagcagagctgaggagctgaagctgctggaggagaagctgaagggcaaggaggccgagctggagaagagcagcgctgcccacacccaggccaccctgctgctgcaggagaagtatgacagcatggtgcagagcctggaggatgtgacagcccagtttgagagctacaaggccctgacagccagcgagattgaggacctgaagctggagaacagcagcctgcaggagaaggccgccaaggccggcaagaatgcagaagatgtgcagcaccagatcctggccacagagagcagcaaccaggagtatgtgaggatgctgctggacctgcagaccaagagcgccctgaaggagacagagatcaaggagatcaccgtgtccttcctgcagaagatcacagacctgcagaaccagctgaagcagcaggaggaggacttcaggaagcagctggaggatgaggagggcaggaaggccgagaaggagaacaccacagctgagctgacagaggagatcaacaagtggaggctgctgtatgaggagctgtacaacaagaccaagcccttccagctgcagctggatgcctttgaggtggagaagcaggccctgctgaatgaacatggagctgcccaggagcagctgaacaagatccgggacagctatgccaagctgctgggccaccagaacctgaagcagaagatcaagcacgtggtgaagctgaaggatgagaacagccagctgaagtctgaggtgtccaagctgcgctgccagctggccaagaagaagcagagcgagaccaagctgcaggaggagctgaacaaggtgctgggcatcaagcactttgaccccagcaaggccttccaccacgagagcaaagaaaattttgccctgaagacccccctgaaggagggcaacaccaactgctaccgggcccccatggagtgccaggagagctggaagtag

SEQ ID NO: 19992 - DNA, 996 bp, Artificial Sequence
  Description of Artificial Sequence: Synthetic coding sequence
atgtccttccccaaggcccccctgaagcgcttcaatgaccccagcggctgtgcccccagccctggggcctatgatgtgaagaccctggaggtgctgaagggccctgtgtccttccagaagagccagcgcttcaagcagcagaaggagagcaagcagaacctgaatgtggacaaggacaccaccctgcctgccagcgccaggaaggtgaagagcagcgagagcaagatccgggtgctgctgcaggagcggggggcccaggaccggcgcatccaggacctggagacagagctggagaagatggaggcccggctgaatgctgccctgcgggagaagaccagcctgagcgccaacaatgccaccctggagaagcagctgattgagctgaccaggaccaatgagctgctgaagagcaagttctctgaaaatggaaaccagaagaacctgcgcatcctgagcctggagctgatgaagctgaggaacaagcgggagaccaagatgaggggcatgatggccaagcaggagggcatggagatgaagctgcaggtgacccagaggagcctggaggagagccagggcaagatcgcccagctggagggcaagctggtgtccattgagaaggagaagattgatgagaagtcagaaacagagaagctgctggagtacatcgaggagatcagctgtgccagtgaccaggtggagaagtacaagctggacatcgcccagctggaggagaacctgaaggagaagaatgatgagatcctgagcctgaagcagagcctggaggagaacatcgtcatcctgagcaagcaggtggaggacctgaatgtgaagtgccagctgctggagaaggagaaggaggaccacgtgaacagaaaccgggagcacaatgaaaacctgaatgctgagatgcagaacctgaagcagaagttcatcctggagcagcaggagcgggagaagctgcagcagaagaagaagcagatgaggaggaagaagtag

SEQ ID NO: 19993 - DNA, 537 bp, Artificial Sequence
  Description of Artificial Sequence: Synthetic coding sequence
atgcacgtgaatggcaaggtggccctggtgactggagctgcccagggcatcggccgggcctttgctgaggccctgctgctgaagggggccaaggtggccctggtggactggaacctggaggccggcgtgcagtgcaaggccgccctggatgagcagtttgagccccagaagaccctcttcatccagtgtgatgtggccgaccagcagcagctgcgggacaccttcaggaaggtggtggaccacttcggccgcctggacatcctggtgaacaatgctggggtgaacaatgagaagaactgggagaagaccctgcagatcaacctggtgtctgtcatcagcggcacctacctgggcctggactacatgagcaagcagaatggaggagagggcggcatcatcatcaacatgagcagcctggccggcctgatgcctgtggcccagcagcctgtgtactgtgccagcaagcacggcatcgtgggcttcaccaggtctgctgcccccaccatcgactgccagtggattgacaacacccactag

SEQ ID NO: 19994 - DNA, 801 bp, Artificial Sequence
  Description of Artificial Sequence: Synthetic coding sequence
atgcacgtgaatggcaaggtggccctggtgactggagctgcccagggcatcggccgggcctttgctgaggccctgctgctgaagggggccaaggtggccctggtggactggaacctggaggccggcgtgcagtgcaaggccgccctggatgagcagtttgagccccagaagaccctcttcatccagtgtgatgtggccgaccagcagcagctgcgggacaccttcaggaaggtggtggaccacttcggccgcctggacatcctggtgaacaatgctggggtgaacaatgagaagaactgggagaagaccctgcagatcaacctggtgtctgtcatcagcggcacctacctgggcctggactacatgagcaagcagaatggaggagagggcggcatcatcatcaacatgagcagcctggccggcctgatgcctgtggcccagcagcctgtgtactgtgccagcaagcacggcatcgtgggcttcaccaggtctgctgccctggccgccaacctgatgaacagcggcgtgcggctgaatgccatctgccccggctttgtgaacacagccatcctggagagcattgagaaggaggagaacatgggccagtacatcgagtacaaggaccacatcaaggacatgatcaagtactacggcatcctggacccccccctgattgccaacggcctcatcaccctgattgaagatgatgccctgaatggagccatcatgaagatcaccaccagcaagggcatccacttccaggactatgacaccacccccttccaggccaagacccagtag

SEQ ID NO: 19995 - DNA, 438 bp, Artificial Sequence
  Description of Artificial Sequence: Synthetic coding sequence
atgagcaagcagaatggaggagagggcggcatcatcatcaacatgagcagcctggccggcctgatgcctgtggcccagcagcctgtgtactgtgccagcaagcatggaattgtgggcttcaccaggtctgctgccctggccgccaacctgatgaacagcggcgtgcggctgaatgccatctgccccggctttgtgaacacagccatcctggagagcattgagaaggaggagaacatgggccagtacatcgagtacaaggaccacatcaaggacatgatcaagtactacggcatcctggaccccccactcatcgccaacggcctcatcaccctgattgaagatgatgccctgaatggagccatcatgaagatcaccaccagcaagggcatccacttccaggactatgacaccacccccttccaggccaagacccagtag

SEQ ID NO: 19996 - DNA, 438 bp, Artificial Sequence; identical to SEQ ID NO: 19995
  Description of Artificial Sequence: Synthetic coding sequence

SEQ ID NO: 19997 - DNA, 432 bp, Artificial Sequence
  Description of Artificial Sequence: Synthetic coding sequence
atgcacgtgaatggcaaggtggccctggtgactggagctgcccagggcatcggccgggcctttgctgaggccctgctgctgaagggggccaaggtggccctggtggactggaacctggaggccggcgtgcagtgcaaggccgccctggatgagcagtttgagccccagaagaccctcttcatccagtgtgatgtggccgaccagcagcagctgcgggacaccttcaggaaggtggtggaccacttcggccgcctggacatcctggtgaacaatgctggggtgaacaatgagaagaactgggagaagaccctgcagatcaacctggtgtctgtcatcagcggcacctacctgggcctggactacatgagcaagcagaatggaggagagggcggcatcatcatcaacatgagcagcctggccgcccaccactag

SEQ ID NO: 19998 - DNA, 2202 bp, Artificial Sequence
  Description of Artificial Sequence: Synthetic coding sequence
atgaccttccctgaggccgacatcctgctgaagagcggggagtgtgccggccagaccatgctggacaccatggaggcccctggccacagccggcagctgctgctgcagctgaacaaccagaggaccaagggcttcctgtgtgatgtgatcatcgtggtgcagaatgccctcttccgggcccacaagaatgtgctggccgccagcagcgcctacctgaagagcctggtggtgcatgacaacctgctgaacctggaccatgacatggtgtccccagctgtgttccggctggtgctggacttcatctacacaggccgcctggctgatggagctgaggccgctgctgctgctgctgtggcccctggagctgagcccagcctgggcgctgtgctggccgccgccagctacctgcagatcccagacctggtggccctgtgcaagaagaggctgaagagacatggcaagtactgccacctgcggggcggcggcggcggcggcggcggctacgccccctacggccggcccggccggggcctgcgggccgccacccctgtgatccaggcctgctaccccagccctgtgggccccccacctcctcctgctgctgagcccccatctggccctgaggccgctgtgaacacccactgtgccgagctgtatgccagcggccctggccctgctgctgccctgtgtgccagcgagcggcgctgcagccccctgtgtggcctggacctgagcaagaagagccccccaggcagcgctgcccctgagcggcccctggccgagcgggagctgccccccaggccagacagccccccatctgctggccctgctgcctacaaggagccccccctggccctgcccagcctgccccccctgcccttccagaagctggaggaggccgccccacccagcgaccccttccggggcggcagcggcagccctggccctgagcccccaggccgcccagatggccccagcctgctgtaccgctggatgaagcatgagcccggcctgggcagctatggagatgagctgggccgggagcggggcagccccagcgagcgctgtgaggagagaggaggagatgctgctgtgtccccaggcggcccccccctgggcctggcccccccaccccgctacccaggcagcctggatggccctggagctggaggagatggagatgactacaagagcagcagcgaggagaccggcagcagcgaggaccccagccccccaggcggccacctggagggctacccctgcccccacctggcctacggggagcctgagagctttggagacaacctgtatgtgtgcatcccctgtgggaagggcttccccagcagcgagcagctgaatgcccacgtggaggcccacgtggaggaggaggaggccctgtatggccgggcagaggccgctgaggtggccgccggggccgccggcctgggccccccatttggaggcggcggggacaaggtggccggggcccctgggggcctgggggagctgctgcggccctaccgctgtgccagctgtgacaagagctacaaggaccctgccaccctgcggcagcacgagaagacccactggctgacccggccctacccctgcaccatctgtgggaagaagttcacccagaggggcaccatgaccaggcacatgaggagccacctgggcctgaagccctttgcctgtgatgcctgtggcatgaggttcacccggcagtaccgcctgacagagcacatgaggatccacagcggggagaagccctatgagtgccaggtgtgtggcggcaagtttgcccagcagaggaacctgatcagccacatgaagatgcatgctgtgggcggcgctgctggagctgctggggccctggccggcctgggcggcctgcccggggtgcccggcccagatggcaagggcaagctggacttccctgagggcgtgtttgctgtggcccggctgacagctgagcagctgagcctgaagcagcaggacaaggctgctgctgctgagctgctggcccagaccacccacttcctgcatgaccccaaggtggccctggagagcctgtaccccctggccaagttcaccgctgagctgggcctgagcccagacaaggctgctgaggtgctgagccagggcgcccacctggccgccggcccagatggccgcaccatcgaccgcttcagccccacctag

SEQ ID NO: 19999 - DNA, 2145 bp, Artificial Sequence
  Description of Artificial Sequence: Synthetic coding sequence
atgctggacaccatggaggcccctggccacagccggcagctgctgctgcagctgaacaaccagaggaccaagggcttcctgtgtgatgtgatcatcgtggtgcagaatgccctcttccgggcccacaagaatgtgctggccgccagcagcgcctacctgaagagcctggtggtgcatgacaacctgctgaacctggaccatgacatggtgtccccagctgtgttccggctggtgctggacttcatctacacaggccgcctggctgatggagctgaggccgctgctgctgctgctgtggcccctggagctgagcccagcctgggcgctgtgctggccgccgccagctacctgcagatcccagacctggtggccctgtgcaagaagaggctgaagagacatggcaagtactgccacctgcggggcggcggcggcggcggcggcggctacgccccctacggccggcccggccggggcctgcgggccgccacccctgtgatccaggcctgctaccccagccctgtgggccccccacctcctcctgctgctgagccccccagcggccctgaggccgctgtgaacacccactgtgccgagctgtatgccagcggccctggccctgctgctgccctgtgtgccagcgagcggcgctgcagccccctgtgtggcctggacctgagcaagaagagccccccaggcagcgctgcccctgagcggcccctggccgagcgggagctgccccccaggccagacagcccccccagcgctggccctgctgcctacaaggagccccccctggccctgcccagcctgccccccctgcccttccagaagctggaggaggccgcccccccaagtgaccccttccggggcggcagcggcagccctggccctgagcccccaggccgcccagatggccccagcctgctgtaccgctggatgaagcatgagcccggcctgggcagctatggagatgagctgggccgggagcggggcagccccagcgagcgctgtgaggagagaggaggagatgctgctgtgtcccctgggggcccccccctgggcctggcccccccaccccgctacccaggcagcctggatggccctggagctggaggagatggagatgactacaagagcagcagcgaggagaccggcagcagcgaggaccccagccccccaggcggccacctggagggctacccctgcccccacctggcctatggagagcctgagagctttggagacaacctgtatgtgtgcatcccctgtgggaagggcttccccagcagcgagcagctgaatgcccacgtggaggcccacgtggaggaggaggaggccctgtatggccgggcagaggccgctgaggtggccgccggggctgctggcctgggccccccatttggaggcggcggggacaaggtggccggggcccctgggggcctgggggagctgctgcggccctaccgctgtgccagctgtgacaagagctacaaggaccctgccaccctgcggcagcacgagaagacccactggctgacccggccctacccctgcaccatctgtgggaagaagttcacccagaggggcaccatgaccaggcacatgaggagccacctgggcctgaagccctttgcctgtgatgcctgtggcatgaggttcacccggcagtaccgcctgacagagcacatgaggatccacagcggggagaagccctatgagtgccaggtgtgtggcggcaagtttgcccagcagaggaacctgatcagccacatgaagatgcatgctgtgggcggggccgccggggctgctggggccctggccggcctgggcggcctgcccggggtgcccggcccagatggcaagggcaagctggacttccctgagggcgtgtttgctgtggcccggctgacagctgagcagctgagcctgaagcagcaggacaaggctgctgctgctgagctgctggcccagaccacccacttcctgcatgaccccaaggtggccctggagagcctgtaccccctggccaagttcaccgctgagctgggcctgagcccagacaaggctgctgaggtgctgagccagggcgcccacctggccgccggcccagatggccgcaccatcgaccgcttcagccccacctag

SEQ ID NO: 20000 - DNA, 2208 bp, Artificial Sequence
  Description of Artificial Sequence: Synthetic coding sequence
atggagggcgctgggggcgccaatgacaagaagaagatcagcagcgagaggaggaaggagaagagcagagatgctgcccggagcagaagaagcaaggagagcgaggtgttctatgagctggcccaccagctgcccctgccccacaacgtgagcagccacctggacaaggcctctgtgatgaggctgaccatctcctacctgcgggtgaggaagctgctggatgctggggacctggacattgaagatgacatgaaggcccagatgaactgcttctacctgaaggccctggatggctttgtgatggtgctgacagatgatggagacatgatctacatcagtgacaacgtgaacaagtacatgggcctgacccagtttgagctgaccggccacagcgtgtttgacttcacccacccctgtgaccacgaggagatgagggagatgctgacccacagaaatggcctggtgaagaagggcaaggagcagaacacccagaggagcttcttcctgaggatgaagtgcaccctgaccagccggggccgcaccatgaacatcaagagcgccacctggaaggtgctgcactgcaccggccacatccacgtgtatgacaccaacagcaaccagccccagtgtggctacaagaagccacccatgacctgcctggtgctgatctgtgagcccatcccccaccccagcaacatcgagatccccctggacagcaagaccttcctgagccgccacagcctggacatgaagttctcctactgtgatgagcgcatcacagagctgatgggctatgagcctgaggagctgctgggccgcagcatctatgagtactaccacgccctggacagcgaccacctgaccaagacccaccacgacatgttcaccaagggccaggtgaccaccggccagtacaggatgctggccaagaggggcggctacgtgtgggtggagacccaggccaccgtcatctacaacaccaagaacagccagccccagtgcatcgtgtgtgtgaactacgtggtgtctggcatcatccagcacgacctgatcttcagcctgcagcagacagaatgtgtgctgaagcctgtggagagcagtgacatgaagatgacccagctgttcaccaaggtggagagcgaggacaccagcagcctgtttgacaagctgaagaaggagccagatgccctgaccctgctggccccagctgctggggacaccatcatcagcctggactttggcagcaatgacacagaaacagatgaccagcagctggaggaggtgcccctgtacaatgatgtgatgctgcccagccccaatgagaagctgcagaacatcaacctggccatgagccccctgcccacagctgagacccccaagcccctgcggagcagcgctgaccctgccctgaaccaggaggtggccctgaagctggagcccaaccctgagagcctggagctgtccttcaccatgccccagatccaggaccagacccccagccccagtgatggcagcacccggcagagcagccctgagcccaacagccccagcgagtactgcttctacgtggacagcgacatggtgaatgagttcaagctggagctggtggagaagctgtttgctgaggacacagaggccaagaaccccttcagcacccaggacacagacctggacctggagatgctggccccctacatccccatggatgatgacttccagctgcggagctttgaccagctgagccccctggagagcagcagcgccagccctgagagcgccagcccccagagcacagtgaccgtcttccagcagacccagatccaggagcccacagccaatgccaccaccaccacagccaccacagatgagctgaagacagtgaccaaggacaggatggaggacatcaagatcctgattgccagccccagccccacccacatccacaaggagaccaccagcgccaccagcagcccctacagagacacccagagcaggacagccagccccaacagagctgggaagggcgtgattgagcagacagagaagagccaccccaggagccccaacgtgctgtctgtggccctgagccagaggaccaccgtgcctgaggaggagctgaaccccaagatcctggccctgcagaatgcccagaggaagaggaagatggagcatgatggcagcctcttccaggccgtgggcatcatctag

SEQ ID NO: 20001 - DNA, 2481 bp, Artificial Sequence
  Description of Artificial Sequence: Synthetic coding sequence
atggagggcgctgggggcgccaatgacaagaagaagatcagcagcgagaggaggaaggagaagagcagagatgctgcccggagcagaagaagcaaggagagcgaggtgttctatgagctggcccaccagctgcccctgccccacaacgtgagcagccacctggacaaggcctctgtgatgaggctgaccatctcctacctgcgggtgaggaagctgctggatgctggggacctggacattgaagatgacatgaaggcccagatgaactgcttctacctgaaggccctggatggctttgtgatggtgctgacagatgatggagacatgatctacatcagtgacaacgtgaacaagtacatgggcctgacccagtttgagctgaccggccacagcgtgtttgacttcacccacccctgtgaccacgaggagatgagggagatgctgacccacagaaatggcctggtgaagaagggcaaggagcagaacacccagaggagcttcttcctgaggatgaagtgcaccctgaccagccggggccgcaccatgaacatcaagagcgccacctggaaggtgctgcactgcaccggccacatccacgtgtatgacaccaacagcaaccagccccagtgtggctacaagaagccacccatgacctgcctggtgctgatctgtgagcccatcccccaccccagcaacatcgagatccccctggacagcaagaccttcctgagccgccacagcctggacatgaagttctcctactgtgatgagcgcatcacagagctgatgggctatgagcctgaggagctgctgggccgcagcatctatgagtactaccacgccctggacagcgaccacctgaccaagacccaccacgacatgttcaccaagggccaggtgaccaccggccagtacaggatgctggccaagaggggcggctacgtgtgggtggagacccaggccaccgtcatctacaacaccaagaacagccagccccagtgcatcgtgtgtgtgaactacgtggtgtctggcatcatccagcacgacctgatcttcagcctgcagcagacagaatgtgtgctgaagcctgtggagagcagtgacatgaagatgacccagctgttcaccaaggtggagagcgaggacaccagcagcctgtttgacaagctgaagaaggagccagatgccctgaccctgctggccccagctgctggggacaccatcatcagcctggactttggcagcaatgacacagaaacagatgaccagcagctggaggaggtgcccctgtacaatgatgtgatgctgcccagccccaatgagaagctgcagaacatcaacctggccatgagccccctgcccacagctgagacccccaagcccctgcggagcagcgctgaccctgccctgaaccaggaggtggccctgaagctggagcccaaccctgagagcctggagctgtccttcaccatgccccagatccaggaccagacccccagccccagtgatggcagcacccggcagagcagccctgagcccaacagccccagcgagtactgcttctacgtggacagcgacatggtgaatgagttcaagctggagctggtggagaagctgtttgctgaggacacagaggccaagaaccccttcagcacccaggacacagacctggacctggagatgctggccccctacatccccatggatgatgacttccagctgcggagctttgaccagctgagccccctggagagcagcagcgccagccctgagagcgccagcccccagagcacagtgaccgtcttccagcagacccagatccaggagcccacagccaatgccaccaccaccacagccaccacagatgagctgaagacagtgaccaaggacaggatggaggacatcaagatcctgattgccagccccagccccacccacatccacaaggagaccaccagcgccaccagcagcccctacagagacacccagagcaggacagccagccccaacagagctgggaagggcgtgattgagcagacagagaagagccaccccaggagccccaacgtgctgtctgtggccctgagccagaggaccaccgtgcctgaggaggagctgaaccccaagatcctggccctgcagaatgcccagaggaagaggaagatggagcatgatggcagcctcttccaggccgtgggcatcggcaccctgctgcagcagccagatgaccatgctgccaccaccagcctgtcctggaagagggtgaagggctgcaagagcagcgagcagaatggcatggagcagaagaccatcatcctgatccccagcgacctggcctgccgcctgctgggccagagcatggatgagagcggcctgccccagctgaccagctatgactgtgaggtgaatgcccccatccagggcagcaggaacctgctgcagggcgaggagctgctgcgggccctggaccaggtgaactag

SEQ ID NO: 20002 - DNA, 2304 bp, Artificial Sequence
  Description of Artificial Sequence: Synthetic coding sequence
atgaggctgaccatctcctacctgcgggtgaggaagctgctggatgctggggacctggacattgaagatgacatgaaggcccagatgaactgcttctacctgaaggccctggatggctttgtgatggtgctgacagatgatggagacatgatctacatcagtgacaacgtgaacaagtacatgggcctgacccagtttgagctgaccggccacagcgtgtttgacttcacccacccctgtgaccacgaggagatgagggagatgctgacccacagaaatggcctggtgaagaagggcaaggagcagaacacccagaggagcttcttcctgaggatgaagtgcaccctgaccagccggggccgcaccatgaacatcaagagcgccacctggaaggtgctgcactgcaccggccacatccacgtgtatgacaccaacagcaaccagccccagtgtggctacaagaagccacccatgacctgcctggtgctgatctgtgagcccatcccccaccccagcaacatcgagatccccctggacagcaagaccttcctgagccgccacagcctggacatgaagttctcctactgtgatgagcgcatcacagagctgatgggctatgagcctgaggagctgctgggccgcagcatctatgagtactaccacgccctggacagcgaccacctgaccaagacccaccacgacatgttcaccaagggccaggtgaccaccggccagtacaggatgctggccaagagaggaggctacgtgtgggtggagacccaggccaccgtcatctacaacaccaagaacagccagccccagtgcatcgtgtgtgtgaactacgtggtgtctggcatcatccagcacgacctgatcttcagcctgcagcagacagaatgtgtgctgaagcctgtggagagcagtgacatgaagatgacccagctgttcaccaaggtggagagcgaggacaccagcagcctgtttgacaagctgaagaaggagccagatgccctgaccctgctggccccagctgctggggacaccatcatcagcctggactttggcagcaatgacacagaaacagatgaccagcagctggaggaggtgcccctgtacaatgatgtgatgctgcccagccccaatgagaagctgcagaacatcaacctggccatgagccccctgcccacagctgagacccccaagcccctgcggagcagcgctgaccctgccctgaaccaggaggtggccctgaagctggagcccaaccctgagagcctggagctgtccttcaccatgccccagatccaggaccagacccccagccccagtgatggcagcacccggcagagcagccctgagcccaacagccccagcgagtactgcttctacgtggacagcgacatggtgaatgagttcaagctggagctggtggagaagctgtttgctgaggacacagaggccaagaaccccttcagcacccaggacacagacctggacctggagatgctggccccctacatccccatggatgatgacttccagctgcggagctttgaccagctgagccccctggagagcagcagcgccagccctgagagcgccagcccccagagcacagtgacagtgttccagcagacccagatccaggagcccacagccaatgccaccaccaccacagccaccacagatgagctgaagacagtgaccaaggacaggatggaggacatcaagatcctgattgccagccccagccccacccacatccacaaggagaccaccagcgccaccagcagcccctacagagacacccagagcaggacagccagccccaacagagctggaaaaggagtcatcgagcagacagagaagagccaccccaggagccccaacgtgctgtctgtggccctgagccagaggaccaccgtgcctgaggaggagctgaaccccaagatcctggccctgcagaatgcccagaggaagaggaagatggagcatgatggcagcctcttccaggccgtgggcatcggcaccctgctgcagcagccagatgaccacgccgccaccaccagcctgtcctggaagagggtgaagggctgcaagagcagcgagcagaatggcatggagcagaagaccatcatcctgatccccagcgacctggcctgccgcctgctgggccagagcatggatgaaagtggcctgccccagctgaccagctatgactgtgaggtgaatgcccccatccagggcagcaggaacctgctgcagggcgaggagctgctgcgggccctggaccaggtgaactag

SEQ ID NO: 20003 - DNA, 2484 bp, Artificial Sequence
  Description of Artificial Sequence: Synthetic coding sequence
atggagggcgctgggggcgccaatgacaagaagaaccgcatcagcagcgagaggaggaaggagaagagcagagatgctgcccggagccgccgcagcaaggagagcgaggtgttctatgagctggcccaccagctgcccctgccccacaacgtgagcagccacctggacaaggcctctgtgatgaggctgaccatctcctacctgcgggtgaggaagctgctggatgctggggacctggacattgaagatgacatgaaggcccagatgaactgcttctacctgaaggccctggatggctttgtgatggtgctgacagatgatggagacatgatctacatcagtgacaacgtgaacaagtacatgggcctgacccagtttgagctgaccggccacagcgtgtttgacttcacccacccctgtgaccacgaggagatgagggagatgctgacccacagaaatggcctggtgaagaagggcaaggagcagaacacccagaggagcttcttcctgaggatgaagtgcaccctgaccagccggggccgcaccatgaacatcaagagcgccacctggaaggtgctgcactgcaccggccacatccacgtgtatgacaccaacagcaaccagccccagtgtggctacaagaagccacccatgacctgcctggtgctgatctgtgagcccatcccccaccccagcaacatcgagatccccctggacagcaagaccttcctgagccgccacagcctggacatgaagttctcctactgtgatgagcgcatcacagagctgatgggctatgagcctgaggagctgctgggccgcagcatctatgagtactaccacgccctggacagcgaccacctgaccaagacccaccacgacatgttcaccaagggccaggtgaccaccggccagtacaggatgctggccaagagaggaggctacgtgtgggtggagacccaggccaccgtcatctacaacaccaagaacagccagccccagtgcatcgtgtgtgtgaactacgtggtgtctggcatcatccagcacgacctgatcttcagcctgcagcagacagaatgtgtgctgaagcctgtggagagcagtgacatgaagatgacccagctgttcaccaaggtggagagcgaggacaccagcagcctgtttgacaagctgaagaaggagccagatgccctgaccctgctggccccagctgctggggacaccatcatcagcctggactttggcagcaatgacacagaaacagatgaccagcagctggaggaggtgcccctgtacaatgatgtgatgctgcccagccccaatgagaagctgcagaacatcaacctggccatgagccccctgcccacagctgagacccccaagcccctgcggagcagcgctgaccctgccctgaaccaggaggtggccctgaagctggagcccaaccctgagagcctggagctgtccttcaccatgccccagatccaggaccagacccccagccccagtgatggcagcacccggcagagcagccctgagcccaacagccccagcgagtactgcttctacgtggacagcgacatggtgaatgagttcaagctggagctggtggagaagctgtttgctgaggacacagaggccaagaaccccttcagcacccaggacacagacctggacctggagatgctggccccctacatccccatggatgatgacttccagctgcggagctttgaccagctgagccccctggagagcagcagcgccagccctgagagcgccagcccccagagcacagtgacagtgttccagcagacccagatccaggagcccacagccaatgccaccaccaccacagccaccacagatgagctgaagacagtgaccaaggacaggatggaggacatcaagatcctgattgccagccccagccccacccacatccacaaggagaccaccagcgccaccagcagcccctacagagacacccagagcaggacagccagccccaacagagctggaaaaggagtcatcgagcagacagagaagagccaccccaggagccccaacgtgctgtctgtggccctgagccagaggaccaccgtgcctgaggaggagctgaaccccaagatcctggccctgcagaatgcccagaggaagaggaagatggagcatgatggcagcctcttccaggccgtgggcatcggcaccctgctgcagcagccagatgaccacgccgccaccaccagcctgtcctggaagagggtgaagggctgcaagagcagcgagcagaatggcatggagcagaagaccatcatcctgatccccagcgacctggcctgccgcctgctgggccagagcatggatgaaagtggcctgccccagctgaccagctatgactgtgaggtgaatgcccccatccagggcagcaggaacctgctgcagggcgaggagctgctgcgggccctggaccaggtgaactag

SEQ ID NO: 20004 - DNA, 2553 bp, Artificial Sequence
  Description of Artificial Sequence: Synthetic coding sequence
atgagcagccagtgccgcagcctggagaacaagtttgtgttcctgaaggagggcctgggcaacagcaagccagaggagctggaggagatcagaattgaaaatggccgcatcagcagcgagaggaggaaggagaagagcagagatgctgcccggagcagaagaagcaaggagagcgaggtgttctatgagctggcccaccagctgcccctgccccacaacgtgagcagccacctggacaaggcctctgtgatgaggctgaccatctcctacctgcgggtgaggaagctgctggatgctggggacctggacattgaagatgacatgaaggcccagatgaactgcttctacctgaaggccctggatggctttgtgatggtgctgacagatgatggagacatgatctacatcagtgacaacgtgaacaagtacatgggcctgacccagtttgagctgaccggccacagcgtgtttgacttcacccacccctgtgaccacgaggagatgagggagatgctgacccacagaaatggcctggtgaagaagggcaaggagcagaacacccagaggagcttcttcctgaggatgaagtgcaccctgaccagccggggccgcaccatgaacatcaagagcgccacctggaaggtgctgcactgcaccggccacatccacgtgtatgacaccaacagcaaccagccccagtgtggctacaagaagccacccatgacctgcctggtgctgatctgtgagcccatcccccaccccagcaacatcgagatccccctggacagcaagaccttcctgagccgccacagcctggacatgaagttctcctactgtgatgagcgcatcacagagctgatgggctatgagcctgaggagctgctgggccgcagcatctatgagtactaccacgccctggacagcgaccacctgaccaagacccaccacgacatgttcaccaagggccaggtgaccaccggccagtacaggatgctggccaagaggggcggctacgtgtgggtggagacccaggccaccgtcatctacaacaccaagaacagccagccccagtgcatcgtgtgtgtgaactacgtggtgtctggcatcatccagcacgacctgatcttcagcctgcagcagacagaatgtgtgctgaagcctgtggagagcagtgacatgaagatgacccagctgttcaccaaggtggagagcgaggacaccagcagcctgtttgacaagctgaagaaggagccagatgccctgaccctgctggccccagctgctggggacaccatcatcagcctggactttggcagcaatgacacagaaacagatgaccagcagctggaggaggtgcccctgtacaatgatgtgatgctgcccagccccaatgagaagctgcagaacatcaacctggccatgagccccctgcccacagctgagacccccaagcccctgcggagcagcgctgaccctgccctgaaccaggaggtggccctgaagctggagcccaaccctgagagcctggagctgtccttcaccatgccccagatccaggaccagacccccagccccagtgatggcagcacccggcagagcagccctgagcccaacagccccagcgagtactgcttctacgtggacagcgacatggtgaatgagttcaagctggagctggtggagaagctgtttgctgaggacacagaggccaagaaccccttcagcacccaggacacagacctggacctggagatgctggccccctacatccccatggatgatgacttccagctgcggagctttgaccagctgagccccctggagagcagcagcgccagccctgagagcgccagcccccagagcacagtgaccgtcttccagcagacccagatccaggagcccacagccaatgccaccaccaccacagccaccacagatgagctgaagacagtgaccaaggacaggatggaggacatcaagatcctgattgccagccccagccccacccacatccacaaggagaccaccagcgccaccagcagcccctacagagacacccagagcaggacagccagccccaacagagctgggaagggcgtgattgagcagacagagaagagccaccccaggagccccaacgtgctgtctgtggccctgagccagaggaccaccgtgcctgaggaggagctgaaccccaagatcctggccctgcagaatgcccagaggaagaggaagatggagcatgatggcagcctcttccaggccgtgggcatcggcaccctgctgcagcagccagatgaccatgctgccaccaccagcctgtcctggaagagggtgaagggctgcaagagcagcgagcagaatggcatggagcagaagaccatcatcctgatccccagcgacctggcctgccgcctgctgggccagagcatggatgagagcggcctgccccagctgaccagctatgactgtgaggtgaatgcccccatccagggcagcaggaacctgctgcagggcgaggagctgctgcgggccctggaccaggtgaactag

SEQ ID NO: 20005 - DNA, 1734 bp, Artificial Sequence
  Description of Artificial Sequence: Synthetic coding sequence
atgaagttctcctactgtgatgagcgcatcacagagctgatgggctatgagcctgaggagctgctgggccgcagcatctatgagtactaccacgccctggacagcgaccacctgaccaagacccaccacgacatgttcaccaagggccaggtgaccaccggccagtacaggatgctggccaagagaggaggctacgtgtgggtggagacccaggccaccgtcatctacaacaccaagaacagccagccccagtgcatcgtgtgtgtgaactacgtggtgtctggcatcatccagcacgacctgatcttcagcctgcagcagacagaatgtgtgctgaagcctgtggagagcagtgacatgaagatgacccagctgttcaccaaggtggagagcgaggacaccagcagcctgtttgacaagctgaagaaggagccagatgccctgaccctgctggccccagctgctggggacaccatcatcagcctggactttggcagcaatgacacagaaacagatgaccagcagctggaggaggtgcccctgtacaatgatgtgatgctgcccagccccaatgagaagctgcagaacatcaacctggccatgagccccctgcccacagctgagacccccaagcccctgcggagcagcgctgaccctgccctgaaccaggaggtggccctgaagctggagcccaaccctgagagcctggagctgtccttcaccatgccccagatccaggaccagacccccagccccagtgatggcagcacccggcagagcagccctgagcccaacagccccagcgagtactgcttctacgtggacagcgacatggtgaatgagttcaagctggagctggtggagaagctgtttgctgaggacacagaggccaagaaccccttcagcacccaggacacagacctggacctggagatgctggccccctacatccccatggatgatgacttccagctgcggagctttgaccagctgagccccctggagagcagcagcgccagccctgagagcgccagcccccagagcacagtgacagtgttccagcagacccagatccaggagcccacagccaatgccaccaccaccacagccaccacagatgagctgaagacagtgaccaaggacaggatggaggacatcaagatcctgattgccagccccagccccacccacatccacaaggagaccaccagcgccaccagcagcccctacagagacacccagagcaggacagccagccccaacagagctggaaaaggagtcatcgagcagacagagaagagccaccccaggagccccaacgtgctgtctgtggccctgagccagaggaccaccgtgcctgaggaggagctgaaccccaagatcctggccctgcagaatgcccagaggaagaggaagatggagcatgatggcagcctcttccaggccgtgggcatcggcaccctgctgcagcagccagatgaccacgccgccaccaccagcctgtcctggaagagggtgaagggctgcaagagcagcgagcagaatggcatggagcagaagaccatcatcctgatccccagcgacctggcctgccgcctgctgggccagagcatggatgaaagtggcctgccccagctgaccagctatgactgtgaggtgaatgcccccatccagggcagcaggaacctgctgcagggcgaggagctgctgcgggccctggaccaggtgaactag

SEQ ID NO: 20006 - DNA, 2304 bp, Artificial Sequence; identical to SEQ ID NO: 20002
  Description of Artificial Sequence: Synthetic coding sequence

SEQ ID NO: 20007 - DNA, 1296 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacactggagagcggcccttccagtgcaaccagtgtggggccagcttcacccagaagggcaacctgctgcggcacatcaagctgcacactggagagaagcccttcaagtgccacctgtgcaactatgcctgccagaggagagatgccctgaccggccacctgcggacccacagcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20008 - DNA, 1245 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacacagccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20009 - DNA, 1413 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacactggagagcggcccttccagtgcaaccagtgtggggccagcttcacccagaagggcaacctgctgcggcacatcaagctgcacactggagagaagcccttcaagtgccacctgtgcaactatgcctgccagaggagagatgccctgaccggccacctgcggacccacagcgtggagaagccctacaagtgtgagttctgtggccgcagctacaagcagaggagcagcctggaggagcacaaggagcgctgcaggaccttcctgcagagcacagatcctggggacaccggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20010 - DNA, 1413 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacactggagagcggcccttccagtgcaaccagtgtggggccagcttcacccagaagggcaacctgctgcggcacatcaagctgcacactggagagaagcccttcaagtgccacctgtgcaactatgcctgccagaggagagatgccctgaccggccacctgcggacccacagcgccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20011 - DNA, 1101 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagtggagaagccctacaagtgtgagttctgtggccgcagctacaagcagaggagcagcctggaggagcacaaggagcgctgcaggaccttcctgcagagcacagaccccggggacacagccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20012 - DNA, 1128 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacactggagagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20013 - DNA, 867 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggaggagagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20014 - DNA, 1269 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggaggagagcggcccttccagtgcaaccagtgtggggccagcttcacccagaagggcaacctgctgcggcacatcaagctgcacactggagagaagcccttcaagtgccacctgtgcaactatgcctgccagaggagagatgccctgaccggccacctgcggacccacagcgtggagaagccctacaagtgtgagttctgtggccgcagctacaagcagaggagcagcctggaggagcacaaggagcgctgcaggaccttcctgcagagcacagaccccggggacacagccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20015 - DNA, 984 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20016 - DNA, 1392 bp, Artificial Sequence
  Description of Artificial Sequence: Synthetic coding sequence
tgacaggagcagagcgtgcctgcagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacactggagagcggcccttccagtgcaaccagtgtggggccagcttcacccagaagggcaacctgctgcggcacatcaagctgcacactggagagaagcccttcaagtgccacctgtgcaactatgcctgccagaggagagatgccctgaccggccacctgcggacccacagcgtggagaagccctacaagtgtgagttctgtggccgcagctacaagcagaggagcagcctggaggagcacaaggagcgctgcaggaccttcctgcagagcacagatcctggggacacagccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20017 - DNA, 1275 bp, Artificial Sequence
  Description of Artificial Sequence: Synthetic coding sequence
tgacaggagcagagcgtgcctgcagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacactggagagcggcccttccagtgcaaccagtgtggggccagcttcacccagaagggcaacctgctgcggcacatcaagctgcacactggagagaagcccttcaagtgccacctgtgcaactatgcctgccagaggagagatgccctgaccggccacctgcggacccacagcgccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20018 - DNA, 1362 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacacagtggagaagccctacaagtgtgagttctgtggccgcagctacaagcagaggagcagcctggaggagcacaaggagcgctgcaggaccttcctgcagagcacagatcctggggacacagccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20019 - DNA, 1530 bp, Artificial Sequence
  Description of Artificial Sequence: Synthetic coding sequence
atggaggacatccagaccaatgctgagctgaagagcacccaggagcagagcgtgcctgctgagagcgctgctgtgctgaatgactacagcctgaccaagagccatgagatggagaatgtggacagcggggagggccctgccaatgaagatgaagatattggagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacactggagagcggcccttccagtgcaaccagtgtggggccagcttcacccagaagggcaacctgctgcggcacatcaagctgcacactggagagaagcccttcaagtgccacctgtgcaactatgcctgccagaggagagatgccctgaccggccacctgcggacccacagcgtggagaagccctacaagtgtgagttctgtggccgcagctacaagcagaggagcagcctggaggagcacaaggagcgctgcaggaccttcctgcagagcacagatcctggggacacagccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20020 - DNA, 1428 bp, Artificial Sequence
  Description of Artificial Sequence: Synthetic coding sequence
atggaggacatccagaccaatgctgagctgaagagcacccaggagcagagcgtgcctgcagatgacagcatgaaggtgaaggatgagtacagcgagagagatgaaaatgtgctgaagtctgagcccatgggaaatgctgaggagcctgagatcccctacagctacagccgggagtacaatgaatatgagaacatcaagctggagcggcacgtggtgtcctttgacagcagccggcccaccagcggcaagatgaactgtgatgtgtgtggcctgagctgcatctccttcaacgtgctgatggtgcacaagaggagccacactggagagcggcccttccagtgcaaccagtgtggggccagcttcacccagaagggcaacctgctgcggcacatcaagctgcacactggagagaagcccttcaagtgccacctgtgcaactatgcctgccagaggagagatgccctgaccggccacctgcggacccacagcgtggagaagccctacaagtgtgagttctgtggccgcagctacaagcagaggagcagcctggaggagcacaaggagcgctgcaggaccttcctgcagagcacagatcctggggacacagccagcgctgaggcccggcacatcaaggccgagatgggcagcgagcgggccctggtgctggaccggctggccagcaatgtggccaagaggaagagctccatgccccagaagttcatcggggagaagaggcactgctttgatgtgaactacaacagcagctacatgtatgagaaggagagcgagctgatccagaccaggatgatggaccaggccatcaacaatgccatctcctacctgggcgctgaggccctgcggcccctggtgcagaccccaccagcccccaccagcgagatggtgcctgtgatcagctccatgtaccccatcgccctgaccagggctgagatgagcaatggagccccccaggagctggagaagaagagcatccacctgcctgagaagtctgtgcccagcgagcggggcctgagccccaacaacagcggccatgacagcacagacacagacagcaaccacgaggagcggcagaaccacatctaccagcagaaccacatggtgctgagccgggccagaaatggcatgcccctgctgaaggaggtgcccaggagctatgagctgctgaagcccccacccatctgcccccgggacagcgtgaaggtgatcaacaaggagggggaggtgatggatgtgtaccgctgtgaccactgccgggtgctcttcctggactatgtgatgttcaccatccacatgggctgccacggcttccgggacccctttgagtgcaacatgtgtggctaccgcagccatgacagatatgagttcagcagccacatcgcccggggggagcaccgggccctgctgaagtag

SEQ ID NO: 20021 - DNA, 450 bp, Artificial Sequence
  Description of Artificial Sequence: Synthetic coding sequence
atgaaggtggccagcggcagcacagccacagctgctgctggccccagctgtgccctgaaggccggcaagacagccagcggggccggggaggtggtgcgctgcctgtctgagcagagcgtggccatcagccgctgtgccggcggggccggggcccggctgcctgccctgctggatgagcagcaggtgaatgtgctgctgtatgacatgaatggctgctacagccggctgaaggagctggtgcccaccctgccccagaacaggaaggtgtccaaggtggagatcctgcagcacgtgattgactacatccgggacctgcagctggagctgaacagcgagagcgaggtgggcacccctgggggccggggcctgcctgtgcgggcccccctgagcaccctgaatggagagatcagcgccctgacagctgaggtgcgcagcagaagtgaccactag

SEQ ID NO: 20022 - DNA, 468 bp, Artificial Sequence
  Description of Artificial Sequence: Synthetic coding sequence
atgaaggtggccagcggcagcacagccacagctgctgctggccccagctgtgccctgaaggccggcaagacagccagcggggccggggaggtggtgcgctgcctgtctgagcagagcgtggccatcagccgctgtgccggcggggccggggcccggctgcctgccctgctggatgagcagcaggtgaatgtgctgctgtatgacatgaatggctgctacagccggctgaaggagctggtgcccaccctgccccagaacaggaaggtgtccaaggtggagatcctgcagcacgtgattgactacatccgggacctgcagctggagctgaacagcgagagcgaggtgggcacccctgggggccggggcctgcctgtgcgggcccccctgagcaccctgaatggagagatcagcgccctgacagctgaggccgcctgtgtgcctgcagatgaccgcatcctgtgcaggtag

SEQ ID NO: 20023 - DNA, 738 bp, Artificial Sequence
  Description of Artificial Sequence: Synthetic coding sequence
atggctgctggcatgtacctggagcactacctggacagcattgagaacctgccctttgagctgcagaggaacttccagctgatgagggacctggaccagaggacagaggacctgaaggccgagattgacaagctggccacagagtacatgagcagcgcccggagcctgagcagcgaggagaagctggccctgctgaagcagatccaggaggcctacggcaagtgcaaggagtttggagatgacaaggtgcagctggccatgcagacctatgagatggtggacaagcacatccggcggctggacacagacctggccaggtttgaagctgacctgaaggagaagcagatcgagagcagtgactatgacagcagcagcagcaaaggaagaacccagaaggagaagaaggccgcccgggcccggagcaagggcaagaacagtgatgaggaggcccccaagacagcccagaagaagctgaagctggtgaggaccagcccagaatatggcatgcccagcgtgaccttcggctctgtgcaccccagtgatgtgctggacatgcctgtggaccccaatgagcccacctactgcctgtgccaccaggtgtcctatggagagatgattggctgtgacaacccagactgcagcattgagtggttccactttgcctgtgtgggcctgaccaccaagccccggggcaagtggttctgcccccgctgcagccaggagaggaagaagaagtag

SEQ ID NO: 20024 - DNA, 840 bp, Artificial Sequence
  Description of Artificial Sequence: Synthetic coding sequence
atgctgagccctgccaacggggagcagctgcacctggtgaactacgtggaggactacctggacagcattgagagcctgccctttgacctgcagagaaatgtgtccctgatgagagaaattgatgccaagtaccaggagatcctgaaggagctggatgaatgttatgagcgcttcagccgggagacagatggagcccagaagaggaggatgctgcactgtgtgcagagggccctgatccgcagccaggagctgggagatgagaagatccagatcgtgtcccagatggtggagctggtggagaacagaacccggcaggtggacagccacgtggagctgtttgaggcccagcaggagctgggggacacagctggcaacagcggcaaggccggggctgaccggcccaagggggaggccgccgcccaggccgacaagcccaacagcaagaggagccggcggcagaggaacaatgaaaatcgggagaatgccagcagcaaccacgaccatgatgatggagccagcggcacccccaaggagaagaaggccaagaccagcaagaagaagaagaggagcaaggccaaggccgagcgggaggccagccctgctgacctgcccatcgaccccaatgagcccacctactgcctgtgcaaccaggtgtcctatggagagatgattggctgtgacaatgatgagtgccccatcgagtggttccacttcagctgtgtgggcctgaaccacaagcccaagggcaagtggtactgccccaagtgcagaggagaaaatgagaagaccatggacaaggccctggagaagagcaagaaggagcgggcctacaacagatag

SEQ ID NO: 20025 - DNA, 708 bp, Artificial Sequence
  Description of Artificial Sequence: Synthetic coding sequence
atggagatcctgaaggagctggatgaatgttatgagcgcttcagccgggagacagatggagcccagaagaggaggatgctgcactgtgtgcagagggccctgatccgcagccaggagctgggagatgagaagatccagatcgtgtcccagatggtggagctggtggagaacagaacccggcaggtggacagccacgtggagctgtttgaggcccagcaggagctgggggacacagctggcaacagcggcaaggccggggctgaccggcccaagggggaggccgccgcccaggccgacaagcccaacagcaagaggagccggcggcagaggaacaatgaaaatcgggagaatgccagcagcaaccacgaccatgatgatggagccagcggcacccccaaggagaagaaggccaagaccagcaagaagaagaagaggagcaaggccaaggccgagcgggaggccagccctgctgacctgcccatcgaccccaatgagcccacctactgcctgtgcaaccaggtgtcctatggagagatgattggctgtgacaatgatgagtgccccatcgagtggttccacttcagctgtgtgggcctgaaccacaagcccaagggcaagtggtactgccccaagtgcagaggagaaaatgagaagaccatggacaaggccctggagaagagcaagaaggagcgggcctacaacagatag

SEQ ID NO: 20026 - DNA, 1269 bp, Artificial Sequence
  Description of Artificial Sequence: Synthetic coding sequence
atgagctttgtggagtgcccctaccacagccctgctgagcggctggtggccgaggctgatgagggcggccccagcgccatcaccggcatgggcctgtgcttccgctgcctgctcttctccttcagcggccgctctggagtggagggcggccgggtggacctgaatgtgtttggcagcctgggcctgcagccctggattggcagcagccgctgctggggcggcccctgcagcagcgccctgcgctgtggctggttcagctcctggcccccacccagcaagagcgccatccccatcggcggcggcagcagaggagctggccgggtgagccgctggcccccaccccactggctggaggcctggagggtgagccccctgcccctgagccccctgagccctgccaccttcggccggggcttcatcgctgtggccgtcatccctggcctgtgggcccggggccggggctgcagcagtgaccggctgcccaggcctgctggccctgcccggcggcagttccaggccgccagcctgctgacccggggctggggccgggcctggccctggaagcagatcctgaaggagctggatgagtgctatgagcgcttcagccgggagacagatggagcccagaagaggaggatgctgcactgtgtgcagagggccctgatccgcagccaggagctgggagatgagaagatccagatcgtgtcccagatggtggagctggtggagaacagaacccggcaggtggacagccacgtggagctgtttgaggcccagcaggagctgggggacacagctggcaacagcggcaaggccggggctgaccggcccaagggggaggccgccgcccaggccgacaagcccaacagcaagaggagccggcggcagagaaataatgaaaatagagaaaatgccagcagcaaccacgaccatgatgatggagccagcggcacccccaaggagaagaaggccaagaccagcaagaagaagaagaggagcaaggccaaggccgagcgggaggccagccctgctgacctgcccatcgaccccaatgagcccacctactgcctgtgcaaccaggtgtcctatggagagatgattggctgtgacaatgatgaatgtcccatcgagtggttccacttcagctgtgtgggcctgaaccacaagcccaagggcaagtggtactgccccaagtgccgcggggagaatgagaagaccatggacaaggccctggagaagagcaagaaggagcgggcctacaacagatag

SEQ ID NO: 20027 - DNA, 633 bp, Artificial Sequence
  Description of Artificial Sequence: Synthetic coding sequence
atgctgcactgtgtgcagagggccctgatccgcagccaggagctgggagatgagaagatccagatcgtgtcccagatggtggagctggtggagaacagaacccggcaggtggacagccacgtggagctgtttgaggcccagcaggagctgggggacacagctggcaacagcggcaaggccggggctgaccggcccaagggggaggccgccgcccaggccgacaagcccaacagcaagaggagccggcggcagagaaataatgaaaatagagaaaatgccagcagcaaccacgaccatgatgatggagccagcggcacccccaaggagaagaaggccaagaccagcaagaagaagaagaggagcaaggccaaggccgagcgggaggccagccctgctgacctgcccatcgaccccaatgagcccacctactgcctgtgcaaccaggtgtcctatggagagatgattggctgtgacaatgatgaatgtcccatcgagtggttccacttcagctgtgtgggcctgaaccacaagcccaagggcaagtggtactgccccaagtgccgcggggagaatgagaagaccatggacaaggccctggagaagagcaagaaggagcgggcctacaacagatag

SEQ ID NO: 20028 - DNA, 747 bp, Artificial Sequence
  Description of Artificial Sequence: Synthetic coding sequence
atggctgctggcatgtacctggagcactacctggacagcattgagaacctgccctttgagctgcagaggaacttccagctgatgagggacctggaccagaggacagaggacctgaaggccgagattgacaagctggccacagagtacatgagcagcgcccggagcctgagcagcgaggagaagctggccctgctgaagcagatccaggaggcctacggcaagtgcaaggagtttggagatgacaaggtgcagctggccatgcagacctatgagatggtggacaagcacatccggcggctggacacagacctggccaggtttgaagctgacctgaaggagaagcagatcgagagcagtgactatgacagcagcagcagcaagggcaagaagagcaggacccagaaggagaagaaggccgcccgggcccggagcaagggcaagaacagtgatgaggaggcccccaagacagcccagaagaagctgaagctggtgaggaccagcccagaatatggcatgcccagcgtgacctttggatctgtgcaccccagtgatgtgctggacatgcctgtggaccccaatgagcccacctactgcctgtgccaccaggtgtcctatggagagatgattggctgtgacaacccagactgcagcattgagtggttccactttgcctgtgtgggcctgaccaccaagccccggggcaagtggttctgcccccgctgcagccaggagaggaagaagaagtag

SEQ ID NO: 20029 - DNA, 750 bp, Artificial Sequence
  Description of Artificial Sequence: Synthetic coding sequence
atggctgctggcatgtacctggagcactacctggacagcattgagaacctgccctttgagctgcagaggaacttccagctgatgagggacctggaccagaggacagaggacctgaaggccgagattgacaagctggccacagagtacatgagcagcgcccggagcctgagcagcgaggagaagctggccctgctgaagcagatccaggaggcctacggcaagtgcaaggagtttggagatgacaaggtgcagctggccatgcagacctatgagatggtggacaagcacatccggcggctggacacagacctggccaggtttgaagctgacctgaaggagaagcagatcgagagcagtgactatgacagcagcagcagcaagggcaagaagaagggccgcacccagaaggagaagaaggccgcccgggcccggagcaagggcaagaacagtgatgaggaggcccccaagacagcccagaagaagctgaagctggtgaggaccagcccagaatatggcatgcccagcgtgaccttcggctctgtgcaccccagtgatgtgctggacatgcctgtggaccccaatgagcccacctactgcctgtgccaccaggtgtcctatggagagatgattggctgtgacaacccagactgcagcattgagtggttccactttgcctgtgtgggcctgaccaccaagccccggggcaagtggttctgcccccgctgcagccaggagaggaagaagaagtag

SEQ ID NO: 20030 - DNA, 741 bp, Artificial Sequence
  Description of Artificial Sequence: Synthetic coding sequence
atggctgctggcatgtacctggagcactacctggacagcattgagaacctgccctttgagctgcagaggaacttccagctgatgagggacctggaccagaggacagaggacctgaaggccgagattgacaagctggccacagagtacatgagcagcgcccggagcctgagcagcgaggagaagctggccctgctgaagcagatccaggaggcctacggcaagtgcaaggagtttggagatgacaaggtgcagctggccatgcagacctatgagatggtggacaagcacatccggcggctggacacagacctggccaggtttgaagctgacctgaaggagaagcagatcgagagcagtgactatgacagcagcagcagcaaggagggccgcacccagaaggagaagaaggccgcccgggcccggagcaagggcaagaacagtgatgaggaggcccccaagacagcccagaagaagctgaagctggtgaggaccagcccagaatatggcatgcccagcgtgacctttggatctgtgcaccccagtgatgtgctggacatgcctgtggaccccaatgagcccacctactgcctgtgccaccaggtgtcctatggagagatgattggctgtgacaacccagactgcagcattgagtggttccactttgcctgtgtgggcctgaccaccaagccccggggcaagtggttctgcccccgctgcagccaggagaggaagaagaagtag

SEQ ID NO: 20031 - DNA, 540 bp, Artificial Sequence
  Description of Artificial Sequence: Synthetic coding sequence
atggctgctggcatgtacctggagcactacctggacagcattgagaacctgccctttgagctgcagaggaacttccagctgatgagggacctggaccagaggacagaggacctgaaggccgagattgacaagctggccacagagtacatgagcagcgcccggagcctgagcagcgaggagaagctggccctgctgaagcagatccaggaggcctacggcaagtgcaaggagtttggagatgacaaggtgcagctggccatgcagacctatgagatggtggacaagcacatccggcggctggacacagacctggccaggtttgaagctgacctgaaggagaagcagatcgagagcagtgactatgacagcagcagcagcaagggcaagaagaagggccgcacccagaaggagaagaaggccgcccgggcccggagcaagggcaagaacagtgatgaggaggcccccaagacagcccagaagaagctgaagctggtgaggacagtgcccctgagcggcagcatcctgcctgtgtggggctag

SEQ ID NO: 20032 - DNA, 678 bp, Artificial Sequence
  Description of Artificial Sequence: Synthetic coding sequence
atggctgctggcatgtacctggagcactacctggacaacctgaaggccgagattgacaagctggccacagagtacatgagcagcgcccggagcctgagcagcgaggagaagctggccctgctgaagcagatccaggaggcctacggcaagtgcaaggagtttggagatgacaaggtgcagctggccatgcagacctatgagatggtggacaagcacatccggcggctggacacagacctggccaggtttgaagctgacctgaaggagaagcagatcgagagcagtgactatgacagcagcagcagcaagggcaagaagaagggccgcacccagaaggagaagaaggccgcccgggcccggagcaagggcaagaacagtgatgaggaggcccccaagacagcccagaagaagctgaagctggtgaggaccagcccagaatatggcatgcccagcgtgaccttcggctctgtgcaccccagtgatgtgctggacatgcctgtggaccccaatgagcccacctactgcctgtgccaccaggtgtcctatggagagatgattggctgtgacaacccagactgcagcattgagtggttccactttgcctgtgtgggcctgaccaccaagccccggggcaagtggttctgcccccgctgcagccaggagaggaagaagaagtag

SEQ ID NO: 20033 - DNA, 3729 bp, Artificial Sequence
  Description of Artificial Sequence: Synthetic coding sequence
atggccagccccccagagagtgatggcttcagtgatgtgaggaaggtgggctacctgaggaagcccaagtccatgcacaagcgcttctttgtgctgcgggccgccagcgaggccggcggccctgcccggctggagtactatgaaaatgagaagaagtggaggcacaagagcagcgcccccaagaggagcatccccctggagagctgcttcaacatcaacaagagagctgacagcaagaacaagcacctggtggccctgtacaccagagatgagcactttgccatcgctgctgacagcgaggccgagcaggacagctggtaccaggccctgctgcagctgcacaacagagccaagggccaccatgatggagctgctgccctgggcgccggcggcggcggcggcagctgcagcggcagcagcggcctgggggaggccggggaggacctgtcctatggagatgtgcccccaggccctgccttcaaggaggtgtggcaggtgatcctgaagcccaagggcctgggccagaccaagaacctgattggcatctaccgcctgtgcctgaccagcaagaccatcagctttgtgaagctgaacagcgaggccgctgctgtggtgctgcagctgatgaacatccgccgctgtggccacagcgagaacttcttcttcatcgaggtgggccgctctgctgtgactggacctggagagttctggatgcaggtggatgattctgtggtggcccagaacatgcatgagaccatcctggaggccatgagggccatgtctgatgagttccggcccaggagcaagagccagagcagcagcaactgcagcaaccccatctctgtgcccctgcggcggcaccacctgaacaaccccccacccagccaggtgggcctgaccaggaggagcaggacagagagcatcacagccaccagccctgcctccatggtgggcggcaagccaggcagcttccgggtgcgggccagcagtgatggagagggcaccatgagcaggcctgcctctgtggatggcagccctgtgagccccagcaccaacagaactcatgcccaccgccaccggggcagcgcccggctgcacccccccctgaaccacagccgcagcatccccatgcctgccagccgctgcagccccagcgccaccagccctgtgtccctgagcagcagcagcaccagcggccacggcagcaccagtgactgcctcttcccccggcgcagcagcgcctctgtgtctggcagccccagtgatggcggcttcatcagcagtgatgaatatggcagcagcccctgtgacttccgcagcagcttccgctctgtgaccccagacagcctgggccacaccccaccagcccggggggaggaggagctgagcaactacatctgcatgggcggcaagggccccagcaccctgacagcccccaacggccactacatcctgagccggggcggcaatggccaccgctgcaccccaggcaccggcctgggcaccagccctgccctggccggagatgaagctgccagcgctgctgacctggacaaccgcttcaggaagaggacccacagcgctggcaccagccccaccatcacccaccagaagacccccagccagagctctgtggccagcattgaggagtacacagagatgatgcctgcctacccacctgggggcggcagcggcggccgcctgcccggccaccgccacagcgcctttgtgcccaccaggagctacccagaggagggcctggagatgcaccccctggagcggcggggcggccaccacaggccagacagcagcaccctgcacacagatgatggctacatgcccatgagccctggggtggcccctgtgcccagcggcaggaaaggaagtggggactacatgcccatgagccccaagtctgtgtctgccccccagcagatcatcaaccccatcagaagacacccccagagggtggaccccaacggctacatgatgatgagccccagcggcggctgcagcccagacattggaggcggccccagcagcagcagcagcagcagcaatgctgtgcccagcggcaccagctatggcaagctgtggaccaatggagtgggcggccaccacagccacgtgctgccccaccccaagccccctgtggagagcagcggcggcaagctgctgccctgcacaggagactacatgaacatgagccctgtgggggacagcaacaccagcagccccagcgactgctactacggccctgaggacccccagcacaagcctgtgctgagctactacagcctgcccaggagcttcaagcacacccagaggcctggagagcctgaggagggcgcccggcaccagcacctgcggctgagcaccagcagcggccgcctgctgtatgctgccacagcagatgacagcagcagcagcaccagcagtgacagcctgggcggcggctactgtggggcccggctggagcccagcctgccccacccccaccaccaggtgctgcagccccacctgcccaggaaggtggacacagctgcccagaccaacagccggctggcccggcccacccggctgagcctgggggaccccaaggccagcaccctgccccgggcccgggagcagcagcagcagcagcagcccctgctgcaccccccagagcccaagagccctggagaatatgtgaacattgaatttggaagtgaccagagcggctacctgagcggccctgtggccttccacagcagccccagcgtgcgctgccccagccagctgcagcctgccccccgggaggaggagaccggcacagaggagtacatgaagatggacctgggccctggccggcgggccgcctggcaggagagcactggagtggagatgggccgcctgggccctgcccctcctggggccgccagcatctgccggcccaccagggctgtgcccagcagcagaggagactacatgaccatgcagatgagctgcccccggcagagctatgtggacaccagccctgctgcccctgtgtcctatgctgacatgaggactggaattgctgctgaggaggtgtccctgccccgggccaccatggctgctgccagcagcagcagcgctgccagcgccagccccaccggcccccagggcgctgctgagctggccgcccacagcagcctgctgggcggcccccagggccctgggggcatgtctgccttcaccagggtgaacctgagccccaacagaaaccagagcgccaaggtgatccgggctgacccccagggctgcagaagaagacacagcagcgagaccttcagcagcaccccatctgccaccagggtgggcaacacagtgccctttggagctggagctgctgtgggcggcggcggcggcagcagcagcagcagtgaagatgtgaagaggcacagcagcgccagctttgaaaatgtgtggctgcggcctggagagctgggcggggcccccaaggagcccgccaagctgtgtggggccgccggcggcctggagaatggcctgaactacatcgacctggacctggtgaaggacttcaagcagtgcccccaggagtgcaccccagagccccagcccccacctcctcctccaccccaccagcccctgggcagcggggagagcagcagcacccggcgcagcagcgaggacctgagcgcctatgccagcatctccttccagaagcagccagaagatcggcagtag

SEQ ID NO: 20034 - DNA, 588 bp, Artificial Sequence
  Description of Artificial Sequence: Synthetic coding sequence
atgggcaagatcagcagcctgcccacccagctgttcaagtgctgcttctgtgacttcctgaaggtgaagatgcacaccatgagcagcagccacctgttctacctggccctgtgcctgctgaccttcaccagcagcgccacagctggccctgagaccctgtgtggggctgagctggtggatgccctgcagtttgtgtgtggggaccggggcttctacttcaacaagcccaccggctacggcagcagcagccggcgggccccccagacaggaattgtggatgagtgctgcttccgcagctgtgacctgcggcggctggagatgtactgtgcccccctgaagccagccaagagcgcccggtctgtgcgggcccagaggcacacagacatgcccaagacccagaagtaccagccccccagcaccaacaagaacaccaagagccagaggaggaagggctggcccaagacccaccctggaggagagcagaaggagggcacagaggccagcctgcagatccggggcaagaagaaggagcagaggcgggagatcggcagcagaaatgctgagtgccggggcaagaagggcaagtag

SEQ ID NO: 20035 - DNA, 462 bp, Artificial Sequence
  Description of Artificial Sequence: Synthetic coding sequence
atgggcaagatcagcagcctgcccacccagctgttcaagtgctgcttctgtgacttcctgaaggtgaagatgcacaccatgagcagcagccacctgttctacctggccctgtgcctgctgaccttcaccagcagcgccacagctggccctgagaccctgtgtggggctgagctggtggatgccctgcagtttgtgtgtggggaccggggcttctacttcaacaagcccaccggctacggcagcagcagccggcgggccccccagacaggaattgtggatgagtgctgcttccgcagctgtgacctgcggcggctggagatgtactgtgcccccctgaagccagccaagagcgcccggtctgtgcgggcccagaggcacacagacatgcccaagacccagaaggaggtgcacctgaagaatgccagccggggcagcgctggcaacaagaactacaggatgtag

SEQ ID NO: 20036 - DNA, 477 bp, Artificial Sequence
  Description of Artificial Sequence: Synthetic coding sequence
atgggcaagatcagcagcctgcccacccagctgttcaagtgctgcttctgtgacttcctgaaggtgaagatgcacaccatgagcagcagccacctgttctacctggccctgtgcctgctgaccttcaccagcagcgccacagctggccctgagaccctgtgtggggctgagctggtggatgccctgcagtttgtgtgtggggaccggggcttctacttcaacaagcccaccggctacggcagcagcagccggcgggccccccagacaggaattgtggatgagtgctgcttccgcagctgtgacctgcggcggctggagatgtactgtgcccccctgaagccagccaagagcgcccggtctgtgcgggcccagaggcacacagacatgcccaagacccagaagtaccagccccccagcaccaacaagaacaccaagagccagaggaggaagggcagcacctttgaggagaggaagtag

SEQ ID NO: 20037 - DNA, 420 bp, Artificial Sequence
  Description of Artificial Sequence: Synthetic coding sequence
ctgaaggtgaagatgcacaccatgagcagcagccacctgttctacctggccctgtgcctgctgaccttcaccagcagcgccacagctggccctgagaccctgtgtggggctgagctggtggatgccctgcagtttgtgtgtggggaccggggcttctacttcaacaagcccaccggctacggcagcagcagcagaagagccccccagacaggcatcgtggatgagtgctgcttccgcagctgtgacctgcggcggctggagatgtactgtgcccccctgaagccagccaagagcgcccggtctgtgcgggcccagaggcacacagacatgcccaagacccagaagtaccagccccccagcaccaacaagaacaccaagagccagaggaggaagggcagcacctttgaggagaggaagtag

SEQ ID NO: 20038 - DNA, 414 bp, Artificial Sequence
  Description of Artificial Sequence: Synthetic coding sequence
atgatcacccccaccgtgaagatgcacaccatgagcagcagccacctgttctacctggccctgtgcctgctgaccttcaccagcagcgccacagctggccctgagaccctgtgtggggctgagctggtggatgccctgcagtttgtgtgtggggaccggggcttctacttcaacaagcccaccggctacggcagcagcagccggcgggccccccagacaggaattgtggatgagtgctgcttccgcagctgtgacctgcggcggctggagatgtactgtgcccccctgaagccagccaagagcgcccggtctgtgcgggcccagaggcacacagacatgcccaagacccagaaggaggtgcacctgaagaatgccagccggggcagcgctggcaacaagaactacaggatgtag

SEQ ID NO: 20039 - DNA, 477 bp, Artificial Sequence; identical to SEQ ID NO: 20036
  Description of Artificial Sequence: Synthetic coding sequence

SEQ ID NO: 20040 - DNA, 4104 bp, Artificial Sequence
  Description of Artificial Sequence: Synthetic coding sequence
atgaagagcggcagcggcggcggcagccccaccagcctgtggggcctgctcttcctgtctgctgccctgagcctgtggcccaccagcggggagatctgtggccctggcatcgacatcagaaatgactaccagcagctgaagaggctggagaactgcaccgtgattgagggctacctgcacatcctgctgatcagcaaggccgaggactaccgcagctaccgcttccccaagctgaccgtcatcacagagtacctgctgctcttccgggtggccggcctggagagcctgggggacctcttccccaacctgaccgtcatccggggctggaagctgttctacaactatgccctggtgatctttgagatgaccaacctgaaggacatcggcctgtacaacctgaggaacatcaccaggggggccatcagaattgagaagaatgctgacctgtgctacctgagcacagtggactggagcctcatcctggatgctgtgagcaacaactacatcgtgggcaacaagccacccaaggaatgtggggacctgtgccccggcaccatggaggagaagcccatgtgtgagaagaccaccatcaacaatgagtacaactaccgctgctggaccaccaaccgctgccagaagatgtgccccagcacctgtgggaagagggcctgcacagagaacaatgaatgctgccaccctgagtgcctgggcagctgcagcgccccagacaatgacacagcctgtgtggcctgccgccactactactatgccggcgtgtgtgtgcctgcctgcccccccaacacctacagatttgagggctggaggtgtgtggaccgggacttctgtgccaacatcctgtctgctgagagcagtgacagcgagggcttcgtcatccatgatggagagtgcatgcaggagtgccccagcggcttcatcagaaatggcagccagagcatgtactgcatcccctgtgagggcccctgccccaaggtgtgtgaggaggagaagaagaccaagaccattgattctgtgaccagcgcccagatgctgcagggctgcaccatcttcaagggcaacctgctgatcaacatcagaagaggcaacaacatcgccagcgagctggagaacttcatgggcctgattgaggtggtgacaggctacgtgaagatccgccacagccacgccctggtgtccctgtccttcctgaagaacctgcggctcatcctgggggaggagcagctggagggcaactacagcttctacgtgctggacaaccagaacctgcagcagctgtgggactgggaccacaggaacctgaccatcaaggccggcaagatgtactttgccttcaaccccaagctgtgtgtgtctgagatctacaggatggaggaggtgacaggcaccaagggccggcagagcaagggggacatcaacaccaggaacaacggggagcgggccagctgtgagagtgatgtgctgcacttcaccagcaccaccaccagcaagaaccgcatcatcatcacctggcaccgctaccggcccccagactacagagacctgatctccttcaccgtgtactacaaggaggcccccttcaagaatgtgacagaatatgatggccaggatgcctgtggcagcaacagctggaacatggtggatgtggacctgccccccaacaaggatgtggagcccggcatcctgctgcacggcctgaagccctggacccagtatgctgtgtatgtgaaggctgtgaccctgaccatggtggagaatgaccacatccggggggccaagtctgagatcctgtacatccgcaccaatgcctctgtgcccagcatccccctggatgtgctgagcgccagcaacagcagcagccagctgattgtgaagtggaacccccccagcctgcccaacggcaacctgagctactacatcgtgcgctggcagaggcagccccaggacggctacctgtaccgccacaactactgcagcaaggacaagatccccatcagaaaatatgcagatggcaccatcgacatcgaggaggtgacagagaaccccaagacagaggtgtgtggcggggagaagggcccctgctgtgcctgccccaagacagaagctgagaagcaggccgagaaggaggaggccgagtacaggaaggtgtttgagaacttcctgcacaacagcatctttgtgcccaggcctgagaggaagagaagagatgtgatgcaggtggccaacaccaccatgagcagccgcagcaggaacaccacagctgctgacacctacaacatcacagatcctgaggagctggagacagagtaccccttctttgagagccgggtggacaacaaggagaggacagtcatcagcaacctgcggcccttcaccctgtacagaattgacatccacagctgcaaccacgaggccgagaagctgggctgcagcgccagcaactttgtgtttgcccggaccatgcctgctgagggcgcagatgacatccctggccctgtgacctgggagcccaggccagaaaattccatcttcctgaagtggccagagcctgagaaccccaacggcctcatcctgatgtatgagatcaagtatggcagccaggtggaggaccagcgggagtgtgtgtcccggcaggagtacagaaaatatggaggagccaagctgaaccggctgaaccctggcaactacacagcccgcatccaggccaccagcctgtctggaaatggctcctggacagatcctgtgttcttctacgtgcaggccaagacaggctatgagaacttcatccacctgatcatcgccctgcctgtggccgtgctgctgattgtgggcggcctggtgatcatgctgtatgtgttccacaggaagaggaacaacagccggctgggcaatggagtgctgtatgcctctgtgaaccctgagtacttctctgctgctgatgtgtatgtgcctgatgagtgggaggtggcccgggagaagatcaccatgagccgggagctgggccagggcagctttggcatggtgtatgagggcgtggccaagggcgtggtgaaggatgagcctgagaccagggtggccatcaagacagtgaatgaggccgcctccatgagggagagaattgagttcctgaatgaggcctctgtgatgaaggagttcaactgccaccacgtggtgcggctgctgggcgtggtgtcccagggccagcccaccctggtgatcatggagctgatgaccaggggggacctgaagagctacctgcggagcctgcggcctgagatggagaacaaccctgtgctggccccacccagcctgagcaagatgatccagatggccggggagattgctgatggcatggcctacctgaatgccaacaagtttgtgcaccgggacctggccgccaggaactgcatggtggccgaggacttcaccgtgaagattggagactttggcatgacccgggacatctatgaaacagactactacaggaagggcggcaagggcctgctgcctgtgcgctggatgagccctgagagcctgaaggatggagtcttcaccacctacagtgatgtgtggagctttggagtggtgctgtgggagatcgccaccctggccgagcagccctaccagggcctgagcaatgagcaggtgctgcgctttgtgatggagggcggcctgctggacaagccagacaactgcccagacatgctgtttgagctgatgaggatgtgctggcagtacaaccccaagatgaggcccagcttcctggagatcatcagcagcatcaaggaggagatggagcccggcttccgggaggtgtccttctactacagcgaggagaacaagctgcctgagcctgaggagctggacctggagcctgagaacatggagagcgtgcccctggaccccagcgccagcagcagcagcctgcccctgcctgacagacattctggccacaaggccgagaatggacctggccctggggtgctggtgctgcgggccagctttgatgagcggcagccctatgcccacatgaatggaggcaggaagaatgaaagagccctgcccctgccccagagcagcacctgctag

SEQ ID NO: 20041 - DNA, 543 bp, Artificial Sequence
  Description of Artificial Sequence: Synthetic coding sequence
atgggcatccccatgggcaagtccatgctggtgctgctgaccttcctggcctttgccagctgctgcatcgccgcctaccggcccagcgagaccctgtgtggcggggagctggtggacaccctgcagtttgtgtgtggggaccggggcttctacttcagcaggcctgccagccgggtgtccagaagaagccggggcatcgtggaggagtgctgcttccgcagctgtgacctggccctgctggagacctactgtgccaccccagccaagtcagaaagagatgtgtccaccccacccaccgtgctgcctgacaacttcccccgctaccctgtgggcaagttcttccagtatgacacctggaagcagagcacccagaggctgcggcggggcctgcctgccctgctgcgggcccggcggggccacgtgctggccaaggagctggaggccttccgggaggccaagaggcaccggcccctgattgccctgcccacccaggaccctgcccacggcggggcccctcctgagatggccagcaacaggaagtag

SEQ ID NO: 20042 - DNA, 543 bp, Artificial Sequence; identical to SEQ ID NO: 20041
  Description of Artificial Sequence: Synthetic coding sequence

SEQ ID NO: 20043 - DNA, 552 bp, Artificial Sequence
  Description of Artificial Sequence: Synthetic coding sequence
atgggcatccccatgggcaagtccatgctggtgctgctgaccttcctggcctttgccagctgctgcatcgccgcctaccggcccagcgagaccctgtgtggcggggagctggtggacaccctgcagtttgtgtgtggggaccggggcttctacttccggctgcccggccggcctgccagccgggtgagccgccgcagccggggcatcgtggaggagtgctgcttccgcagctgtgacctggccctgctggagacctactgtgccaccccagccaagtcagaaagagatgtgtccaccccacccaccgtgctgcctgacaacttcccccgctaccctgtgggcaagttcttccagtatgacacctggaagcagagcacccagaggctgcggcggggcctgcctgccctgctgcgggcccggcggggccacgtgctggccaaggagctggaggccttccgggaggccaagaggcaccggcccctcatcgccctgcccacccaggaccctgcccatggaggagcccctcctgagatggccagcaacaggaagtag

SEQ ID NO: 20044 - DNA, 552 bp, Artificial Sequence; identical to SEQ ID NO: 20043
  Description of Artificial Sequence: Synthetic coding sequence

SEQ ID NO: 20045 - DNA, 543 bp, Artificial Sequence; identical to SEQ ID NO: 20041
  Description of Artificial Sequence: Synthetic coding sequence

SEQ ID NO: 20046 - DNA, 552 bp, Artificial Sequence; identical to SEQ ID NO: 20043
  Description of Artificial Sequence: Synthetic coding sequence

SEQ ID NO: 20047 - DNA, 543 bp, Artificial Sequence; identical to SEQ ID NO: 20041
  Description of Artificial Sequence: Synthetic coding sequence

SEQ ID NO: 20048 - DNA, 552 bp, Artificial Sequence; identical to SEQ ID NO: 20043
  Description of Artificial Sequence: Synthetic coding sequence

SEQ ID NO: 20049 - DNA, 543 bp, Artificial Sequence; identical to SEQ ID NO: 20041
  Description of Artificial Sequence: Synthetic coding sequence

SEQ ID NO: 20050 - DNA, 543 bp, Artificial Sequence; identical to SEQ ID NO: 20041
  Description of Artificial Sequence: Synthetic coding sequence

SEQ ID NO: 20051 - DNA, 711 bp, Artificial Sequence
  Description of Artificial Sequence: Synthetic coding sequence
atggtgtccccagacccccagatcatcgtggtggcccctgagacagagctggcctccatgcaggtgcagaggacagaagatggagtgaccatcatccagatcttctgggtgggcaggaagggggagctgctgcggaggacccctgtgtcctctgccatgcagacccccatgggcatccccatgggcaagtccatgctggtgctgctgaccttcctggcctttgccagctgctgcatcgccgcctaccggcccagcgagaccctgtgtggcggggagctggtggacaccctgcagtttgtgtgtggggaccggggcttctacttcagcaggcctgccagccgggtgtccagaagaagccggggcatcgtggaggagtgctgcttccgcagctgtgacctggccctgctggagacctactgtgccaccccagccaagtcagaaagagatgtgtccaccccacccaccgtgctgcctgacaacttcccccgctaccctgtgggcaagttcttccagtatgacacctggaagcagagcacccagaggctgcggcggggcctgcctgccctgctgcgggcccggcggggccacgtgctggccaaggagctggaggccttccgggaggccaagaggcaccggcccctgattgccctgcccacccaggaccctgcccacggcggggcccctcctgagatggccagcaacaggaagtag

SEQ ID NO: 20052 - DNA, 876 bp, Artificial Sequence
  Description of Artificial Sequence: Synthetic coding sequence
atgcagagggcccggcccaccctgtgggccgccgccctgaccctgctggtgctgctgcggggcccccctgtggcccgggccggggccagcagcgctggcctgggccctgtggtgcgctgtgagccctgtgatgcccgggccctggcccagtgtgcccctcctcctgctgtgtgtgccgagctggtgcgggagcccggctgcggctgctgcctgacctgtgccctgtctgagggccagccctgtggcatctacacagagcgctgtggcagcggcctgcgctgccagcccagcccagatgaggcccggcccctgcaggccctgctggatggccggggcctgtgtgtgaatgccagcgctgtgtcccggctgcgggcctacctgctgcctgcccccccagcccctggaaatgccagcgagagcgaggaggacagatctgctggctctgtggagagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgccggcgggagatggaggacaccctgaaccacctgaagttcctgaatgtgctgagcccccggggcgtgcacatccccaactgtgacaagaagggcttctacaagaagaagcagtgccggcccagcaaaggaaggaagaggggcttctgctggtgtgtggacaagtatggccagcccctgcccggctacaccaccaagggcaaggaggatgtgcactgctacagcatgcagagcaagtag

SEQ ID NO: 20053 - DNA, 894 bp, Artificial Sequence
  Description of Artificial Sequence: Synthetic coding sequence
atgcagagggcccggcccaccctgtgggccgccgccctgaccctgctggtgctgctgcggggcccccctgtggcccgggccggggccagcagcgctggcctgggccctgtggtgcgctgtgagccctgtgatgcccgggccctggcccagtgtgcccctcctcctgctgtgtgtgccgagctggtgcgggagcccggctgcggctgctgcctgacctgtgccctgtctgagggccagccctgtggcatctacacagagcgctgtggcagcggcctgcgctgccagcccagcccagatgaggcccggcccctgcaggccctgctggatggccggggcctgtgtgtgaatgccagcgctgtgtcccggctgcgggcctacctgctgcctgcccccccagcccctggagagcccccagcccctggaaatgccagcgagagcgaggaggacagatctgctggctctgtggagagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgccggcgggagatggaggacaccctgaaccacctgaagttcctgaatgtgctgagcccccggggcgtgcacatccccaactgtgacaagaagggcttctacaagaagaagcagtgccggcccagcaaaggaaggaagaggggcttctgctggtgtgtggacaagtatggccagcccctgcccggctacaccaccaagggcaaggaggatgtgcactgctacagcatgcagagcaagtag

SEQ ID NO: 20054 - DNA, 585 bp, Artificial Sequence
  Description of Artificial Sequence: Synthetic coding sequence
atgcagagggcccggcccctgcaggccctgctggatggccggggcctgtgtgtgaatgccagcgctgtgtcccggctgcgggcctacctgctgcctgcccccccagcccctggaaatgccagcgagagtgaagaagatagatctgctggctctgtggagagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgcagaagagagatggaggacaccctgaaccacctgaagttcctgaatgtgctgagcccccggggcgtgcacatccccaactgtgacaagaagggcttctacaagaagaagcagtgccggcccagcaagggcaggaagaggggcttctgctggtgtgtggacaagtatggccagcccctgcccggctacaccaccaagggcaaggaggatgtgcactgctacagcatgcagagcaagtag

SEQ ID NO: 20055 - DNA, 462 bp, Artificial Sequence
  Description of Artificial Sequence: Synthetic coding sequence
tgaagtgaggaggacagatctgctggctctgtggagagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgccggcgggagatggaggacaccctgaaccacctgaagttcctgaatgtgctgagcccccggggcgtgcacatccccaactgtgacaagaagggcttctacaagaagaagcagtgccggcccagcaaaggaaggaagaggggcttctgctggtgtgtggacaagtatggccagcccctgcccggctacaccaccaagggcaaggaggatgtgcactgctacagcatgcagagcaagtag

SEQ ID NO: 20056 - DNA, 432 bp, Artificial Sequence
  Description of Artificial Sequence: Synthetic coding sequence
tgagaaagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgccggcgggagatggaggacaccctgaaccacctgaagttcctgaatgtgctgagcccccggggcgtgcacatccccaactgtgacaagaagggcttctacaagaagaagcagtgccggcccagcaaaggaaggaagaggggcttctgctggtgtgtggacaagtatggccagcccctgcccggctacaccaccaagggcaaggaggatgtgcactgctacagcatgcagagcaagtag

SEQ ID NO: 20057 - DNA, 792 bp, Artificial Sequence
  Description of Artificial Sequence: Synthetic coding sequence
atgcagagggcccggcccaccctgtgggccgcctgtgagccctgtgatgcccgggccctggcccagtgtgcccctcctcctgctgtgtgtgccgagctggtgcgggagcccggctgcggctgctgcctgacctgtgccctgtctgagggccagccctgtggcatctacacagagcgctgtggcagcggcctgcgctgccagcccagcccagatgaggcccggcccctgcaggccctgctggatggccggggcctgtgtgtgaatgccagcgctgtgtcccggctgcgggcctacctgctgcctgcccccccagcccctggaaatgccagcgagagcgaggaggacagatctgctggctctgtggagagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgccggcgggagatggaggacaccctgaaccacctgaagttcctgaatgtgctgagcccccggggcgtgcacatccccaactgtgacaagaagggcttctacaagaagaagcagtgccggcccagcaaaggaaggaagaggggcttctgctggtgtgtggacaagtatggccagcccctgcccggctacaccaccaagggcaaggaggatgtgcactgctacagcatgcagagcaagtag

SEQ ID NO: 20058 - DNA, 834 bp, Artificial Sequence
  Description of Artificial Sequence: Synthetic coding sequence
atgagggccctgcggctgggcgctgaggaccagcccctgcctgcctggatcccccagctgcgggctgtgtactgccggcccatcccagcccggcctgcctgccaggccgcctgccccggctgcagaagacatgctgctggggccacccacgccctgggccgctgtgccgacagcgctggagctgcccccagggctgctgggggcgccggctggagggagctgggcggcctgggcagcagaggagccctgcgggctgtgcgccacctgcaccgggccctgctggatggccggggcctgtgtgtgaatgccagcgctgtgtcccggctgcgggcctacctgctgcctgcccccccagcccctggaaatgccagcgagagcgaggaggacagatctgctggctctgtggagagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgccggcgggagatggaggacaccctgaaccacctgaagttcctgaatgtgctgagcccccggggcgtgcacatccccaactgtgacaagaagggcttctacaagaagaagcagtgccggcccagcaaaggaaggaagaggggcttctgctggtgtgtggacaagtatggccagcccctgcccggctacaccaccaagggcaaggaggatgtgcactgctacagcatgcagagcaagtag

SEQ ID NO: 20059 - DNA, 570 bp, Artificial Sequence
  Description of Artificial Sequence: Synthetic coding sequence
atgcagagggcccggcccaccctgtgggccgccgccctgaccctgctggatggccggggcctgtgtgcctacctgctgcctgcccccccagcccctggaaatgccagcgagagcgaggaggacagatctgctggctctgtggagagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgccggcgggagatggaggacaccctgaaccacctgaagttcctgaatgtgctgagcccccggggcgtgcacatccccaactgtgacaagaagggcttctacaagaagaagcagtgccggcccagcaaaggaaggaagaggggcttctgctggtgtgtggacaagtatggccagcccctgcccggctacaccaccaagggcaaggaggatgtgcactgctacagcatgcagagcaagtag

SEQ ID NO: 20060 - DNA, 807 bp, Artificial Sequence
  Description of Artificial Sequence: Synthetic coding sequence
atgcagagggcccggcccaccctgtgggccgccgccctgaccctgctggtgctgctgcggggcccccctgtggcccgggccggggccagcagcgctggcctgggccctgtggtgagaagagagcccggctgcggctgctgcctgacctgtgccctgtctgagggccagccctgtggcatctacacagagcgctgtggcagcggcctgcgctgccagcccagcccagatgaggcccggcccctgcaggccctgctggatggccggggcctgtgtgtgaatgccagcgctgtgtcccggctgcgggcctacctgctgcctgcccccccagcccctggaaatgccagcgagagtgaagaagatagatctgctggctctgtggagagccccagcgtgagcagcacccaccgggtgtctgaccccaagttccaccccctgcacagcaagatcatcatcatcaagaagggccacgccaaggacagccagcgctacaaggtggactatgagagccagagcacagacacccagaacttcagcagcgagagcaagcgggagacagaatatggcccctgcagaagagagatggaggacaccctgaaccacctgaagttcctgaatgtgctgagcccccggggcgtgcacatccccaactgtgacaagaagggcttctacaagaagaagcagtgccggcccagcaagggcaggaagaggggcttctgctggtgtgtggacaagtatggccagcccctgcccggctacaccaccaagggcaaggaggatgtgcactgctacagcatgcagagcaagtag

SEQ ID NO: 20061 - DNA, 978 bp, Artificial Sequence
  Description of Artificial Sequence: Synthetic coding sequence
atgctgccccgggtgggctgcccagccctgcccctgcccccaccacccctgctgcccctgctgctgctgctgctgggcgccagcggcggcggcggcggggcccgggcagaggtgctcttccgctgccccccctgcaccccagagcggctggccgcctgtggccccccacctgtggcccccccagctgctgtggccgctgtggccggcggggccaggatgccctgtgccgagctggtgcgggagcccggctgcggctgctgcagcgtgtgtgcccggctggagggggaggcctgtggggtgtacaccccccgctgtggccagggcctgcgctgctacccccaccctggcagcgagctgcccctgcaggccctggtgatgggagagggcacctgtgagaagagaagagatgctgaatatggagccagccctgagcaggtggccgacaatggagatgaccacagcgagggcggcctggtggagaaccacgtggacagcaccatgaacatgctgggcggcggcggcagcgctggcaggaagcccctgaagagcggcatgaaggagctggccgtgttccgggagaaggtgacagagcagcaccggcagatgggcaagggcggcaagcaccacctgggcctggaggagcccaagaagctgcggcccccaccagcccggaccccctgccagcaggagctggaccaggtgctggagcgcatcagcaccatgaggctgcctgatgagcggggccccctggagcacctgtacagcctgcacatccccaactgtgacaagcacggcctgtacaacctgaagcagtgcaagatgagcctgaatggccagagaggagagtgctggtgtgtgaaccccaacacaggcaagctgatccagggcgcccccaccatccggggggaccctgagtgccacctgttctacaatgagcagcaggaggcccggggcgtgcacacccagaggatgcagtag

SEQ ID NO: 20062 - DNA, 3099 bp, Artificial Sequence
  Description of Artificial Sequence: Synthetic coding sequence
atggcctgggaggcccggcgggagcccggcccccggcgggctgctgtgcgggagaccgtgatgctgctgctgtgcctgggcgtgcccaccggccggccctacaacgtggacacagagagcgccctgctgtaccagggcccccacaacaccctgtttggctacagcgtggtgctgcacagccatggagccaaccgctggctgctggtgggcgcccccacagccaactggctggccaatgccagcgtcatcaaccctggggccatctaccgctgcagaattggcaagaaccctggccagacctgtgagcagctgcagctgggcagccccaacggggagccctgtgggaagacctgcctggaggagcgggacaaccagtggctgggcgtgaccctgagccggcagcctggagaaaatggcagcatcgtgacctgtggccaccgctggaagaacatcttctacatcaagaatgaaaacaagctgcccaccggcggctgctacggcgtgcccccagacctgaggacagagctgagcaagagaattgccccctgctaccaggactatgtgaagaagtttggagaaaattttgccagctgccaggccggcatcagcagcttctacaccaaggacctgattgtgatgggcgcccctggcagcagctactggacaggcagcctgtttgtgtacaacatcaccaccaacaagtacaaggccttcctggacaagcagaaccaggtgaagtttggcagctacctgggctacagcgtgggcgccggccacttccgcagccagcacaccacagaggtggtgggcggggccccccagcacgagcagatcggcaaggcctacatcttcagcattgatgagaaggagctgaacatcctgcacgagatgaagggcaagaagctgggcagctactttggagcctctgtgtgtgctgtggacctgaatgctgatggcttcagtgacctgctggtgggcgcccccatgcagagcaccatccgggaggagggccgggtgtttgtgtacatcaacagcggcagcggggctgtgatgaatgccatggagaccaacctggtgggcagtgacaagtatgctgccaggtttggagagagcatcgtgaacctgggggacatcgacaatgatggctttgaagatgtggccatcggggccccccaggaggatgacctgcagggcgccatctacatctacaacggccgggcagatggcatcagcagcaccttcagccagagaattgagggcctgcagatcagcaagagcctgtccatgtttggccagagcatcagcggccagattgatgctgacaacaacggctacgtggatgtggccgtgggcgccttcagaagtgacagcgctgtgctgctgcggaccaggcctgtggtgattgtggatgccagcctgagccaccctgagagcgtgaacagaaccaagtttgactgtgtggagaatggctggcccagcgtgtgcatcgacctgaccctgtgcttctcctacaagggcaaggaggtgcccggctacatcgtgctcttctacaacatgagcctggatgtgaacaggaaggccgagagccccccacgcttctacttcagcagcaatggcaccagtgatgtgatcaccggcagcatccaggtgagcagccgggaggccaactgcaggacccaccaggccttcatgaggaaggatgtgcgggacatcctgacccccatccagattgaagctgcctaccacctgggcccccacgtgatcagcaagaggagcacagaggagttcccccccctgcagcccatcctgcagcagaagaaggagaaggacatcatgaagaagaccatcaactttgcccgcttctgtgcccacgagaactgcagcgctgacctgcaggtgtctgccaagattggcttcctgaagccccatgagaacaagacctacctggccgtgggctccatgaagaccctgatgctgaatgtgtccctcttcaatgctggagatgatgcctatgagaccaccctgcacgtgaagctgcctgtgggcctgtacttcatcaagatcctggagctggaggagaagcagatcaactgtgaggtgacagacaacagcggcgtggtgcagctggactgcagcatcggctacatctacgtggaccacctgagcagaattgacatctccttcctgctggatgtgagcagcctgagcagagctgaggaggacctgagcatcaccgtgcacgccacctgtgaaaatgaggaggagatggacaacctgaagcacagccgggtgacagtggccatccccctgaagtatgaggtgaagctgactgtgcacggctttgtgaaccccaccagctttgtgtatggcagcaatgatgaaaatgaacctgagacctgcatggtggagaagatgaacctgaccttccacgtgatcaacacaggcaacagcatggccccaaatgtgtctgtggagatcatggtgcccaacagcttcagcccccagacagacaagctgttcaacatcctggatgtgcagaccaccactggagagtgccactttgagaactaccagagggtgtgtgccctggagcagcagaagagcgccatgcagaccctgaagggcatcgtgcgcttcctgagcaagacagacaagaggctgctgtactgcatcaaggctgacccccactgcctgaacttcctgtgcaactttgggaagatggagagcggcaaggaggcctctgtgcacatccagctggagggccggcccagcatcctggagatggatgagaccagcgccctgaagtttgagatccgggccaccggcttccctgagcccaacccccgggtgattgagctgaacaaggatgaaaatgtggcccacgtgctgctggagggcctgcaccaccagaggcccaagcgctacttcaccatcgtcatcatcagcagcagcctgctgctgggcctcatcgtgctgctgctgatctcctatgtgatgtggaaggccggcttcttcaagaggcagtacaagagcatcctgcaggaggagaacagaagagacagctggagctacatcaacagcaagagcaatgatgactag

SEQ ID NO: 20063 - DNA, 1854 bp, Artificial Sequence
  Description of Artificial Sequence: Synthetic coding sequence
atggcctgggaggcccggcgggagcccggcccccggcgggctgctgtgcgggagaccgtgatgctgctgctgtgcctgggcgtgcccaccggccggccctacaacgtggacacagagagcgccctgctgtaccagggcccccacaacaccctgtttggctacagcgtggtgctgcacagccatggagccaaccgctggctgctggtgggcgcccccacagccaactggctggccaatgccagcgtcatcaaccctggggccatctaccgctgcagaattggcaagaaccctggccagacctgtgagcagctgcagctgggcagccccaacggggagccctgtgggaagacctgcctggaggagcgggacaaccagtggctgggcgtgaccctgagccggcagcctggagaaaatggcagcatcgtgacctgtggccaccgctggaagaacatcttctacatcaagaatgaaaacaagctgcccaccggcggctgctacggcgtgcccccagacctgaggacagagctgagcaagagaattgccccctgctaccaggactatgtgaagaagtttggagaaaattttgccagctgccaggccggcatcagcagcttctacaccaaggacctgattgtgatgggcgcccctggcagcagctactggacaggcagcctgtttgtgtacaacatcaccaccaacaagtacaaggccttcctggacaagcagaaccaggtgaagtttggcagctacctgggctacagcgtgggcgccggccacttccgcagccagcacaccacagaggtggtgggcggggccccccagcacgagcagatcggcaaggcctacatcttcagcattgatgagaaggagctgaacatcctgcacgagatgaagggcaagaagctgggcagctactttggagcctctgtgtgtgctgtggacctgaatgctgatggcttcagtgacctgctggtgggcgcccccatgcagagcaccatccgggaggagggccgggtgtttgtgtacatcaacagcggcagcggggctgtgatgaatgccatggagaccaacctggtgggcagtgacaagtatgctgccaggtttggagagagcatcgtgaacctgggggacatcgacaatgatggctttgaagatgtggccatcggggccccccaggaggatgacctgcagggcgccatctacatctacaacggccgggcagatggcatcagcagcaccttcagccagagaattgagggcctgcagatcagcaagagcctgtccatgtttggccagagcatcagcggccagattgatgctgacaacaacggctacgtggatgtggccgtgggcgccttcagaagtgacagcgctgtgctgctgcggaccaggcctgtggtgattgtggatgccagcctgagccaccctgagagcgtgaacagaaccaagtttgactgtgtggagaatggctggcccagcgtgtgcatcgacctgaccctgtgcttctcctacaagggcaaggaggtgcccggctacatcgtgctcttctacaacatgagcctggatgtgaacaggaaggccgagagccccccacgcttctacttcagcagcaatggcaccagtgatgtgatcaccggcagcatccaggtgagcagccgggaggccaactgcaggacccaccaggccttcatgaggaaggatgtgcgggacatcctgacccccatccagattgaagctgcctaccacctgggcccccacgtgatcagcaagaggagcacagaggagttcccccccctgcagcccatcctgcagcagaagaaggagaaggacatcatgaagaagaccaagaagtag

SEQ ID NO: 20064 - DNA, 3150 bp, Artificial Sequence
  Description of Artificial Sequence: Synthetic coding sequence
atgggcagcaggaccccagagagccccctgcatgctgtgcagctgcgctggggccccaggagaagaccacccctgctgcccctgctgctgctgctgctgcccccaccaccccgggtgggcggcttcaacctggatgctgaggccccagctgtgctgagcggccccccaggcagcttcttcggcttctctgtggagttctacagacctggaacagatggagtgtctgtgctggtgggcgcccccaaggccaacaccagccagcccggggtgctgcagggcggcgctgtgtacctgtgcccctggggcgccagccccacccagtgcacccccattgaatttgacagcaagggcagccggctgctggagagcagcctgagcagcagcgagggggaggagcctgtggagtacaagagcctgcagtggtttggagccaccgtgcgggcccacggcagcagcatcctggcctgtgcccccctgtacagctggaggacagagaaggagcccctgagtgaccctgtgggcacctgctacctgagcacagacaacttcacccgcatcctggagtatgccccctgccgcagtgacttctcctgggccgccggccagggctactgccagggcggcttctctgctgagttcaccaagacaggccgggtggtgctgggcggccctggcagctacttctggcagggccagatcctgagcgccacccaggagcagattgctgagagctactacccagagtacctgatcaacctggtgcagggccagctgcagacccggcaggccagcagcatctatgatgacagctacctgggctacagcgtggccgtgggggagttctctggagatgacacagaagattttgtggccggcgtgcccaagggcaacctgacctacggctacgtgaccatcctgaatggaagtgacatccgcagcctgtacaacttcagcggggagcagatggccagctacttcggctatgctgtggccgccacagatgtgaatggagatggcctggatgacctgctggtgggcgcccccctgctgatggacaggaccccagatggccggccccaggaggtgggccgggtgtatgtgtacctgcagcaccctgctggcatcgagcccacccccaccctgaccctgaccggccatgatgaatttggccgcttcggcagcagcctgacccccctgggggacctggaccaggacggctacaatgatgtggccatcggggccccctttggaggagagacccagcagggcgtggtgtttgtgtttcctgggggccctgggggcctgggcagcaagcccagccaggtgctgcagcccctgtgggccgccagccacaccccagacttcttcggcagcgccctgcggggcggccgggacctggatggaaatggctacccagacctgattgtgggcagctttggagtggacaaggctgtggtgtaccggggccggcccatcgtgtctgccagcgccagcctgaccatcttccctgccatgttcaaccctgaggagaggagctgcagcctggagggcaaccctgtggcctgcatcaacctgtccttctgcctgaatgccagcggcaagcacgtggccgacagcatcggcttcaccgtggagctgcagctggactggcagaagcagaagggcggcgtgcggcgggccctcttcctggccagccggcaggccaccctgacccagaccctgctgatccagaatggagcccgggaggactgccgggagatgaagatctacctgagaaatgaaagtgagttccgggacaagctgagccccatccacatcgccctgaacttcagcctggacccccaggcccctgtggacagccacggcctgcggcctgccctgcactaccagagcaagagcagaattgaggacaaggcccagatcctgctggactgtggggaggacaacatctgtgtgcctgacctgcagctggaggtgtttggagagcagaaccacgtgtacctgggggacaagaatgccctgaacctgaccttccacgcccagaatgtgggggagggcggggcctatgaagctgagctgcgggtgacagcccctcctgaggccgagtacagcggcctggtgcgccaccctggcaacttcagcagcctgagctgtgactactttgctgtgaaccagagccggctgctggtgtgtgacctgggcaaccccatgaaggccggggccagcctgtggggcggcctgcgcttcaccgtgccccacctgcgggacaccaagaagaccatccagtttgacttccagatcctgagcaagaacctgaacaacagccagagtgatgtggtgtccttccggctgtctgtggaggcccaggcccaggtgaccctgaatggagtgtccaagccagaggccgtgctcttccctgtgtctgactggcacccccgggaccagccccagaaggaggaggacctgggccctgctgtgcaccacgtgtatgagctgatcaaccagggccccagcagcatcagccagggcgtgctggagctgagctgcccccaggccctggagggccagcagctgctgtatgtgaccagggtgacaggcctgaactgcaccaccaaccaccccatcaaccccaagggcctggagctggaccctgagggcagcctgcaccaccagcagaagcgggaggcccccagccgcagcagcgccagcagcggcccccagatcctgaagtgcccagaggccgagtgcttccggctgcgctgtgagctgggccccctgcaccagcaggagagccagagcctgcagctgcacttccgggtgtgggccaagaccttcctgcagcgggagcaccagcccttcagcctgcagtgtgaggccgtgtacaaggccctgaagatgccctaccgcatcctgccccggcagctgccccagaaggagcggcaggtggccacagctgtgcagtggaccaaggccgagggcagctatggagtgcccctgtggatcatcatcctggccatcctgtttggcctgctgctgctgggcctgctgatctacatcctgtacaagctgggcttcttcaagaggagcctgccctacggcacagccatggagaaggcccagctgaagcccccagccaccagtgatgcctag

SEQ ID NO: 20065 - DNA, 3393 bp, Artificial Sequence
  Description of Artificial Sequence: Synthetic coding sequence
atggctgctgctggccagctgtgcctgctgtacctgtctgctggcctgctgagccggctgggcgccgccttcaacctggacacccgggaggacaacgtcatcagaaaatatggagaccccggcagcctgtttggcttcagcctggccatgcactggcagctgcagcctgaggacaagaggctgctgctggtgggcgcccccagggctgaggccctgcccctgcagagggccaacagaactggaggcctgtacagctgtgacatcacagcccggggcccctgcaccagaattgaatttgacaatgatgctgaccccaccagcgagagcaaagaagaccagtggatgggcgtgacagtgcagagccagggccctgggggcaaggtggtgacctgtgcccacagatatgagaagaggcagcacgtgaacaccaagcaggagagccgggacatcttcggccgctgctacgtgctgagccagaacctgagaattgaagatgacatggatggaggagactggagcttctgtgatggccgcctgcggggccacgagaagtttggcagctgccagcagggcgtggccgccaccttcaccaaggacttccactacatcgtgtttggagcccctggcacctacaactggaagggcatcgtgcgggtggagcagaagaacaacaccttctttgacatgaacatctttgaagatggcccctatgaggtgggcggggagacagaacatgatgagagcctggtgcctgtgcctgccaacagctacctgggcctgctcttcctgacctctgtgtcctacacagatcctgaccagtttgtgtacaagacccggcccccccgggagcagcctgacaccttcccagatgtgatgatgaacagctacctgggcttcagcctggacagcgggaaaggaattgtgtccaaggatgagatcacctttgtgtctggggccccccgggccaaccacagcggggctgtggtgctgctgaagagggacatgaagagcgcccacctgctgcctgagcacatctttgatggagagggcctggccagcagctttggctatgatgtggccgtggtggacctgaacaaggatggctggcaggacatcgtcatcggggccccccagtactttgacagagatggagaggtgggcggcgctgtgtatgtgtacatgaaccagcagggccgctggaacaacgtgaagcccatccggctgaatggcaccaaggacagcatgtttggaattgctgtgaagaacattggagacatcaaccaggacggctacccagacattgctgtgggcgccccctatgatgacctgggcaaggtgttcatctaccacggcagcgccaacggcatcaacaccaagcccacccaggtgctgaagggcatcagcccctacttcggctacagcattgctggcaacatggacctggacagaaattcctacccagatgtggccgtgggcagcctgagtgacagcgtgaccatcttccgcagcaggcctgtgatcaacatccagaagaccatcaccgtgacccccaacagaattgacctgcggcagaagacagcctgtggggcccccagcggcatctgcctgcaggtgaagagctgctttgagtacacagccaacccagctggctacaaccccagcatcagcatcgtgggcaccctggaggccgagaaggagaggaggaagagcggcctgagcagccgggtgcagttcaggaaccagggcagcgagcccaagtacacccaggagctgaccctgaagaggcagaagcagaaggtgtgcatggaggagaccctgtggctgcaggacaacatccgggacaagctgcggcccatccccatcacagcctctgtggagatccaggagcccagcagcagaagaagagtgaacagcctgcctgaggtgctgcccatcctgaacagtgatgagcccaagacagcccacattgatgtgcacttcctgaaggagggctgtggagatgacaacgtgtgcaacagcaacctgaagctggagtacaagttctgcacccgggagggcaaccaggacaagttctcctacctgcccatccagaagggcgtgcctgagctggtgctgaaggaccagaaggacatcgccctggagatcaccgtgaccaacagccccagcaaccccaggaaccccaccaaggatggagatgatgcccacgaggccaagctgattgccaccttcccagacaccctgacctacagcgcctaccgggagctgcgggccttccctgagaagcagctgagctgtgtggccaaccagaatggcagccaggccgactgtgagctgggcaaccccttcaagaggaacagcaatgtgaccttctacctggtgctgagcaccacagaggtgacctttgacaccccagacctggacatcaacctgaagctggagaccaccagcaaccaggacaacctggcccccatcacagccaaggccaaggtggtgattgagctgctgctgtctgtgtctggagtggccaagcccagccaggtgtactttggaggcaccgtggtgggggagcaggccatgaagtcagaagatgaggtgggcagcctgattgaatatgagttccgggtcatcaacctgggcaagcccctgaccaacctgggcacagccaccctgaacatccagtggcccaaggagatcagcaatggcaagtggctgctgtacctggtgaaggtggagagcaagggcctggagaaggtgacctgtgagccccagaaggagatcaacagcctgaacctgacagagagccacaacagcaggaagaagcgggagatcacagagaagcagattgatgacaacaggaagttcagcctgtttgctgagaggaagtaccagaccctgaactgcagcgtgaatgtgaactgtgtgaacatccgctgccccctgcggggcctggacagcaaggccagcctcatcctgcggagccggctgtggaacagcaccttcctggaggagtacagcaagctgaactacctggacatcctgatgagggccttcattgatgtgacagctgctgctgagaacatccggctgcccaatgccggcacccaggtgcgggtgacagtgttccccagcaagacagtggcccagtacagcggcgtgccctggtggatcatcctggtggccatcctggccggcatcctgatgctggccctgctggtgttcatcctgtggaagtgtggcttcttcaagaggagccgctatgatgattctgtgccccgctaccacgctgtgcgcatcaggaaggaggagcgggagatcaaggatgagaagtacatcgacaacctggagaagaagcagtggatcaccaagtggaatgaaaatgaaagctacagctag

SEQ ID NO: 20066 - DNA, 3222 bp, Artificial Sequence
  Description of Artificial Sequence: Synthetic coding sequence
atggctgctgctggccagctgtgcctgctgtacctgtctgctggcctgctgagccggctgggcgccgccttcaacctggacacccgggaggacaacgtcatcagaaaatatggagaccccggcagcctgtttggcttcagcctggccatgcactggcagctgcagcctgaggacaagaggctgctgctggtgggcgcccccagggctgaggccctgcccctgcagagggccaacagaactggaggcctgtacagctgtgacatcacagcccggggcccctgcaccagaattgaatttgacaatgatgctgaccccaccagcgagagcaaagaagaccagtggatgggcgtgacagtgcagagccagggccctgggggcaaggtggtgacctgtgcccacagatatgagaagaggcagcacgtgaacaccaagcaggagagccgggacatcttcggccgctgctacgtgctgagccagaacctgagaattgaagatgacatggatggaggagactggagcttctgtgatggccgcctgcggggccacgagaagtttggcagctgccagcagggcgtggccgccaccttcaccaaggacttccactacatcgtgtttggagcccctggcacctacaactggaagggcatcgtgcgggtggagcagaagaacaacaccttctttgacatgaacatctttgaagatggcccctatgaggtgggcggggagacagaacatgatgagagcctggtgcctgtgcctgccaacagctacctgggcttcagcctggacagcggcaagggcatcgtgtccaaggatgagatcacctttgtgtctggggccccccgggccaaccacagcggggctgtggtgctgctgaagagggacatgaagagcgcccacctgctgcctgagcacatctttgatggagagggcctggccagcagctttggctatgatgtggccgtggtggacctgaacaaggatggctggcaggacatcgtgattggagccccccagtactttgacagagatggagaggtgggcggcgctgtgtatgtgtacatgaaccagcagggccgctggaacaacgtgaagcccatccggctgaatggcaccaaggacagcatgtttggaattgctgtgaagaacatcggggacatcaaccaggacggctacccagacattgctgtgggcgccccctatgatgacctgggcaaggtgttcatctaccacggcagcgccaacggcatcaacaccaagcccacccaggtgctgaagggcatcagcccctacttcggctacagcattgctggcaacatggacctggacaggaacagctacccagatgtggccgtgggcagcctgagtgacagcgtgaccatcttccgcagcaggcctgtgatcaacatccagaagaccatcaccgtgacccccaacagaattgacctgcggcagaagacagcctgtggggcccccagcggcatctgcctgcaggtgaagagctgctttgagtacacagccaacccagctggctacaaccccagcatcagcatcgtgggcaccctggaggccgagaaggagaggaggaagagcggcctgagcagccgggtgcagttcaggaaccagggcagcgagcccaagtacacccaggagctgaccctgaagaggcagaagcagaaggtgtgcatggaggagaccctgtggctgcaggacaacatccgggacaagctgcggcccatccccatcacagcctctgtggagatccaggagcccagcagcagaagaagagtgaacagcctgcctgaggtgctgcccatcctgaacagtgatgagcccaagacagcccacattgatgtgcacttcctgaaggagggctgtggagatgacaacgtgtgcaacagcaacctgaagctggagtacaagttctgcacccgggagggcaaccaggacaagttctcctacctgcccatccagaagggcgtgcctgagctggtgctgaaggaccagaaggacatcgccctggagatcaccgtgaccaacagccccagcaaccccaggaaccccaccaaggatggagatgatgcccacgaggccaagctgattgccaccttcccagacaccctgacctacagcgcctaccgggagctgcgggccttccctgagaagcagctgagctgtgtggccaaccagaatggcagccaggccgactgtgagctgggcaaccccttcaagaggaacagcaatgtgaccttctacctggtgctgagcaccacagaggtgacctttgacaccccagacctggacatcaacctgaagctggagaccaccagcaaccaggacaacctggcccccatcacagccaaggccaaggtggtgattgagctgctgctgtctgtgtctggagtggccaagcccagccaggtgtactttggaggcaccgtggtgggggagcaggccatgaagtcagaagatgaggtgggcagcctcatcgagtatgagttccgggtcatcaacctgggcaagcccctgaccaacctgggcacagccaccctgaacatccagtggcccaaggagatcagcaatggcaagtggctgctgtacctggtgaaggtggagagcaagggcctggagaaggtgacctgtgagccccagaaggagatcaacagcctgaacctgacagagagccacaacagcaggaagaagcgggagatcacagagaagcagattgatgacaacaggaagttcagcctgtttgctgagaggaagtaccagaccctgaactgcagcgtgaatgtgaactgtgtgaacatccgctgccccctgcggggcctggacagcaaggccagcctcatcctgcggagccggctgtggaacagcaccttcctggaggagtacagcaagctgaactacctggacatcctgatgagggccttcattgatgtgacagctgctgctgagaacatccggctgcccaatgccggcacccaggtgcgggtgaccgtcttccccagcaagacagtggcccagtacagcggcgtgccctggtggatcatcctggtggccatcctggccggcatcctgatgctggccctgctggtgttcatcctgtggaagtgtggcttcttcaagaggaacaagaaggaccactatgatgccacctaccacaaggccgagatccacgcccagcccagcgacaaggagcggctgaccagtgatgcctag

SEQ ID NO: 20067 - DNA, 3207 bp, Artificial Sequence
  Description of Artificial Sequence: Synthetic coding sequence
atggctgctgctggccagctgtgcctgctgtacctgtctgctggcctgctgagccggctgggcgccgccttcaacctggacacccgggaggacaacgtcatcagaaaatatggagaccccggcagcctgtttggcttcagcctggccatgcactggcagctgcagcctgaggacaagaggctgctgctggtgggcgcccccagggctgaggccctgcccctgcagagggccaacagaactggaggcctgtacagctgtgacatcacagcccggggcccctgcaccagaattgaatttgacaatgatgctgaccccaccagcgagagcaaagaagaccagtggatgggcgtgacagtgcagagccagggccctgggggcaaggtggtgacctgtgcccacagatatgagaagaggcagcacgtgaacaccaagcaggagagccgggacatcttcggccgctgctacgtgctgagccagaacctgagaattgaagatgacatggatggaggagactggagcttctgtgatggccgcctgcggggccacgagaagtttggcagctgccagcagggcgtggccgccaccttcaccaaggacttccactacatcgtgtttggagcccctggcacctacaactggaagggcctgctcttcctgacctctgtgtcctacacagatcctgaccagtttgtgtacaagacccggcccccccgggagcagcctgacaccttcccagatgtgatgatgaacagctacctgggcttcagcctggacagcgggaaaggaattgtgtccaaggatgagatcacctttgtgtctggggccccccgggccaaccacagcggggctgtggtgctgctgaagagggacatgaagagcgcccacctgctgcctgagcacatctttgatggagagggcctggccagcagctttggctatgatgtggccgtggtggacctgaacaaggatggctggcaggacatcgtcatcggggccccccagtactttgacagagatggagaggtgggcggcgctgtgtatgtgtacatgaaccagcagggccgctggaacaacgtgaagcccatccggctgaatggcaccaaggacagcatgtttggaattgctgtgaagaacattggagacatcaaccaggacggctacccagacattgctgtgggcgccccctatgatgacctgggcaaggtgttcatctaccacggcagcgccaacggcatcaacaccaagcccacccaggtgctgaagggcatcagcccctacttcggctacagcattgctggcaacatggacctggacagaaattcctacccagatgtggccgtgggcagcctgagtgacagcgtgaccatcttccgcagcaggcctgtgatcaacatccagaagaccatcaccgtgacccccaacagaattgacctgcggcagaagacagcctgtggggcccccagcggcatctgcctgcaggtgaagagctgctttgagtacacagccaacccagctggctacaaccccagcatcagcatcgtgggcaccctggaggccgagaaggagaggaggaagagcggcctgagcagccgggtgcagttcaggaaccagggcagcgagcccaagtacacccaggagctgaccctgaagaggcagaagcagaaggtgtgcatggaggagaccctgtggctgcaggacaacatccgggacaagctgcggcccatccccatcacagcctctgtggagatccaggagcccagcagcagaagaagagtgaacagcctgcctgaggtgctgcccatcctgaacagtgatgagcccaagacagcccacattgatgtgcacttcctgaaggagggctgtggagatgacaacgtgtgcaacagcaacctgaagctggagtacaagttctgcacccgggagggcaaccaggacaagttctcctacctgcccatccagaagggcgtgcctgagctggtgctgaaggaccagaaggacatcgccctggagatcaccgtgaccaacagccccagcaaccccaggaaccccaccaaggatggagatgatgcccacgaggccaagctgattgccaccttcccagacaccctgacctacagcgcctaccgggagctgcgggccttccctgagaagcagctgagctgtgtggccaaccagaatggcagccaggccgactgtgagctgggcaaccccttcaagaggaacagcaatgtgaccttctacctggtgctgagcaccacagaggtgacctttgacaccccagacctggacatcaacctgaagctggagaccaccagcaaccaggacaacctggcccccatcacagccaaggccaaggtggtgattgagctgctgctgtctgtgtctggagtggccaagcccagccaggtgtactttggaggcaccgtggtgggggagcaggccatgaagtcagaagatgaggtgggcagcctgattgaatatgagttccgggtcatcaacctgggcaagcccctgaccaacctgggcacagccaccctgaacatccagtggcccaaggagatcagcaatggcaagtggctgctgtacctggtgaaggtggagagcaagggcctggagaaggtgacctgtgagccccagaaggagatcaacagcctgaacctgacagagagccacaacagcaggaagaagcgggagatcacagagaagcagattgatgacaacaggaagttcagcctgtttgctgagaggaagtaccagaccctgaactgcagcgtgaatgtgaactgtgtgaacatccgctgccccctgcggggcctggacagcaaggccagcctcatcctgcggagccggctgtggaacagcaccttcctggaggagtacagcaagctgaactacctggacatcctgatgagggccttcattgatgtgacagctgctgctgagaacatccggctgcccaatgccggcacccaggtgcgggtgacagtgttccccagcaagacagtggcccagtacagcggcgtgccctggtggatcatcctggtggccatcctggccggcatcctgatgctggccctgctggtgttcatcctgtggaagtgtggcttcttcaagaggaacaagaaggaccactatgatgccacctaccacaaggccgagatccacgcccagcccagcgacaaggagcggctgaccagtgatgcctag

SEQ ID NO: 20068 - DNA, 3339 bp, Artificial Sequence
  Description of Artificial Sequence: Synthetic coding sequence
atggctgctgctggccagctgtgcctgctgtacctgtctgctggcctgctgagccggctgggcgccgccttcaacctggacacccgggaggacaacgtcatcagaaaatatggagaccccggcagcctgtttggcttcagcctggccatgcactggcagctgcagcctgaggacaagaggctgctgctggtgggcgcccccagggctgaggccctgcccctgcagagggccaacagaactggaggcctgtacagctgtgacatcacagcccggggcccctgcaccagaattgaatttgacaatgatgctgaccccaccagcgagagcaaagaagaccagtggatgggcgtgacagtgcagagccagggccctgggggcaaggtggtgacctgtgcccacagatatgagaagaggcagcacgtgaacaccaagcaggagagccgggacatcttcggccgctgctacgtgctgagccagaacctgagaattgaagatgacatggatggaggagactggagcttctgtgatggccgcctgcggggccacgagaagtttggcagctgccagcagggcgtggccgccaccttcaccaaggacttccactacatcgtgtttggagcccctggcacctacaactggaagggcatcgtgcgggtggagcagaagaacaacaccttctttgacatgaacatctttgaagatggcccctatgaggtgggcggggagacagaacatgatgagagcctggtgcctgtgcctgccaacagctacctgggcctgctcttcctgacctctgtgtcctacacagatcctgaccagtttgtgtacaagacccggcccccccgggagcagcctgacaccttcccagatgtgatgatgaacagctacctgggcttcagcctggacagcgggaaaggaattgtgtccaaggatgagatcacctttgtgtctggggccccccgggccaaccacagcggggctgtggtgctgctgaagagggacatgaagagcgcccacctgctgcctgagcacatctttgatggagagggcctggccagcagctttggctatgatgtggccgtggtggacctgaacaaggatggctggcaggacatcgtcatcggggccccccagtactttgacagagatggagaggtgggcggcgctgtgtatgtgtacatgaaccagcagggccgctggaacaacgtgaagcccatccggctgaatggcaccaaggacagcatgtttggaattgctgtgaagaacattggagacatcaaccaggacggctacccagacattgctgtgggcgccccctatgatgacctgggcaaggtgttcatctaccacggcagcgccaacggcatcaacaccaagcccacccaggtgctgaagggcatcagcccctacttcggctacagcattgctggcaacatggacctggacagaaattcctacccagatgtggccgtgggcagcctgagtgacagcgtgaccatcttccgcagcaggcctgtgatcaacatccagaagaccatcaccgtgacccccaacagaattgacctgcggcagaagacagcctgtggggcccccagcggcatctgcctgcaggtgaagagctgctttgagtacacagccaacccagctggctacaaccccagcatcagcatcgtgggcaccctggaggccgagaaggagaggaggaagagcggcctgagcagccgggtgcagttcaggaaccagggcagcgagcccaagtacacccaggagctgaccctgaagaggcagaagcagaaggtgtgcatggaggagaccctgtggctgcaggacaacatccgggacaagctgcggcccatccccatcacagcctctgtggagatccaggagcccagcagcagaagaagagtgaacagcctgcctgaggtgctgcccatcctgaacagtgatgagcccaagacagcccacattgatgtgcacttcctgaaggagggctgtggagatgacaacgtgtgcaacagcaacctgaagctggagtacaagttctgcacccgggagggcaaccaggacaagttctcctacctgcccatccagaagggcgtgcctgagctggtgctgaaggaccagaaggacatcgccctggagatcaccgtgaccaacagccccagcaaccccaggaaccccaccaaggatggagatgatgcccacgaggccaagctgattgccaccttcccagacaccctgacctacagcgcctaccgggagctgcgggccttccctgagaagcagctgagctgtgtggccaaccagaatggcagccaggccgactgtgagctgggcaaccccttcaagaggaacagcaatgtgaccttctacctggtgctgagcaccacagaggtgacctttgacaccccagacctggacatcaacctgaagctggagaccaccagcaaccaggacaacctggcccccatcacagccaaggccaaggtggtgattgagctgctgctgtctgtgtctggagtggccaagcccagccaggtgtactttggaggcaccgtggtgggggagcaggccatgaagtcagaagatgaggtgggcagcctgattgaatatgagttccgggtcatcaacctgggcaagcccctgaccaacctgggcacagccaccctgaacatccagtggcccaaggagatcagcaatggcaagtggctgctgtacctggtgaaggtggagagcaagggcctggagaaggtgacctgtgagccccagaaggagatcaacagcctgaacctgacagagagccacaacagcaggaagaagcgggagatcacagagaagcagattgatgacaacaggaagttcagcctgtttgctgagaggaagtaccagaccctgaactgcagcgtgaatgtgaactgtgtgaacatccgctgccccctgcggggcctggacagcaaggccagcctcatcctgcggagccggctgtggaacagcaccttcctggaggagtacagcaagctgaactacctggacatcctgatgagggccttcattgatgtgacagctgctgctgagaacatccggctgcccaatgccggcacccaggtgcgggtgacagtgttccccagcaagacagtggcccagtacagcggcgtgccctggtggatcatcctggtggccatcctggccggcatcctgatgctggccctgctggtgttcatcctgtggaagtgtggcttcttcaagaggaacaagaaggaccactatgatgccacctaccacaaggccgagatccacgcccagcccagcgacaaggagcggctgaccagtgatgcctag

SEQ ID NO: 20069 - DNA, 3276 bp, Artificial Sequence
  Description of Artificial Sequence: Synthetic coding sequence
atggctgctgctggccagctgtgcctgctgtacctgtctgctggcctgctgagccggctgggcgccgccttcaacctggacacccgggaggacaacgtcatcagaaaatatggagaccccggcagcctgtttggcttcagcctggccatgcactggcagctgcagcctgaggacaagaggctgctgctggtgggcgcccccagggctgaggccctgcccctgcagagggccaacagaactggaggcctgtacagctgtgacatcacagcccggggcccctgcaccagaattgaatttgacaatgatgctgaccccaccagcgagagcaaagaagaccagtggatgggcgtgacagtgcagagccagggccctgggggcaaggtggtgacctgtgcccacagatatgagaagaggcagcacgtgaacaccaagcaggagagccgggacatcttcggccgctgctacgtgctgagccagaacctgagaattgaagatgacatggatggaggagactggagcttctgtgatggccgcctgcggggccacgagaagtttggcagctgccagcagggcgtggccgccaccttcaccaaggacttccactacatcgtgtttggagcccctggcacctacaactggaagggcatcgtgcgggtggagcagaagaacaacaccttctttgacatgaacatctttgaagatggcccctatgaggtgggcggggagacagaacatgatgagagcctggtgcctgtgcctgccaacagctacctgggcttcagcctggacagcggcaagggcatcgtgtccaaggatgagatcacctttgtgtctggggccccccgggccaaccacagcggggctgtggtgctgctgaagagggacatgaagagcgcccacctgctgcctgagcacatctttgatggagagggcctggccagcagctttggctatgatgtggccgtggtggacctgaacaaggatggctggcaggacatcgtgattggagccccccagtactttgacagagatggagaggtgggcggcgctgtgtatgtgtacatgaaccagcagggccgctggaacaacgtgaagcccatccggctgaatggcaccaaggacagcatgtttggaattgctgtgaagaacatcggggacatcaaccaggacggctacccagacattgctgtgggcgccccctatgatgacctgggcaaggtgttcatctaccacggcagcgccaacggcatcaacaccaagcccacccaggtgctgaagggcatcagcccctacttcggctacagcattgctggcaacatggacctggacaggaacagctacccagatgtggccgtgggcagcctgagtgacagcgtgaccatcttccgcagcaggcctgtgatcaacatccagaagaccatcaccgtgacccccaacagaattgacctgcggcagaagacagcctgtggggcccccagcggcatctgcctgcaggtgaagagctgctttgagtacacagccaacccagctggctacaaccccagcatcagcatcgtgggcaccctggaggccgagaaggagaggaggaagagcggcctgagcagccgggtgcagttcaggaaccagggcagcgagcccaagtacacccaggagctgaccctgaagaggcagaagcagaaggtgtgcatggaggagaccctgtggctgcaggacaacatccgggacaagctgcggcccatccccatcacagcctctgtggagatccaggagcccagcagcagaagaagagtgaacagcctgcctgaggtgctgcccatcctgaacagtgatgagcccaagacagcccacattgatgtgcacttcctgaaggagggctgtggagatgacaacgtgtgcaacagcaacctgaagctggagtacaagttctgcacccgggagggcaaccaggacaagttctcctacctgcccatccagaagggcgtgcctgagctggtgctgaaggaccagaaggacatcgccctggagatcaccgtgaccaacagccccagcaaccccaggaaccccaccaaggatggagatgatgcccacgaggccaagctgattgccaccttcccagacaccctgacctacagcgcctaccgggagctgcgggccttccctgagaagcagctgagctgtgtggccaaccagaatggcagccaggccgactgtgagctgggcaaccccttcaagaggaacagcaatgtgaccttctacctggtgctgagcaccacagaggtgacctttgacaccccagacctggacatcaacctgaagctggagaccaccagcaaccaggacaacctggcccccatcacagccaaggccaaggtggtgattgagctgctgctgtctgtgtctggagtggccaagcccagccaggtgtactttggaggcaccgtggtgggggagcaggccatgaagtcagaagatgaggtgggcagcctcatcgagtatgagttccgggtcatcaacctgggcaagcccctgaccaacctgggcacagccaccctgaacatccagtggcccaaggagatcagcaatggcaagtggctgctgtacctggtgaaggtggagagcaagggcctggagaaggtgacctgtgagccccagaaggagatcaacagcctgaacctgacagagagccacaacagcaggaagaagcgggagatcacagagaagcagattgatgacaacaggaagttcagcctgtttgctgagaggaagtaccagaccctgaactgcagcgtgaatgtgaactgtgtgaacatccgctgccccctgcggggcctggacagcaaggccagcctcatcctgcggagccggctgtggaacagcaccttcctggaggagtacagcaagctgaactacctggacatcctgatgagggccttcattgatgtgacagctgctgctgagaacatccggctgcccaatgccggcacccaggtgcgggtgaccgtcttccccagcaagacagtggcccagtacagcggcgtgccctggtggatcatcctggtggccatcctggccggcatcctgatgctggccctgctggtgttcatcctgtggaagtgtggcttcttcaagaggagccgctatgatgacagcgtgccccgctaccacgctgtgcgcatcaggaaggaggagcgggagatcaaggatgagaagtacatcgacaacctggagaagaagcagtggatcaccaagtggaatgaaaatgaaagctacagctag

SEQ ID NO: 20070 - DNA, 2865 bp, Artificial Sequence
  Description of Artificial Sequence: Synthetic coding sequence
atgggcgtgacagtgcagagccagggccctgggggcaaggtggtgacctgtgcccacagatatgagaagaggcagcacgtgaacaccaagcaggagagccgggacatcttcggccgctgctacgtgctgagccagaacctgagaattgaagatgacatggatggaggagactggagcttctgtgatggccgcctgcggggccacgagaagtttggcagctgccagcagggcgtggccgccaccttcaccaaggacttccactacatcgtgtttggagcccctggcacctacaactggaagggcctgctcttcctgacctctgtgtcctacacagatcctgaccagtttgtgtacaagacccggcccccccgggagcagcctgacaccttcccagatgtgatgatgaacagctacctgggcttcagcctggacagcgggaaaggaattgtgtccaaggatgagatcacctttgtgtctggggccccccgggccaaccacagcggggctgtggtgctgctgaagagggacatgaagagcgcccacctgctgcctgagcacatctttgatggagagggcctggccagcagctttggctatgatgtggccgtggtggacctgaacaaggatggctggcaggacatcgtcatcggggccccccagtactttgacagagatggagaggtgggcggcgctgtgtatgtgtacatgaaccagcagggccgctggaacaacgtgaagcccatccggctgaatggcaccaaggacagcatgtttggaattgctgtgaagaacattggagacatcaaccaggacggctacccagacattgctgtgggcgccccctatgatgacctgggcaaggtgttcatctaccacggcagcgccaacggcatcaacaccaagcccacccaggtgctgaagggcatcagcccctacttcggctacagcattgctggcaacatggacctggacagaaattcctacccagatgtggccgtgggcagcctgagtgacagcgtgaccatcttccgcagcaggcctgtgatcaacatccagaagaccatcaccgtgacccccaacagaattgacctgcggcagaagacagcctgtggggcccccagcggcatctgcctgcaggtgaagagctgctttgagtacacagccaacccagctggctacaaccccagcatcagcatcgtgggcaccctggaggccgagaaggagaggaggaagagcggcctgagcagccgggtgcagttcaggaaccagggcagcgagcccaagtacacccaggagctgaccctgaagaggcagaagcagaaggtgtgcatggaggagaccctgtggctgcaggacaacatccgggacaagctgcggcccatccccatcacagcctctgtggagatccaggagcccagcagcagaagaagagtgaacagcctgcctgaggtgctgcccatcctgaacagtgatgagcccaagacagcccacattgatgtgcacttcctgaaggagggctgtggagatgacaacgtgtgcaacagcaacctgaagctggagtacaagttctgcacccgggagggcaaccaggacaagttctcctacctgcccatccagaagggcgtgcctgagctggtgctgaaggaccagaaggacatcgccctggagatcaccgtgaccaacagccccagcaaccccaggaaccccaccaaggatggagatgatgcccacgaggccaagctgattgccaccttcccagacaccctgacctacagcgcctaccgggagctgcgggccttccctgagaagcagctgagctgtgtggccaaccagaatggcagccaggccgactgtgagctgggcaaccccttcaagaggaacagcaatgtgaccttctacctggtgctgagcaccacagaggtgacctttgacaccccagacctggacatcaacctgaagctggagaccaccagcaaccaggacaacctggcccccatcacagccaaggccaaggtggtgattgagctgctgctgtctgtgtctggagtggccaagcccagccaggtgtactttggaggcaccgtggtgggggagcaggccatgaagtcagaagatgaggtgggcagcctgattgaatatgagttccgggtcatcaacctgggcaagcccctgaccaacctgggcacagccaccctgaacatccagtggcccaaggagatcagcaatggcaagtggctgctgtacctggtgaaggtggagagcaagggcctggagaaggtgacctgtgagccccagaaggagatcaacagcctgaacctgacagagagccacaacagcaggaagaagcgggagatcacagagaagcagattgatgacaacaggaagttcagcctgtttgctgagaggaagtaccagaccctgaactgcagcgtgaatgtgaactgtgtgaacatccgctgccccctgcggggcctggacagcaaggccagcctcatcctgcggagccggctgtggaacagcaccttcctggaggagtacagcaagctgaactacctggacatcctgatgagggccttcattgatgtgacagctgctgctgagaacatccggctgcccaatgccggcacccaggtgcgggtgacagtgttccccagcaagacagtggcccagtacagcggcgtgccctggtggatcatcctggtggccatcctggccggcatcctgatgctggccctgctggtgttcatcctgtggaagtgtggcttcttcaagaggaacaagaaggaccactatgatgccacctaccacaaggccgagatccacgcccagcccagcgacaaggagcggctgaccagtgatgcctag

SEQ ID NO: 20071 - DNA, 3393 bp, Artificial Sequence; identical to SEQ ID NO: 20065
  Description of Artificial Sequence: Synthetic coding sequence

SEQ ID NO: 20072 - DNA, 3261 bp, Artificial Sequence
  Description of Artificial Sequence: Synthetic coding sequence
atggctgctgctggccagctgtgcctgctgtacctgtctgctggcctgctgagccggctgggcgccgccttcaacctggacacccgggaggacaacgtcatcagaaaatatggagaccccggcagcctgtttggcttcagcctggccatgcactggcagctgcagcctgaggacaagaggctgctgctggtgggcgcccccagggctgaggccctgcccctgcagagggccaacagaactggaggcctgtacagctgtgacatcacagcccggggcccctgcaccagaattgaatttgacaatgatgctgaccccaccagcgagagcaaagaagaccagtggatgggcgtgacagtgcagagccagggccctgggggcaaggtggtgacctgtgcccacagatatgagaagaggcagcacgtgaacaccaagcaggagagccgggacatcttcggccgctgctacgtgctgagccagaacctgagaattgaagatgacatggatggaggagactggagcttctgtgatggccgcctgcggggccacgagaagtttggcagctgccagcagggcgtggccgccaccttcaccaaggacttccactacatcgtgtttggagcccctggcacctacaactggaagggcctgctcttcctgacctctgtgtcctacacagatcctgaccagtttgtgtacaagacccggcccccccgggagcagcctgacaccttcccagatgtgatgatgaacagctacctgggcttcagcctggacagcgggaaaggaattgtgtccaaggatgagatcacctttgtgtctggggccccccgggccaaccacagcggggctgtggtgctgctgaagagggacatgaagagcgcccacctgctgcctgagcacatctttgatggagagggcctggccagcagctttggctatgatgtggccgtggtggacctgaacaaggatggctggcaggacatcgtcatcggggccccccagtactttgacagagatggagaggtgggcggcgctgtgtatgtgtacatgaaccagcagggccgctggaacaacgtgaagcccatccggctgaatggcaccaaggacagcatgtttggaattgctgtgaagaacattggagacatcaaccaggacggctacccagacattgctgtgggcgccccctatgatgacctgggcaaggtgttcatctaccacggcagcgccaacggcatcaacaccaagcccacccaggtgctgaagggcatcagcccctacttcggctacagcattgctggcaacatggacctggacagaaattcctacccagatgtggccgtgggcagcctgagtgacagcgtgaccatcttccgcagcaggcctgtgatcaacatccagaagaccatcaccgtgacccccaacagaattgacctgcggcagaagacagcctgtggggcccccagcggcatctgcctgcaggtgaagagctgctttgagtacacagccaacccagctggctacaaccccagcatcagcatcgtgggcaccctggaggccgagaaggagaggaggaagagcggcctgagcagccgggtgcagttcaggaaccagggcagcgagcccaagtacacccaggagctgaccctgaagaggcagaagcagaaggtgtgcatggaggagaccctgtggctgcaggacaacatccgggacaagctgcggcccatccccatcacagcctctgtggagatccaggagcccagcagcagaagaagagtgaacagcctgcctgaggtgctgcccatcctgaacagtgatgagcccaagacagcccacattgatgtgcacttcctgaaggagggctgtggagatgacaacgtgtgcaacagcaacctgaagctggagtacaagttctgcacccgggagggcaaccaggacaagttctcctacctgcccatccagaagggcgtgcctgagctggtgctgaaggaccagaaggacatcgccctggagatcaccgtgaccaacagccccagcaaccccaggaaccccaccaaggatggagatgatgcccacgaggccaagctgattgccaccttcccagacaccctgacctacagcgcctaccgggagctgcgggccttccctgagaagcagctgagctgtgtggccaaccagaatggcagccaggccgactgtgagctgggcaaccccttcaagaggaacagcaatgtgaccttctacctggtgctgagcaccacagaggtgacctttgacaccccagacctggacatcaacctgaagctggagaccaccagcaaccaggacaacctggcccccatcacagccaaggccaaggtggtgattgagctgctgctgtctgtgtctggagtggccaagcccagccaggtgtactttggaggcaccgtggtgggggagcaggccatgaagtcagaagatgaggtgggcagcctgattgaatatgagttccgggtcatcaacctgggcaagcccctgaccaacctgggcacagccaccctgaacatccagtggcccaaggagatcagcaatggcaagtggctgctgtacctggtgaaggtggagagcaagggcctggagaaggtgacctgtgagccccagaaggagatcaacagcctgaacctgacagagagccacaacagcaggaagaagcgggagatcacagagaagcagattgatgacaacaggaagttcagcctgtttgctgagaggaagtaccagaccctgaactgcagcgtgaatgtgaactgtgtgaacatccgctgccccctgcggggcctggacagcaaggccagcctcatcctgcggagccggctgtggaacagcaccttcctggaggagtacagcaagctgaactacctggacatcctgatgagggccttcattgatgtgacagctgctgctgagaacatccggctgcccaatgccggcacccaggtgcgggtgacagtgttccccagcaagacagtggcccagtacagcggcgtgccctggtggatcatcctggtggccatcctggccggcatcctgatgctggccctgctggtgttcatcctgtggaagtgtggcttcttcaagaggagccgctatgatgattctgtgccccgctaccacgctgtgcgcatcaggaaggaggagcgggagatcaaggatgagaagtacatcgacaacctggagaagaagcagtggatcaccaagtggaatgaaaatgaaagctacagctag

SEQ ID NO: 20073 - DNA, 3414 bp, Artificial Sequence
  Description of Artificial Sequence: Synthetic coding sequence
atggccggggcccggagccgggacccctggggcgccagcggcatctgctacctgtttggcagcctgctggtggagctgctcttcagcagagctgtggccttcaacctggatgtgatgggcgccctgaggaaggagggggagcccggcagcctgtttggcttctctgtggccctgcaccggcagctgcagccccggccccagagctggctgctggtgggcgccccccaggccctggccctgcccggccagcaggccaacagaactggaggcctgtttgcctgccccctgagcctggaggagacagactgctacagagtggacatcgaccagggcgctgacatgcagaaggagagcaaggagaaccagtggctgggcgtgtctgtgcgcagccagggccctgggggcaagatcgtgacctgtgcccacagatatgaggcccggcagagggtggaccagatcctggagacccgggacatgattggccgctgctttgtgctgagccaggacctggccatcagagatgagctggatggaggagagtggaagttctgtgagggccggccccagggccacgagcagtttggcttctgccagcagggcacagctgctgccttctccccagacagccactacctgctgtttggagcccctggcacctacaactggaagggcctgctgtttgtgaccaacatcgacagcagtgaccctgaccagctggtgtacaagaccctggaccctgctgaccggctgcccggccctgctggggacctggccctgaacagctacctgggcttcagcattgattctgggaagggcctggtgcgggcagaggagctgagctttgtggccggggccccccgggccaaccacaagggagctgtggtgatcctgaggaaggacagcgccagccggctggtgcctgaggtgatgctgagcggggagcggctgaccagcggcttcggctacagcctggccgtggccgacctgaacagtgatggctggccagacctgattgtgggcgccccctacttctttgagcggcaggaggagctgggcggcgctgtgtatgtgtacctgaaccagggcggccactgggccggcatcagccccctgcggctgtgtggcagcccagacagcatgtttggcatcagcctggccgtgctgggggacctgaaccaggacggcttcccagacattgctgtgggcgccccctttgatggagatggcaaggtgttcatctaccacggcagcagcctgggcgtggtggccaagcccagccaggtgctggagggggaggccgtgggcatcaagagctttggctacagcctgagcggcagcctggacatggatggcaaccagtacccagacctgctggtgggcagcctggccgacacagctgtgctcttccgggcccggcccatcctgcacgtgtcccatgaggtgtccatcgcccccaggagcattgacctggagcagcccaactgtgccggcggccacagcgtgtgtgtggacctgcgggtgtgcttctcctacatcgctgtgcccagcagctacagccccaccgtggccctggactatgtgctggatgctgacacagaccggcggctgcggggccaggtgccccgggtgaccttcctgagcaggaacctggaggagcccaagcaccaggccagcggcaccgtgtggctgaagcaccagcacgacagagtgtgtggagatgccatgttccagctgcaggagaatgtgaaggacaagctgcgggccatcgtggtgaccctgagctacagcctgcagaccccccggctgcggcggcaggcccctggccagggcctgccccctgtggcccccatcctgaatgcccaccagcccagcacccagagagctgagatccacttcctgaagcagggctgtggggaggacaagatctgccagagcaacctgcagctggtgcgggcccgcttctgcaccagggtgtctgacacagagttccagcccctgcccatggatgtggatggcaccacagccctgtttgccctgagcggccagcctgtgattggcctggagctgatggtgaccaacctgcccagcgaccctgcccagccccaggctgatggagatgatgcccacgaggcccagctgctggtgatgctgcctgacagcctgcactacagcggcgtgcgggccctggaccctgctgagaagcccctgtgcctgagcaatgaaaatgccagccacgtggagtgtgagctgggcaaccccatgaagagaggagcccaggtgaccttctacctgatcctgagcaccagcggcatcagcattgagaccacagagctggaggtggagctgctgctggccaccatcagcgagcaggagctgcaccctgtgtctgcccgggcccgggtcttcatcgagctgcccctgagcattgctggcatggccatcccccagcagctgttcttctctggagtggtgcggggggagcgggccatgcagagcgagagagatgtgggcagcaaggtgaagtatgaggtgacagtgagcaaccagggccagagcctgcggaccctgggcagcgccttcctgaacatcatgtggccccatgaaattgccaacgggaagtggctgctgtaccccatgcaggtggagctggagggcggccagggccctggccagaagggcctgtgcagcccccggcccaacatcctgcacctggatgtggacagccgggacagaagaagaagagagctggagcccccagagcagcaggagcccggggagcggcaggagcccagcatgtcctggtggcctgtgtcctctgctgagaagaagaagaacatcaccctggactgtgcccggggcacagccaactgtgtggtgttcagctgccccctgtacagctttgacagagctgctgtgctgcacgtgtggggccgcctgtggaacagcaccttcctggaggagtacagcgctgtgaagagcctggaggtgattgtgcgggccaacatcaccgtgaagagcagcatcaagaacctgatgctgagagatgccagcaccgtcatccctgtgatggtgtacctggaccccatggctgtggtggccgagggcgtgccctggtgggtgatcctgctggccgtgctggccggcctgctggtgctggccctgctggtgctgctgctgtggaagatgggcttcttcaagagggccaagcaccctgaggccaccgtgccccagtaccacgctgtgaagatcccccgggaggaccggcagcagttcaaggaggagaagacaggcaccatcctgaggaacaactggggcagcccccggcgggagggcccagatgcccaccccatcctggccgcagatggccaccctgagctgggcccagatggccaccctggccctggaacagcctag

SEQ ID NO: 20074 - DNA, 3489 bp, Artificial Sequence
  Description of Artificial Sequence: Synthetic coding sequence
atggccggggcccggagccgggacccctggggcgccagcggcatctgctacctgtttggcagcctgctggtggagctgctcttcagcagagctgtggccttcaacctggatgtgatgggcgccctgaggaaggagggggagcccggcagcctgtttggcttctctgtggccctgcaccggcagctgcagccccggccccagagctggctgctggtgggcgccccccaggccctggccctgcccggccagcaggccaacagaactggaggcctgtttgcctgccccctgagcctggaggagacagactgctacagagtggacatcgaccagggcgctgacatgcagaaggagagcaaggagaaccagtggctgggcgtgtctgtgcgcagccagggccctgggggcaagatcgtgacctgtgcccacagatatgaggcccggcagagggtggaccagatcctggagacccgggacatgattggccgctgctttgtgctgagccaggacctggccatcagagatgagctggatggaggagagtggaagttctgtgagggccggccccagggccacgagcagtttggcttctgccagcagggcacagctgctgccttctccccagacagccactacctgctgtttggagcccctggcacctacaactggaagggcacagcccgggtggagctgtgtgcccagggcagcgctgacctggcccacctggatgatggcccctatgaggccggcggggagaaggagcaggaccccaggctcatccctgtgcctgccaacagctacttcggcctgctgtttgtgaccaacatcgacagcagtgaccctgaccagctggtgtacaagaccctggaccctgctgaccggctgcccggccctgctggggacctggccctgaacagctacctgggcttcagcattgattctgggaagggcctggtgcgggcagaggagctgagctttgtggccggggccccccgggccaaccacaagggagctgtggtgatcctgaggaaggacagcgccagccggctggtgcctgaggtgatgctgagcggggagcggctgaccagcggcttcggctacagcctggccgtggccgacctgaacagtgatggctggccagacctgattgtgggcgccccctacttctttgagcggcaggaggagctgggcggcgctgtgtatgtgtacctgaaccagggcggccactgggccggcatcagccccctgcggctgtgtggcagcccagacagcatgtttggcatcagcctggccgtgctgggggacctgaaccaggacggcttcccagacattgctgtgggcgccccctttgatggagatggcaaggtgttcatctaccacggcagcagcctgggcgtggtggccaagcccagccaggtgctggagggggaggccgtgggcatcaagagctttggctacagcctgagcggcagcctggacatggatggcaaccagtacccagacctgctggtgggcagcctggccgacacagctgtgctcttccgggcccggcccatcctgcacgtgtcccatgaggtgtccatcgcccccaggagcattgacctggagcagcccaactgtgccggcggccacagcgtgtgtgtggacctgcgggtgtgcttctcctacatcgctgtgcccagcagctacagccccaccgtggccctggactatgtgctggatgctgacacagaccggcggctgcggggccaggtgccccgggtgaccttcctgagcaggaacctggaggagcccaagcaccaggccagcggcaccgtgtggctgaagcaccagcacgacagagtgtgtggagatgccatgttccagctgcaggagaatgtgaaggacaagctgcgggccatcgtggtgaccctgagctacagcctgcagaccccccggctgcggcggcaggcccctggccagggcctgccccctgtggcccccatcctgaatgcccaccagcccagcacccagagagctgagatccacttcctgaagcagggctgtggggaggacaagatctgccagagcaacctgcagctggtgcgggcccgcttctgcaccagggtgtctgacacagagttccagcccctgcccatggatgtggatggcaccacagccctgtttgccctgagcggccagcctgtgattggcctggagctgatggtgaccaacctgcccagcgaccctgcccagccccaggctgatggagatgatgcccacgaggcccagctgctggtgatgctgcctgacagcctgcactacagcggcgtgcgggccctggaccctgctgagaagcccctgtgcctgagcaatgaaaatgccagccacgtggagtgtgagctgggcaaccccatgaagagaggagcccaggtgaccttctacctgatcctgagcaccagcggcatcagcattgagaccacagagctggaggtggagctgctgctggccaccatcagcgagcaggagctgcaccctgtgtctgcccgggcccgggtcttcatcgagctgcccctgagcattgctggcatggccatcccccagcagctgttcttctctggagtggtgcggggggagcgggccatgcagagcgagagagatgtgggcagcaaggtgaagtatgaggtgacagtgagcaaccagggccagagcctgcggaccctgggcagcgccttcctgaacatcatgtggccccatgaaattgccaacgggaagtggctgctgtaccccatgcaggtggagctggagggcggccagggccctggccagaagggcctgtgcagcccccggcccaacatcctgcacctggatgtggacagccgggacagaagaagaagagagctggagcccccagagcagcaggagcccggggagcggcaggagcccagcatgtcctggtggcctgtgtcctctgctgagaagaagaagaacatcaccctggactgtgcccggggcacagccaactgtgtggtgttcagctgccccctgtacagctttgacagagctgctgtgctgcacgtgtggggccgcctgtggaacagcaccttcctggaggagtacagcgctgtgaagagcctggaggtgattgtgcgggccaacatcaccgtgaagagcagcatcaagaacctgatgctgagagatgccagcaccgtcatccctgtgatggtgtacctggaccccatggctgtggtggccgagggcgtgccctggtgggtgatcctgctggccgtgctggccggcctgctggtgctggccctgctggtgctgctgctgtggaagtgtggcttcttccacaggagcagccagagcagcagcttccccaccaactaccaccgggcctgcctggccgtgcagcccagcgccatggaggtgggcggccctggcaccgtgggctgggacagcagcaatggccgcagcacccccaggcctccctgccccagcaccatgaggtag

SEQ ID NO: 20075 - DNA, 2976 bp, Artificial Sequence
  Description of Artificial Sequence: Synthetic coding sequence
atggccggggcccggagccgggacccctggggcgccagcggcatctgctacctgtttggcagcctgctggtggagctgctcttcagcagagctgtggccttcaacctggatgtgatgggcgccctgaggaaggagggggagcccggcagcctgtttggcttctctgtggccctgcaccggcagctgcagccccggccccagagctggctgctggtgggcgccccccaggccctggccctgcccggccagcaggccaacagaactggaggcctgtttgcctgccccctgagcctggaggagacagactgctacagagtggacatcgaccagggcgctgacatgcagaaggagagcaaggagaaccagtggctgggcgtgtctgtgcgcagccagggccctgggggcaagatcgtgacctgtgcccacagatatgaggcccggcagagggtggaccagatcctggagacccgggacatgattggccgctgctttgtgctgagccaggacctggccatcagagatgagctggatggaggagagtggaagttctgtgagggccggccccagggccacgagcagtttggcttctgccagcagggcacagctgctgccttctccccagacagccactacctgctgtttggagcccctggcacctacaactggaagggcacagcccgggtggagctgtgtgcccagggcagcgctgacctggcccacctggatgatggcccctatgaggccggcggggagaaggagcaggaccccaggctcatccctgtgcctgccaacagctacttcggcctgctgtttgtgaccaacatcgacagcagtgaccctgaccagctggtgtacaagaccctggaccctgctgaccggctgcccggccctgctggggacctggccctgaacagctacctgggcttcagcattgattctgggaagggcctggtgcgggcagaggagctgagctttgtggccggggccccccgggccaaccacaagggagctgtggtgatcctgaggaaggacagcgccagccggctggtgcctgaggtgatgctgagcggggagcggctgaccagcggcttcggctacagcctggccgtggccgacctgaacagtgatggctggccagacctgattgtgggcgccccctacttctttgagcggcaggaggagctgggcggcgctgtgtatgtgtacctgaaccagggcggccactgggccggcatcagccccctgcggctgtgtggcagcccagacagcatgtttggcatcagcctggccgtgctgggggacctgaaccaggacggcttcccagacattgctgtgggcgccccctttgatggagatggcaaggtgttcatctaccacggcagcagcctgggcgtggtggccaagcccagccaggtgctggagggggaggccgtgggcatcaagagctttggctacagcctgagcggcagcctggacatggatggcaaccagtacccagacctgctggtgggcagcctggccgacacagctgtgctcttccgggcccggcccatcctgcacgtgtcccatgaggtgtccatcgcccccaggagcattgacctggagcagcccaactgtgccggcggccacagcgtgtgtgtggacctgcgggtgtgcttctcctacatcgctgtgcccagcagctacagccccaccgtggccctggactatgtgctggatgctgacacagaccggcggctgcggggccaggtgccccgggtgaccttcctgagcaggaacctggaggagcccaagcaccaggccctggaccctgctgagaagcccctgtgcctgagcaatgaaaatgccagccacgtggagtgtgagctgggcaaccccatgaagagaggagcccaggtgaccttctacctgatcctgagcaccagcggcatcagcattgagaccacagagctggaggtggagctgctgctggccaccatcagcgagcaggagctgcaccctgtgtctgcccgggcccgggtcttcatcgagctgcccctgagcattgctggcatggccatcccccagcagctgttcttcagcggcgtggtgcggggggagcgggccatgcagagcgagagagatgtgggcagcaaggtgaagtatgaggtgacagtgagcaaccagggccagagcctgcggaccctgggcagcgccttcctgaacatcatgtggccccatgagatcgccaacgggaagtggctgctgtaccccatgcaggtggagctggagggcggccagggccctggccagaagggcctgtgcagcccccggcccaacatcctgcacctggatgtggacagccgggacagaagaagaagagagctggagcccccagagcagcaggagcctggagagcggcaggagcccagcatgtcctggtggcctgtgagcagcgctgagaagaagaagaacatcaccctggactgtgcccggggcacagccaactgtgtggtgttcagctgccccctgtacagctttgacagagctgctgtgctgcacgtgtggggccgcctgtggaacagcaccttcctggaggagtacagcgctgtgaagagcctggaggtgattgtgcgggccaacatcaccgtgaagagcagcatcaagaacctgatgctgagagatgccagcaccgtcatccctgtgatggtgtacctggaccccatggctgtggtggccgagggcgtgccctggtgggtgatcctgctggccgtgctggccggcctgctggtgctggccctgctggtgctgctgctgtggaagtgtggcttcttccacaggagcagccagagcagcagcttccccaccaactaccaccgggcctgcctggccgtgcagcccagcgccatggaggtgggcggccctggcaccgtgggctgggacagcagcaatggccgcagcaccccccggcccccctgccccagcaccatgaggtag

SEQ ID NO: 20076 - DNA, 3357 bp, Artificial Sequence
  Description of Artificial Sequence: Synthetic coding sequence
atggccggggcccggagccgggacccctggggcgccagcggcatctgctacctgtttggcagcctgctggtggagctgctcttcagcagagctgtggccttcaacctggatgtgatgggcgccctgaggaaggagggggagcccggcagcctgtttggcttctctgtggccctgcaccggcagctgcagccccggccccagagctggctgctggtgggcgccccccaggccctggccctgcccggccagcaggccaacagaactggaggcctgtttgcctgccccctgagcctggaggagacagactgctacagagtggacatcgaccagggcgctgacatgcagaaggagagcaaggagaaccagtggctgggcgtgtctgtgcgcagccagggccctgggggcaagatcgtgacctgtgcccacagatatgaggcccggcagagggtggaccagatcctggagacccgggacatgattggccgctgctttgtgctgagccaggacctggccatcagagatgagctggatggaggagagtggaagttctgtgagggccggccccagggccacgagcagtttggcttctgccagcagggcacagctgctgccttctccccagacagccactacctgctgtttggagcccctggcacctacaactggaagggcctgctgtttgtgaccaacatcgacagcagtgaccctgaccagctggtgtacaagaccctggaccctgctgaccggctgcccggccctgctggggacctggccctgaacagctacctgggcttcagcattgattctgggaagggcctggtgcgggcagaggagctgagctttgtggccggggccccccgggccaaccacaagggagctgtggtgatcctgaggaaggacagcgccagccggctggtgcctgaggtgatgctgagcggggagcggctgaccagcggcttcggctacagcctggccgtggccgacctgaacagtgatggctggccagacctgattgtgggcgccccctacttctttgagcggcaggaggagctgggcggcgctgtgtatgtgtacctgaaccagggcggccactgggccggcatcagccccctgcggctgtgtggcagcccagacagcatgtttggcatcagcctggccgtgctgggggacctgaaccaggacggcttcccagacattgctgtgggcgccccctttgatggagatggcaaggtgttcatctaccacggcagcagcctgggcgtggtggccaagcccagccaggtgctggagggggaggccgtgggcatcaagagctttggctacagcctgagcggcagcctggacatggatggcaaccagtacccagacctgctggtgggcagcctggccgacacagctgtgctcttccgggcccggcccatcctgcacgtgtcccatgaggtgtccatcgcccccaggagcattgacctggagcagcccaactgtgccggcggccacagcgtgtgtgtggacctgcgggtgtgcttctcctacatcgctgtgcccagcagctacagccccaccgtggccctggactatgtgctggatgctgacacagaccggcggctgcggggccaggtgccccgggtgaccttcctgagcaggaacctggaggagcccaagcaccaggccagcggcaccgtgtggctgaagcaccagcacgacagagtgtgtggagatgccatgttccagctgcaggagaatgtgaaggacaagctgcgggccatcgtggtgaccctgagctacagcctgcagaccccccggctgcggcggcaggcccctggccagggcctgccccctgtggcccccatcctgaatgcccaccagcccagcacccagagagctgagatccacttcctgaagcagggctgtggggaggacaagatctgccagagcaacctgcagctggtgcgggcccgcttctgcaccagggtgtctgacacagagttccagcccctgcccatggatgtggatggcaccacagccctgtttgccctgagcggccagcctgtgattggcctggagctgatggtgaccaacctgcccagcgaccctgcccagccccaggctgatggagatgatgcccacgaggcccagctgctggtgatgctgcctgacagcctgcactacagcggcgtgcgggccctggaccctgctgagaagcccctgtgcctgagcaatgaaaatgccagccacgtggagtgtgagctgggcaaccccatgaagagaggagcccaggtgaccttctacctgatcctgagcaccagcggcatcagcattgagaccacagagctggaggtggagctgctgctggccaccatcagcgagcaggagctgcaccctgtgtctgcccgggcccgggtcttcatcgagctgcccctgagcattgctggcatggccatcccccagcagctgttcttctctggagtggtgcggggggagcgggccatgcagagcgagagagatgtgggcagcaaggtgaagtatgaggtgacagtgagcaaccagggccagagcctgcggaccctgggcagcgccttcctgaacatcatgtggccccatgaaattgccaacgggaagtggctgctgtaccccatgcaggtggagctggagggcggccagggccctggccagaagggcctgtgcagcccccggcccaacatcctgcacctggatgtggacagccgggacagaagaagaagagagctggagcccccagagcagcaggagcccggggagcggcaggagcccagcatgtcctggtggcctgtgtcctctgctgagaagaagaagaacatcaccctggactgtgcccggggcacagccaactgtgtggtgttcagctgccccctgtacagctttgacagagctgctgtgctgcacgtgtggggccgcctgtggaacagcaccttcctggaggagtacagcgctgtgaagagcctggaggtgattgtgcgggccaacatcaccgtgaagagcagcatcaagaacctgatgctgagagatgccagcaccgtcatccctgtgatggtgtacctggaccccatggctgtggtggccgagggcgtgccctggtgggtgatcctgctggccgtgctggccggcctgctggtgctggccctgctggtgctgctgctgtggaagtgtggcttcttccacaggagcagccagagcagcagcttccccaccaactaccaccgggcctgcctggccgtgcagcccagcgccatggaggtgggcggccctggcaccgtgggctgggacagcagcaatggccgcagcacccccaggcctccctgccccagcaccatgaggtag

SEQ ID NO: 20077 - DNA, 3369 bp, Artificial Sequence
  Description of Artificial Sequence: Synthetic coding sequence
atggccggggcccggagccgggacccctggggcgccagcggcatctgctacctgtttggcagcctgctggtggagctgctcttcagcagagctgtggccttcaacctggatgtgatgggcgccctgaggaaggagggggagcccggcagcctgtttggcttctctgtggccctgcaccggcagctgcagccccggccccagagctggctgctggtgggcgccccccaggccctggccctgcccggccagcaggccaacagaactggaggcctgtttgcctgccccctgagcctggaggagacagactgctacagagtggacatcgaccagggcgctgacatgcagaaggagagcaaggagaaccagtggctgggcgtgtctgtgcgcagccagggccctgggggcaagatcgtgacctgtgcccacagatatgaggcccggcagagggtggaccagatcctggagacccgggacatgattggccgctgctttgtgctgagccaggacctggccatcagagatgagctggatggaggagagtggaagttctgtgagggccggccccagggccacgagcagtttggcttctgccagcagggcacagctgctgccttctccccagacagccactacctgctgtttggagcccctggcacctacaactggaagggcacagcccgggtggagctgtgtgcccagggcagcgctgacctggcccacctggatgatggcccctatgaggccggcggggagaaggagcaggaccccaggctcatccctgtgcctgccaacagctacttcggcttcagcattgattctgggaagggcctggtgcgggcagaggagctgagctttgtggccggggccccccgggccaaccacaagggagctgtggtgatcctgaggaaggacagcgccagccggctggtgcctgaggtgatgctgagcggggagcggctgaccagcggcttcggctacagcctggccgtggccgacctgaacagtgatggctggccagacctgattgtgggcgccccctacttctttgagcggcaggaggagctgggcggcgctgtgtatgtgtacctgaaccagggcggccactgggccggcatcagccccctgcggctgtgtggcagcccagacagcatgtttggcatcagcctggccgtgctgggggacctgaaccaggacggcttcccagacattgctgtgggcgccccctttgatggagatggcaaggtgttcatctaccacggcagcagcctgggcgtggtggccaagcccagccaggtgctggagggggaggccgtgggcatcaagagctttggctacagcctgagcggcagcctggacatggatggcaaccagtacccagacctgctggtgggcagcctggccgacacagctgtgctcttccgggcccggcccatcctgcacgtgtcccatgaggtgtccatcgcccccaggagcattgacctggagcagcccaactgtgccggcggccacagcgtgtgtgtggacctgcgggtgtgcttctcctacatcgctgtgcccagcagctacagccccaccgtggccctggactatgtgctggatgctgacacagaccggcggctgcggggccaggtgccccgggtgaccttcctgagcaggaacctggaggagcccaagcaccaggccagcggcaccgtgtggctgaagcaccagcacgacagagtgtgtggagatgccatgttccagctgcaggagaatgtgaaggacaagctgcgggccatcgtggtgaccctgagctacagcctgcagaccccccggctgcggcggcaggcccctggccagggcctgccccctgtggcccccatcctgaatgcccaccagcccagcacccagagagctgagatccacttcctgaagcagggctgtggggaggacaagatctgccagagcaacctgcagctggtgcgggcccgcttctgcaccagggtgtctgacacagagttccagcccctgcccatggatgtggatggcaccacagccctgtttgccctgagcggccagcctgtgattggcctggagctgatggtgaccaacctgcccagcgaccctgcccagccccaggctgatggagatgatgcccacgaggcccagctgctggtgatgctgcctgacagcctgcactacagcggcgtgcgggccctggaccctgctgagaagcccctgtgcctgagcaatgaaaatgccagccacgtggagtgtgagctgggcaaccccatgaagagaggagcccaggtgaccttctacctgatcctgagcaccagcggcatcagcattgagaccacagagctggaggtggagctgctgctggccaccatcagcgagcaggagctgcaccctgtgtctgcccgggcccgggtcttcatcgagctgcccctgagcattgctggcatggccatcccccagcagctgttcttctctggagtggtgcggggggagcgggccatgcagagcgagagagatgtgggcagcaaggtgaagtatgaggtgacagtgagcaaccagggccagagcctgcggaccctgggcagcgccttcctgaacatcatgtggccccatgaaattgccaacgggaagtggctgctgtaccccatgcaggtggagctggagggcggccagggccctggccagaagggcctgtgcagcccccggcccaacatcctgcacctggatgtggacagccgggacagaagaagaagagagctggagcccccagagcagcaggagcccggggagcggcaggagcccagcatgtcctggtggcctgtgtcctctgctgagaagaagaagaacatcaccctggactgtgcccggggcacagccaactgtgtggtgttcagctgccccctgtacagctttgacagagctgctgtgctgcacgtgtggggccgcctgtggaacagcaccttcctggaggagtacagcgctgtgaagagcctggaggtgattgtgcgggccaacatcaccgtgaagagcagcatcaagaacctgatgctgagagatgccagcaccgtcatccctgtgatggtgtacctggaccccatggctgtggtggccgagggcgtgccctggtgggtgatcctgctggccgtgctggccggcctgctggtgctggccctgctggtgctgctgctgtggaagtgtggcttcttccacaggagcagccagagcagcagcttccccaccaactaccaccgggcctgcctggccgtgcagcccagcgccatggaggtgggcggccctggcaccgtgggctgggacagcagcaatggccgcagcacccccaggcctccctgccccagcaccatgaggtag

SEQ ID NO: 20078 - DNA, 3135 bp, Artificial Sequence
  Description of Artificial Sequence: Synthetic coding sequence
atggccccctttgccacccccatggtgcaggccctgaccaccacccgcatccagaggcaggccgagggcttccagtgctggagagaatgtggcaccaggaggagcccctttgagggcaaggagacctgtgcccacagatatgaggcccggcagagggtggaccagatcctggagacccgggacatgattggccgctgctttgtgctgagccaggacctggccatcagagatgagctggatggaggagagtggaagttctgtgagggccggccccagggccacgagcagtttggcttctgccagcagggcacagctgctgccttctccccagacagccactacctgctgtttggagcccctggcacctacaactggaagggcacagcccgggtggagctgtgtgcccagggcagcgctgacctggcccacctggatgatggcccctatgaagctggaggagagaaggagcaggaccccaggctcatccctgtgcctgccaacagctacttcggcttcagcattgacagcggcaagggcctggtgcgggcagaggagctgagctttgtggccggggccccccgggccaaccacaagggagctgtggtgatcctgaggaaggacagcgccagccggctggtgcctgaggtgatgctgtctggagagcggctgaccagcggcttcggctacagcctggccgtggccgacctgaacagtgatggctggccagacctgattgtgggcgccccctacttctttgagcggcaggaggagctgggcggcgctgtgtatgtgtacctgaaccagggcggccactgggccggcatcagccccctgcggctgtgtggcagcccagacagcatgtttggcatcagcctggccgtgctgggggacctgaaccaggacggcttcccagacattgctgtgggcgccccctttgatggagatggcaaggtgttcatctaccacggcagcagcctgggcgtggtggccaagcccagccaggtgctggagggggaggccgtgggcatcaagagctttggctacagcctgagcggcagcctggacatggatggcaaccagtacccagacctgctggtgggcagcctggccgacacagctgtgctcttccgggcccggcccatcctgcacgtgtcccatgaggtgtccatcgcccccaggagcattgacctggagcagcccaactgtgccggcggccacagcgtgtgtgtggacctgcgggtgtgcttctcctacatcgctgtgcccagcagctacagccccaccgtggccctggactatgtgctggatgctgacacagaccggcggctgcggggccaggtgccccgggtgaccttcctgagcaggaacctggaggagcccaagcaccaggccagcggcaccgtgtggctgaagcaccagcacgacagagtgtgtggagatgccatgttccagctgcaggagaatgtgaaggacaagctgcgggccatcgtggtgaccctgagctacagcctgcagaccccccggctgcggcggcaggcccctggccagggcctgccccctgtggcccccatcctgaatgcccaccagcccagcacccagagagctgagatccacttcctgaagcagggctgtggggaggacaagatctgccagagcaacctgcagctggtgcgggcccgcttctgcaccagggtgtctgacacagagttccagcccctgcccatggatgtggatggcaccacagccctgtttgccctgagcggccagcccgtcatcggcctggagctgatggtgaccaacctgcccagcgaccctgcccagccccaggctgatggagatgatgcccacgaggcccagctgctggtgatgctgcctgacagcctgcactacagcggcgtgcgggccctggaccctgctgagaagcccctgtgcctgagcaatgaaaatgccagccacgtggagtgtgagctgggcaaccccatgaagagaggagcccaggtgaccttctacctgatcctgagcaccagcggcatcagcattgagaccacagagctggaggtggagctgctgctggccaccatcagcgagcaggagctgcaccctgtgtctgcccgggcccgggtcttcatcgagctgcccctgagcattgctggcatggccatcccccagcagctgttcttcagcggcgtggtgcggggggagcgggccatgcagagcgagagagatgtgggcagcaaggtgaagtatgaggtgacagtgagcaaccagggccagagcctgcggaccctgggcagcgccttcctgaacatcatgtggccccatgagatcgccaacgggaagtggctgctgtaccccatgcaggtggagctggagggcggccagggccctggccagaagggcctgtgcagcccccggcccaacatcctgcacctggatgtggacagccgggacagaagaagaagagagctggagcccccagagcagcaggagcctggagagcggcaggagcccagcatgtcctggtggcctgtgagcagcgctgagaagaagaagaacatcaccctggactgtgcccggggcacagccaactgtgtggtgttcagctgccccctgtacagctttgacagagctgctgtgctgcacgtgtggggccgcctgtggaacagcaccttcctggaggagtacagcgctgtgaagagcctggaggtgattgtgcgggccaacatcaccgtgaagagcagcatcaagaacctgatgctgagagatgccagcaccgtcatccctgtgatggtgtacctggaccccatggctgtggtggccgagggcgtgccctggtgggtgatcctgctggccgtgctggccggcctgctggtgctggccctgctggtgctgctgctgtggaagatgggcttcttcaagagggccaagcaccctgaggccaccgtgccccagtaccacgctgtgaagatccccagagaagatcggcagcagttcaaggaggagaagacaggcaccatcctgaggaacaactggggcagcccccggcgggagggcccagatgcccaccccatcctggccgcagatggccaccctgagctgggcccagatggccaccctggccctggaacagcctag

SEQ ID NO: 20079 - DNA, 3426 bp, Artificial Sequence
  Description of Artificial Sequence: Synthetic coding sequence
atggccggggcccggagccgggacccctggggcgccagcggcatctgctacctgtttggcagcctgctggtggagctgctcttcagcagagctgtggccttcaacctggatgtgatgggcgccctgaggaaggagggggagcccggcagcctgtttggcttctctgtggccctgcaccggcagctgcagccccggccccagagctggctgctggtgggcgccccccaggccctggccctgcccggccagcaggccaacagaactggaggcctgtttgcctgccccctgagcctggaggagacagactgctacagagtggacatcgaccagggcgctgacatgcagaaggagagcaaggagaaccagtggctgggcgtgtctgtgcgcagccagggccctgggggcaagatcgtgacctgtgcccacagatatgaggcccggcagagggtggaccagatcctggagacccgggacatgattggccgctgctttgtgctgagccaggacctggccatcagagatgagctggatggaggagagtggaagttctgtgagggccggccccagggccacgagcagtttggcttctgccagcagggcacagctgctgccttctccccagacagccactacctgctgtttggagcccctggcacctacaactggaagggcacagcccgggtggagctgtgtgcccagggcagcgctgacctggcccacctggatgatggcccctatgaggccggcggggagaaggagcaggaccccaggctcatccctgtgcctgccaacagctacttcggcttcagcattgattctgggaagggcctggtgcgggcagaggagctgagctttgtggccggggccccccgggccaaccacaagggagctgtggtgatcctgaggaaggacagcgccagccggctggtgcctgaggtgatgctgagcggggagcggctgaccagcggcttcggctacagcctggccgtggccgacctgaacagtgatggctggccagacctgattgtgggcgccccctacttctttgagcggcaggaggagctgggcggcgctgtgtatgtgtacctgaaccagggcggccactgggccggcatcagccccctgcggctgtgtggcagcccagacagcatgtttggcatcagcctggccgtgctgggggacctgaaccaggacggcttcccagacattgctgtgggcgccccctttgatggagatggcaaggtgttcatctaccacggcagcagcctgggcgtggtggccaagcccagccaggtgctggagggggaggccgtgggcatcaagagctttggctacagcctgagcggcagcctggacatggatggcaaccagtacccagacctgctggtgggcagcctggccgacacagctgtgctcttccgggcccggcccatcctgcacgtgtcccatgaggtgtccatcgcccccaggagcattgacctggagcagcccaactgtgccggcggccacagcgtgtgtgtggacctgcgggtgtgcttctcctacatcgctgtgcccagcagctacagccccaccgtggccctggactatgtgctggatgctgacacagaccggcggctgcggggccaggtgccccgggtgaccttcctgagcaggaacctggaggagcccaagcaccaggccagcggcaccgtgtggctgaagcaccagcacgacagagtgtgtggagatgccatgttccagctgcaggagaatgtgaaggacaagctgcgggccatcgtggtgaccctgagctacagcctgcagaccccccggctgcggcggcaggcccctggccagggcctgccccctgtggcccccatcctgaatgcccaccagcccagcacccagagagctgagatccacttcctgaagcagggctgtggggaggacaagatctgccagagcaacctgcagctggtgcgggcccgcttctgcaccagggtgtctgacacagagttccagcccctgcccatggatgtggatggcaccacagccctgtttgccctgagcggccagcctgtgattggcctggagctgatggtgaccaacctgcccagcgaccctgcccagccccaggctgatggagatgatgcccacgaggcccagctgctggtgatgctgcctgacagcctgcactacagcggcgtgcgggccctggaccctgctgagaagcccctgtgcctgagcaatgaaaatgccagccacgtggagtgtgagctgggcaaccccatgaagagaggagcccaggtgaccttctacctgatcctgagcaccagcggcatcagcattgagaccacagagctggaggtggagctgctgctggccaccatcagcgagcaggagctgcaccctgtgtctgcccgggcccgggtcttcatcgagctgcccctgagcattgctggcatggccatcccccagcagctgttcttctctggagtggtgcggggggagcgggccatgcagagcgagagagatgtgggcagcaaggtgaagtatgaggtgacagtgagcaaccagggccagagcctgcggaccctgggcagcgccttcctgaacatcatgtggccccatgaaattgccaacgggaagtggctgctgtaccccatgcaggtggagctggagggcggccagggccctggccagaagggcctgtgcagcccccggcccaacatcctgcacctggatgtggacagccgggacagaagaagaagagagctggagcccccagagcagcaggagcccggggagcggcaggagcccagcatgtcctggtggcctgtgtcctctgctgagaagaagaagaacatcaccctggactgtgcccggggcacagccaactgtgtggtgttcagctgccccctgtacagctttgacagagctgctgtgctgcacgtgtggggccgcctgtggaacagcaccttcctggaggagtacagcgctgtgaagagcctggaggtgattgtgcgggccaacatcaccgtgaagagcagcatcaagaacctgatgctgagagatgccagcaccgtcatccctgtgatggtgtacctggaccccatggctgtggtggccgagggcgtgccctggtgggtgatcctgctggccgtgctggccggcctgctggtgctggccctgctggtgctgctgctgtggaagatgggcttcttcaagagggccaagcaccctgaggccaccgtgccccagtaccacgctgtgaagatcccccgggaggaccggcagcagttcaaggaggagaagacaggcaccatcctgaggaacaactggggcagcccccggcgggagggcccagatgcccaccccatcctggccgcagatggccaccctgagctgggcccagatggccaccctggccctggaacagcctag

SEQ ID NO: 20080 - DNA, 3546 bp, Artificial Sequence
  Description of Artificial Sequence: Synthetic coding sequence
atggccggggcccggagccgggacccctggggcgccagcggcatctgctacctgtttggcagcctgctggtggagctgctcttcagcagagctgtggccttcaacctggatgtgatgggcgccctgaggaaggagggggagcccggcagcctgtttggcttctctgtggccctgcaccggcagctgcagccccggccccagagctggctgctggtgggcgccccccaggccctggccctgcccggccagcaggccaacagaactggaggcctgtttgcctgccccctgagcctggaggagacagactgctacagagtggacatcgaccagggcgctgacatgcagaaggagagcaaggagaaccagtggctgggcgtgtctgtgcgcagccagggccctgggggcaagatcgtgacctgtgcccacagatatgaggcccggcagagggtggaccagatcctggagacccgggacatgattggccgctgctttgtgctgagccaggacctggccatcagagatgagctggatggaggagagtggaagttctgtgagggccggccccagggccacgagcagtttggcttctgccagcagggcacagctgctgccttctccccagacagccactacctgctgtttggagcccctggcacctacaactggaagggcacagcccgggtggagctgtgtgcccagggcagcgctgacctggcccacctggatgatggcccctatgaggccggcggggagaaggagcaggaccccaggctcatccctgtgcctgccaacagctacttcggcctgctgtttgtgaccaacatcgacagcagtgaccctgaccagctggtgtacaagaccctggaccctgctgaccggctgcccggccctgctggggacctggccctgaacagctacctgggcttcagcattgattctgggaagggcctggtgcgggcagaggagctgagctttgtggccggggccccccgggccaaccacaagggagctgtggtgatcctgaggaaggacagcgccagccggctggtgcctgaggtgatgctgagcggggagcggctgaccagcggcttcggctacagcctggccgtggccgacctgaacagtgatggctggccagacctgattgtgggcgccccctacttctttgagcggcaggaggagctgggcggcgctgtgtatgtgtacctgaaccagggcggccactgggccggcatcagccccctgcggctgtgtggcagcccagacagcatgtttggcatcagcctggccgtgctgggggacctgaaccaggacggcttcccagacattgctgtgggcgccccctttgatggagatggcaaggtgttcatctaccacggcagcagcctgggcgtggtggccaagcccagccaggtgctggagggggaggccgtgggcatcaagagctttggctacagcctgagcggcagcctggacatggatggcaaccagtacccagacctgctggtgggcagcctggccgacacagctgtgctcttccgggcccggcccatcctgcacgtgtcccatgaggtgtccatcgcccccaggagcattgacctggagcagcccaactgtgccggcggccacagcgtgtgtgtggacctgcgggtgtgcttctcctacatcgctgtgcccagcagctacagccccaccgtggccctggactatgtgctggatgctgacacagaccggcggctgcggggccaggtgccccgggtgaccttcctgagcaggaacctggaggagcccaagcaccaggccagcggcaccgtgtggctgaagcaccagcacgacagagtgtgtggagatgccatgttccagctgcaggagaatgtgaaggacaagctgcgggccatcgtggtgaccctgagctacagcctgcagaccccccggctgcggcggcaggcccctggccagggcctgccccctgtggcccccatcctgaatgcccaccagcccagcacccagagagctgagatccacttcctgaagcagggctgtggggaggacaagatctgccagagcaacctgcagctggtgcgggcccgcttctgcaccagggtgtctgacacagagttccagcccctgcccatggatgtggatggcaccacagccctgtttgccctgagcggccagcctgtgattggcctggagctgatggtgaccaacctgcccagcgaccctgcccagccccaggctgatggagatgatgcccacgaggcccagctgctggtgatgctgcctgacagcctgcactacagcggcgtgcgggccctggaccctgctgagaagcccctgtgcctgagcaatgaaaatgccagccacgtggagtgtgagctgggcaaccccatgaagagaggagcccaggtgaccttctacctgatcctgagcaccagcggcatcagcattgagaccacagagctggaggtggagctgctgctggccaccatcagcgagcaggagctgcaccctgtgtctgcccgggcccgggtcttcatcgagctgcccctgagcattgctggcatggccatcccccagcagctgttcttctctggagtggtgcggggggagcgggccatgcagagcgagagagatgtgggcagcaaggtgaagtatgaggtgacagtgagcaaccagggccagagcctgcggaccctgggcagcgccttcctgaacatcatgtggccccatgaaattgccaacgggaagtggctgctgtaccccatgcaggtggagctggagggcggccagggccctggccagaagggcctgtgcagcccccggcccaacatcctgcacctggatgtggacagccgggacagaagaagaagagagctggagcccccagagcagcaggagcccggggagcggcaggagcccagcatgtcctggtggcctgtgtcctctgctgagaagaagaagaacatcaccctggactgtgcccggggcacagccaactgtgtggtgttcagctgccccctgtacagctttgacagagctgctgtgctgcacgtgtggggccgcctgtggaacagcaccttcctggaggagtacagcgctgtgaagagcctggaggtgattgtgcgggccaacatcaccgtgaagagcagcatcaagaacctgatgctgagagatgccagcaccgtcatccctgtgatggtgtacctggaccccatggctgtggtggccgagggcgtgccctggtgggtgatcctgctggccgtgctggccggcctgctggtgctggccctgctggtgctgctgctgtggaagatgggcttcttcaagagggccaagcaccctgaggccaccgtgccccagtaccacgctgtgaagatcccccgggaggaccggcagcagttcaaggaggagaagacaggcaccatcctgaggaacaactggggcagcccccggcgggagggcccagatgcccaccccatcctggccgcagatggccaccctgagctgggcccagatggccaccctggccctggaacagcctag

SEQ ID NO: 20081 - DNA, 3147 bp, Artificial Sequence
  Description of Artificial Sequence: Synthetic coding sequence
atggccttccccccccggcggcggctgcggctgggcccccggggcctgcccctgctgctgagcggcctgctgctgcccctgtgccgggccttcaacctggatgtggacagccctgctgagtacagcggccctgagggcagctactttggatttgctgtggacttctttgtgcccagcgccagcagcaggatgttcctgctggtgggcgcccccaaggccaacaccacccagcccggcatcgtggagggcggccaggtgctgaagtgtgactggagcagcacccggcgctgccagcccatcgagtttgatgccactggaaacagagattatgccaaggatgaccccctggagttcaagagccaccagtggtttggagcctctgtgcgcagcaagcaggacaagatcctggcctgtgcccccctgtaccactggaggacagagatgaagcaggagcgggagcctgtgggcacctgcttcctgcaggacggcaccaagacagtggagtatgccccctgccgcagccaggacattgatgctgatggccagggcttctgccagggcggcttcagcattgacttcaccaaggctgacagagtgctgctgggcggccctggcagcttctactggcagggccagctgatcagtgaccaggtggccgagatcgtgtccaaatatgaccccaacgtgtacagcatcaagtacaacaaccagctggccaccaggacagcccaggccatctttgatgacagctacctgggctacagcgtggccgtgggggacttcaatggagatggcattgatgactttgtgtctggagtgccccgggccgcccggaccctgggcatggtgtacatctatgatggcaagaacatgagcagcctgtacaacttcaccggggagcagatggccgcctacttcggcttctctgtggccgccacagacatcaatggagatgattatgcagatgtgttcatcggggcccccctcttcatggaccggggcagtgatggcaagctgcaggaggtgggccaggtgtctgtgtccctgcagagggccagcggggacttccagaccaccaagctgaatggatttgaggtgtttgcccgcttcggcagcgccatcgcccccctgggggacctggaccaggacggcttcaatgacatcgccatcgccgccccctatggaggagaggacaagaagggcatcgtgtacatcttcaacggccgcagcacaggcctgaatgctgtgcccagccagatcctggagggccagtgggccgcccgctccatgcctccttcctttggctacagcatgaagggggccacagacatcgacaagaatggctacccagacctgattgtgggcgcctttggagtggaccgggccatcctgtaccgggcccggcctgtgatcaccgtgaatgccggcctggaggtgtaccccagcatcctgaaccaggacaacaagacctgcagcctgcccggcacagccctgaaggtgtcctgcttcaacgtgcgcttctgcctgaaggcagatggcaagggcgtgctgcccaggaagctgaacttccaggtggagctgctgctggacaagctgaagcagaagggggccatcagaagagccctcttcctgtacagccgcagccccagccacagcaagaacatgaccatcagccggggcggcctgatgcagtgtgaggagctgattgcctacctgagagatgagagcgagttccgggacaagctgacccccatcaccatcttcatggagtaccgcctggactacagaacagctgctgacaccaccggcctgcagcccatcctgaaccagttcaccccagccaacatcagccggcaggcccacatcctgctggactgtggggaggacaacgtgtgcaagcccaagctggaggtgtctgtggacagcgaccagaagaagatctacatcggagatgacaaccccctgaccctcatcgtgaaggcccagaaccagggcgagggcgcctatgaagctgagctgattgtgtccatccccctgcaggccgacttcatcggcgtggtgaggaacaatgaggccctggcccggctgagctgtgccttcaagacagagaaccagacccggcaggtggtgtgtgacctgggcaaccccatgaaggccggcacccagctgctggccggcctgcgcttctctgtgcaccagcagagcgagatggacacctctgtgaagtttgacctgcagatccagagcagcaacctgtttgacaaggtgtcccctgtggtgagccacaaggtggacctggccgtgctggccgctgtggagatccggggcgtgagcagcccagaccacgtgttcctgcccatccccaactgggagcacaaggagaaccctgagacagaggaggatgtgggccctgtggtgcagcacatctatgagctgagaaataatggccccagcagcttcagcaaggccatgctgcacctgcagtggccctacaagtacaacaacaacaccctgctgtacatcctgcactatgacattgatggccccatgaactgcaccagtgacatggagatcaaccccctgcgcatcaagatcagcagcctgcagaccacagagaagaatgacacagtggccggccagggcgagcgggaccacctgatcaccaagagggacctggccctgtctgagggggacatccacaccctgggctgcggcgtggcccagtgcctgaagatcgtgtgccaggtgggccgcctggaccggggcaagagcgccatcctgtatgtgaagagcctgctgtggacagagaccttcatgaacaaggagaaccagaaccacagctacagcctgaagagcagcgccagcttcaacgtgattgagttcccctacaagaacctgcccatcgaggacatcaccaacagcaccctggtgaccaccaacgtgacctggggcatccagcctgcccccatgcctgtgcctgtgtgggtgatcatcctggccgtgctggccggcctgctgctgctggccgtgctggtgtttgtgatgtacaggatgggcttcttcaagagggtgcggcccccccaggaggagcaggagcgggagcagctgcagccccatgaaaatggagagggcaacagcgagacctag

SEQ ID NO: 20082 - DNA, 3039 bp, Artificial Sequence
  Description of Artificial Sequence: Synthetic coding sequence
atggccttccccccccggcggcggctgcggctgggcccccggggcctgcccctgctgctgagcggcctgctgctgcccctgtgccgggccttcaacctggatgtggacagccctgctgagtacagcggccctgagggcagctactttggatttgctgtggacttctttgtgcccagcgccagcagcaggatgttcctgctggtgggcgcccccaaggccaacaccacccagcccggcatcgtggagggcggccaggtgctgaagtgtgactggagcagcacccggcgctgccagcccatcgagtttgatgccactggaaacagagattatgccaaggatgaccccctggagttcaagagccaccagtggtttggagcctctgtgcgcagcaagcaggacaagatcctggcctgtgcccccctgtaccactggaggacagagatgaagcaggagcgggagcctgtgggcacctgcttcctgcaggacggcaccaagacagtggagtatgccccctgccgcagccggcagctgatcagtgaccaggtggccgagatcgtgtccaaatatgaccccaacgtgtacagcatcaagtacaacaaccagctggccaccaggacagcccaggccatctttgatgacagctacctgggctacagcgtggccgtgggggacttcaatggagatggcattgatgactttgtgtctggagtgccccgggccgcccggaccctgggcatggtgtacatctatgatggcaagaacatgagcagcctgtacaacttcaccggggagcagatggccgcctacttcggcttctctgtggccgccacagacatcaatggagatgattatgcagatgtgttcatcggggcccccctcttcatggaccggggcagtgatggcaagctgcaggaggtgggccaggtgtctgtgtccctgcagagggccagcggggacttccagaccaccaagctgaatggatttgaggtgtttgcccgcttcggcagcgccatcgcccccctgggggacctggaccaggacggcttcaatgacatcgccatcgccgccccctatggaggagaggacaagaagggcatcgtgtacatcttcaacggccgcagcacaggcctgaatgctgtgcccagccagatcctggagggccagtgggccgcccgctccatgcctccttcctttggctacagcatgaagggggccacagacatcgacaagaatggctacccagacctgattgtgggcgcctttggagtggaccgggccatcctgtaccgggcccggcctgtgatcaccgtgaatgccggcctggaggtgtaccccagcatcctgaaccaggacaacaagacctgcagcctgcccggcacagccctgaaggtgtcctgcttcaacgtgcgcttctgcctgaaggcagatggcaagggcgtgctgcccaggaagctgaacttccaggtggagctgctgctggacaagctgaagcagaagggggccatcagaagagccctcttcctgtacagccgcagccccagccacagcaagaacatgaccatcagccggggcggcctgatgcagtgtgaggagctgattgcctacctgagagatgagagcgagttccgggacaagctgacccccatcaccatcttcatggagtaccgcctggactacagaacagctgctgacaccaccggcctgcagcccatcctgaaccagttcaccccagccaacatcagccggcaggcccacatcctgctggactgtggggaggacaacgtgtgcaagcccaagctggaggtgtctgtggacagcgaccagaagaagatctacatcggagatgacaaccccctgaccctcatcgtgaaggcccagaaccagggcgagggcgcctatgaagctgagctgattgtgtccatccccctgcaggccgacttcatcggcgtggtgaggaacaatgaggccctggcccggctgagctgtgccttcaagacagagaaccagacccggcaggtggtgtgtgacctgggcaaccccatgaaggccggcacccagctgctggccggcctgcgcttctctgtgcaccagcagagcgagatggacacctctgtgaagtttgacctgcagatccagagcagcaacctgtttgacaaggtgtcccctgtggtgagccacaaggtggacctggccgtgctggccgctgtggagatccggggcgtgagcagcccagaccacgtgttcctgcccatccccaactgggagcacaaggagaaccctgagacagaggaggatgtgggccctgtggtgcagcacatctatgagctgagaaataatggccccagcagcttcagcaaggccatgctgcacctgcagtggccctacaagtacaacaacaacaccctgctgtacatcctgcactatgacattgatggccccatgaactgcaccagtgacatggagatcaaccccctgcgcatcaagatcagcagcctgcagaccacagagaagaatgacacagtggccggccagggcgagcgggaccacctgatcaccaagagggacctggccctgtctgagggggacatccacaccctgggctgcggcgtggcccagtgcctgaagatcgtgtgccaggtgggccgcctggaccggggcaagagcgccatcctgtatgtgaagagcctgctgtggacagagaccttcatgaacaaggagaaccagaaccacagctacagcctgaagagcagcgccagcttcaacgtgattgagttcccctacaagaacctgcccatcgaggacatcaccaacagcaccctggtgaccaccaacgtgacctggggcatccagcctgcccccatgcctgtgcctgtgtgggtgatcatcctggccgtgctggccggcctgctgctgctggccgtgctggtgtttgtgatgtacaggatgggcttcttcaagagggtgcggcccccccaggaggagcaggagcgggagcagctgcagccccatgaaaatggagagggcaacagcgagacctag

SEQ ID NO: 20083 - DNA, 3009 bp, Artificial Sequence
  Description of Artificial Sequence: Synthetic coding sequence
atgctgctgggcaccctgctgctgatcctgtacatcctgatgctgtgcaggatgttcctgctggtgggcgcccccaaggccaacaccacccagcccggcatcgtggagggcggccaggtgctgaagtgtgactggagcagcacccggcgctgccagcccatcgagtttgatgccactggaaacagagattatgccaaggatgaccccctggagttcaagagccaccagtggtttggagcctctgtgcgcagcaagcaggacaagatcctggcctgtgcccccctgtaccactggaggacagagatgaagcaggagcgggagcctgtgggcacctgcttcctgcaggacggcaccaagacagtggagtatgccccctgccgcagccaggacattgatgctgatggccagggcttctgccagggcggcttcagcattgacttcaccaaggctgacagagtgctgctgggcggccctggcagcttctactggcagggccagctgatcagtgaccaggtggccgagatcgtgtccaaatatgaccccaacgtgtacagcatcaagtacaacaaccagctggccaccaggacagcccaggccatctttgatgacagctacctgggctacagcgtggccgtgggggacttcaatggagatggcattgatgactttgtgtctggagtgccccgggccgcccggaccctgggcatggtgtacatctatgatggcaagaacatgagcagcctgtacaacttcaccggggagcagatggccgcctacttcggcttctctgtggccgccacagacatcaatggagatgattatgcagatgtgttcatcggggcccccctcttcatggaccggggcagtgatggcaagctgcaggaggtgggccaggtgtctgtgtccctgcagagggccagcggggacttccagaccaccaagctgaatggatttgaggtgtttgcccgcttcggcagcgccatcgcccccctgggggacctggaccaggacggcttcaatgacatcgccatcgccgccccctatggaggagaggacaagaagggcatcgtgtacatcttcaacggccgcagcacaggcctgaatgctgtgcccagccagatcctggagggccagtgggccgcccgctccatgcctccttcctttggctacagcatgaagggggccacagacatcgacaagaatggctacccagacctgattgtgggcgcctttggagtggaccgggccatcctgtaccgggcccggcctgtgatcaccgtgaatgccggcctggaggtgtaccccagcatcctgaaccaggacaacaagacctgcagcctgcccggcacagccctgaaggtgtcctgcttcaacgtgcgcttctgcctgaaggcagatggcaagggcgtgctgcccaggaagctgaacttccaggtggagctgctgctggacaagctgaagcagaagggggccatcagaagagccctcttcctgtacagccgcagccccagccacagcaagaacatgaccatcagccggggcggcctgatgcagtgtgaggagctgattgcctacctgagagatgagagcgagttccgggacaagctgacccccatcaccatcttcatggagtaccgcctggactacagaacagctgctgacaccaccggcctgcagcccatcctgaaccagttcaccccagccaacatcagccggcaggcccacatcctgctggactgtggggaggacaacgtgtgcaagcccaagctggaggtgtctgtggacagcgaccagaagaagatctacatcggagatgacaaccccctgaccctcatcgtgaaggcccagaaccagggcgagggcgcctatgaagctgagctgattgtgtccatccccctgcaggccgacttcatcggcgtggtgaggaacaatgaggccctggcccggctgagctgtgccttcaagacagagaaccagacccggcaggtggtgtgtgacctgggcaaccccatgaaggccggcacccagctgctggccggcctgcgcttctctgtgcaccagcagagcgagatggacacctctgtgaagtttgacctgcagatccagagcagcaacctgtttgacaaggtgtcccctgtggtgagccacaaggtggacctggccgtgctggccgctgtggagatccggggcgtgagcagcccagaccacgtgttcctgcccatccccaactgggagcacaaggagaaccctgagacagaggaggatgtgggccctgtggtgcagcacatctatgagctgagaaataatggccccagcagcttcagcaaggccatgctgcacctgcagtggccctacaagtacaacaacaacaccctgctgtacatcctgcactatgacattgatggccccatgaactgcaccagtgacatggagatcaaccccctgcgcatcaagatcagcagcctgcagaccacagagaagaatgacacagtggccggccagggcgagcgggaccacctgatcaccaagagggacctggccctgtctgagggggacatccacaccctgggctgcggcgtggcccagtgcctgaagatcgtgtgccaggtgggccgcctggaccggggcaagagcgccatcctgtatgtgaagagcctgctgtggacagagaccttcatgaacaaggagaaccagaaccacagctacagcctgaagagcagcgccagcttcaacgtgattgagttcccctacaagaacctgcccatcgaggacatcaccaacagcaccctggtgaccaccaacgtgacctggggcatccagcctgcccccatgcctgtgcctgtgtgggtgatcatcctggccgtgctggccggcctgctgctgctggccgtgctggtgtttgtgatgtacaggatgggcttcttcaagagggtgcggcccccccaggaggagcaggagcgggagcagctgcagccccatgaaaatggagagggcaacagcgagacctag

SEQ ID NO: 20084 - DNA, 1449 bp, Artificial Sequence
  Description of Artificial Sequence: Synthetic coding sequence
atggccttccccccccggcggcggctgcggctgggcccccggggcctgcccctgctgctgagcggcctgctgctgcccctgtgccgggccttcaacctggatgtggacagccctgctgagtacagcggccctgagggcagctactttggatttgctgtggacttctttgtgcccagcgccagcagcaggatgttcctgctggtgggcgcccccaaggccaacaccacccagcccggcatcgtggagggcggccaggtgctgaagtgtgactggagcagcacccggcgctgccagcccatcgagtttgatgccactggaaacagagattatgccaaggatgaccccctggagttcaagagccaccagtggtttggagcctctgtgcgcagcaagcaggacaagatcctggcctgtgcccccctgtaccactggaggacagagatgaagcaggagcgggagcctgtgggcacctgcttcctgcaggacggcaccaagacagtggagtatgccccctgccgcagccaggacattgatgctgatggccagggcttctgccagggcggcttcagcattgacttcaccaaggctgacagagtgctgctgggcggccctggcagcttctactggcagggccagctgatcagtgaccaggtggccgagatcgtgtccaaatatgaccccaacgtgtacagcatcaagtacaacaaccagctggccaccaggacagcccaggccatctttgatgacagctacctgggctacagcgtggccgtgggggacttcaatggagatggcattgatgactttgtgtctggagtgccccgggccgcccggaccctgggcatggtgtacatctatgatggcaagaacatgagcagcctgtacaacttcaccggggagcagatggccgcctacttcggcttctctgtggccgccacagacatcaatggagatgattatgcagatgtgttcatcggggcccccctcttcatggaccggggcagtgatggcaagctgcaggaggtgggccaggtgtctgtgtccctgcagagggccagcggggacttccagaccaccaagctgaatggatttgaggtgtttgcccgcttcggcagcgccatcgcccccctgggggacctggaccaggacggcttcaatgacatcgccatcgccgccccctatggaggagaggacaagaagggcatcgtgtacatcttcaacggccgcagcacaggcctgaatgctgtgcccagccagatcctggagggccagtgggccgcccgctccatgcctccttcctttggctacagcatgaagggggccacagacatcgacaagaatggctacccagacctgattgtgggcgcctttggagtggaccgggccatcctgtaccgggcccggcctgtgatccccatctttgtgcagctgcaccacgtggtgcactag

SEQ ID NO: 20085 - DNA, 2397 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaagggcacagctgagaagctgaagccagaggacatcacccagatccagccccagcagctggtgctgcggctgcggtctggagagccccagaccttcaccctgaagttcaagagagctgaggactaccccatcgacctgtactacctgatggacctgagctacagcatgaaggatgacctggagaatgtgaagagcctgggcacagacctgatgaatgagatgaggcgcatcaccagtgacttccgcatcggcttcggcagctttgtggagaagacagtgatgccctacatcagcaccaccccagccaagctgaggaacccctgcaccagcgagcagaactgcaccagccccttctcctacaagaatgtgctgagcctgaccaacaagggggaggtgttcaatgagctggtgggcaagcagaggatcagcggcaacctggacagccctgagggcggctttgatgccatcatgcaggtggccgtgtgtggcagcctgattggctggagaaatgtgacccggctgctggtgttcagcacagatgctggcttccactttgctggagatggcaagctgggcggcatcgtgctgcccaatgatggccagtgccacctggagaacaacatgtacaccatgagccactactatgactaccccagcatcgcccacctggtgcagaagctgtctgagaacaacatccagaccatctttgctgtgacagaggagttccagcctgtgtacaaggagctgaagaacctgatccccaagtctgctgtgggcaccctgagcgccaacagcagcaatgtcatccagctgatcattgatgcctacaacagcctgagcagcgaggtgatcctggagaatggcaagctgtctgagggcgtgaccatctcctacaagagctactgcaagaatggagtgaatggcaccggggagaatggaaggaagtgcagcaacatcagcattggagatgaggtgcagtttgagatcagcatcaccagcaacaagtgccccaagaaggacagcgacagcttcaagatccggcccctgggcttcacagaggaggtggaggtgatcctgcagtacatctgtgaatgtgagtgccagagcgagggcatccctgagagccccaagtgccacgagggcaatggcacctttgaatgtggggcctgccgctgcaatgaaggccgggtgggccgccactgtgaatgttccacagatgaggtgaacagcgaggacatggatgcctactgcaggaaagaaaacagcagcgagatctgcagcaacaacggggagtgtgtgtgtggccagtgtgtgtgcaggaagagggacaacaccaatgagatctacagcggcaagttctgtgaatgtgacaacttcaactgtgacaggagcaatggcctcatctgtggcggcaatggagtgtgcaagtgccgggtgtgtgagtgcaaccccaactacacaggcagcgcctgtgactgcagcctggacaccagcacctgtgaggccagcaatggccagatctgcaatggccggggcatctgtgaatgtggggtgtgcaagtgcacagaccccaagttccagggccagacctgtgagatgtgccagacctgcctgggcgtgtgtgccgagcacaaggaatgtgtgcagtgccgggccttcaacaagggggagaagaaggacacctgcacccaggagtgcagctacttcaacatcaccaaggtggagagccgggacaagctgccccagcctgtgcagcctgaccctgtgagccactgcaaggagaaggatgtggatgactgctggttctacttcacctacagcgtgaatggaaataatgaggtgatggtgcacgtggtggagaaccctgagtgccccactggaccagacatcatccccatcgtggccggcgtggtggccggcatcgtgctgattggcctggccctgctgctgatctggaagctgctgatgatcatccatgaccggcgggagtttgccaagtttgagaaggagaagatgaatgccaagtgggacacaggagagaaccccatctacaagtctgctgtgaccaccgtggtgaaccccaagtatgagggcaagtag

SEQ ID NO: 20086 - DNA, 2478 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaagggcacagctgagaagctgaagccagaggacatcacccagatccagccccagcagctggtgctgcggctgcggtctggagagccccagaccttcaccctgaagttcaagagagctgaggactaccccatcgacctgtactacctgatggacctgagctacagcatgaaggatgacctggagaatgtgaagagcctgggcacagacctgatgaatgagatgaggcgcatcaccagtgacttccgcatcggcttcggcagctttgtggagaagacagtgatgccctacatcagcaccaccccagccaagctgaggaacccctgcaccagcgagcagaactgcaccagccccttctcctacaagaatgtgctgagcctgaccaacaagggggaggtgttcaatgagctggtgggcaagcagaggatcagcggcaacctggacagccctgagggcggctttgatgccatcatgcaggtggccgtgtgtggcagcctgattggctggagaaatgtgacccggctgctggtgttcagcacagatgctggcttccactttgctggagatggcaagctgggcggcatcgtgctgcccaatgatggccagtgccacctggagaacaacatgtacaccatgagccactactatgactaccccagcatcgcccacctggtgcagaagctgtctgagaacaacatccagaccatctttgctgtgacagaggagttccagcctgtgtacaaggagctgaagaacctgatccccaagtctgctgtgggcaccctgagcgccaacagcagcaatgtcatccagctgatcattgatgcctacaacagcctgagcagcgaggtgatcctggagaatggcaagctgtctgagggcgtgaccatctcctacaagagctactgcaagaatggagtgaatggcaccggggagaatggaaggaagtgcagcaacatcagcattggagatgaggtgcagtttgagatcagcatcaccagcaacaagtgccccaagaaggacagcgacagcttcaagatccggcccctgggcttcacagaggaggtggaggtgatcctgcagtacatctgtgaatgtgagtgccagagcgagggcatccctgagagccccaagtgccacgagggcaatggcacctttgaatgtggggcctgccgctgcaatgaaggccgggtgggccgccactgtgaatgttccacagatgaggtgaacagcgaggacatggatgcctactgcaggaaagaaaacagcagcgagatctgcagcaacaacggggagtgtgtgtgtggccagtgtgtgtgcaggaagagggacaacaccaatgagatctacagcggcaagttctgtgaatgtgacaacttcaactgtgacaggagcaatggcctcatctgtggcggcaatggagtgtgcaagtgccgggtgtgtgagtgcaaccccaactacacaggcagcgcctgtgactgcagcctggacaccagcacctgtgaggccagcaatggccagatctgcaatggccggggcatctgtgaatgtggggtgtgcaagtgcacagaccccaagttccagggccagacctgtgagatgtgccagacctgcctgggcgtgtgtgccgagcacaaggaatgtgtgcagtgccgggccttcaacaagggggagaagaaggacacctgcacccaggagtgcagctacttcaacatcaccaaggtggagagccgggacaagctgccccagcctgtgcagcctgaccctgtgagccactgcaaggagaaggatgtggatgactgctggttctacttcacctacagcgtgaatggaaataatgaggtgatggtgcacgtggtggagaaccctgagtgccccactggaccagacatcatccccatcgtggccggcgtggtggccggcatcgtgctgattggcctggccctgctgctgatctggaagctgctgatgatcatccatgaccggcgggagtttgccaagtttgagaaggagaagatgaatgccaagtgggacaccagcctgtctgtggcccagcccggggtgcagtggtgtgacatcagcagcctgcagcccctgaccagccgcttccagcagttcagctgcctgagcctgcccagcacctgggactacagagtgaagatcctcttcatccgggtgccctag

SEQ ID NO: 20087 - DNA, 2397 bp, Artificial Sequence; identical to SEQ ID NO: 20085
  Description of Artificial Sequence: Synthetic coding sequence

SEQ ID NO: 20088 - DNA, 150 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcacctag

SEQ ID NO: 20089 - DNA, 270 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatctag

SEQ ID NO: 20090 - DNA, 2406 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaagggcacagctgagaagctgaagccagaggacatcacccagatccagccccagcagctggtgctgcggctgcggtctggagagccccagaccttcaccctgaagttcaagagagctgaggactaccccatcgacctgtactacctgatggacctgagctacagcatgaaggatgacctggagaatgtgaagagcctgggcacagacctgatgaatgagatgaggcgcatcaccagtgacttccgcatcggcttcggcagctttgtggagaagacagtgatgccctacatcagcaccaccccagccaagctgaggaacccctgcaccagcgagcagaactgcaccagccccttctcctacaagaatgtgctgagcctgaccaacaagggggaggtgttcaatgagctggtgggcaagcagaggatcagcggcaacctggacagccctgagggcggctttgatgccatcatgcaggtggccgtgtgtggcagcctgattggctggagaaatgtgacccggctgctggtgttcagcacagatgctggcttccactttgctggagatggcaagctgggcggcatcgtgctgcccaatgatggccagtgccacctggagaacaacatgtacaccatgagccactactatgactaccccagcatcgcccacctggtgcagaagctgtctgagaacaacatccagaccatctttgctgtgacagaggagttccagcctgtgtacaaggagctgaagaacctgatccccaagtctgctgtgggcaccctgagcgccaacagcagcaatgtcatccagctgatcattgatgcctacaacagcctgagcagcgaggtgatcctggagaatggcaagctgtctgagggcgtgaccatctcctacaagagctactgcaagaatggagtgaatggcaccggggagaatggaaggaagtgcagcaacatcagcattggagatgaggtgcagtttgagatcagcatcaccagcaacaagtgccccaagaaggacagcgacagcttcaagatccggcccctgggcttcacagaggaggtggaggtgatcctgcagtacatctgtgaatgtgagtgccagagcgagggcatccctgagagccccaagtgccacgagggcaatggcacctttgaatgtggggcctgccgctgcaatgaaggccgggtgggccgccactgtgaatgttccacagatgaggtgaacagcgaggacatggatgcctactgcaggaaagaaaacagcagcgagatctgcagcaacaacggggagtgtgtgtgtggccagtgtgtgtgcaggaagagggacaacaccaatgagatctacagcggcaagttctgtgaatgtgacaacttcaactgtgacaggagcaatggcctcatctgtggcggcaatggagtgtgcaagtgccgggtgtgtgagtgcaaccccaactacacaggcagcgcctgtgactgcagcctggacaccagcacctgtgaggccagcaatggccagatctgcaatggccggggcatctgtgaatgtggggtgtgcaagtgcacagaccccaagttccagggccagacctgtgagatgtgccagacctgcctgggcgtgtgtgccgagcacaaggaatgtgtgcagtgccgggccttcaacaagggggagaagaaggacacctgcacccaggagtgcagctacttcaacatcaccaaggtggagagccgggacaagctgccccagcctgtgcagcctgaccctgtgagccactgcaaggagaaggatgtggatgactgctggttctacttcacctacagcgtgaatggaaataatgaggtgatggtgcacgtggtggagaaccctgagtgccccactggaccagacatcatccccatcgtggccggcgtggtggccggcatcgtgctgattggcctggccctgctgctgatctggaagctgctgatgatcatccatgaccggcgggagtttgccaagtttgagaaggagaagatgaatgccaagtgggacacccaggagaaccccatctacaagagccccatcaacaacttcaagaaccccaactacggcaggaaggccggcctgtag

SEQ ID NO: 20091 - DNA, 411 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaagggcacagctgagaagctgaagccagaggacatcacccagatccagccccagcagctggtgctgcggctgcggtctggagagccccagaccttcaccctgaagttcaagtag

SEQ ID NO: 20092 - DNA, 378 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaagggcacagctgagaagctgaagccagaggacatcacccagatccagccccagcagctggtgctgcggctgcggagctag

SEQ ID NO: 20093 - DNA, 492 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaagggcacagctgagaagctgaagccagaggacatcacccagatccagccccagcagctggtgctgcggctgcggtctggagagccccagaccttcaccctgaagttcaagagagctgaggactaccccatcgacctgtactacctgatggacctgagctacagcatgaaggatgacctggagaatgtgaagtag

SEQ ID NO: 20094 - DNA, 459 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcgtgtccaagaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaaaggaacagctgagaagctgaagccagaggacatcacccagatccagccccagcagctggtgctgcggctgcggagcggggagccccagaccttcaccctgaagttcaagagagctgaggactaccccatcgacctgtactacctgatgtag

SEQ ID NO: 20095 - DNA, 315 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaagggcacagctgagtag

SEQ ID NO: 20096 - DNA, 432 bp, Artificial Sequence
  Description of Artificial Sequence: Synthetic coding sequence
atgaacctgcagcccatcttctggattggcctcatcagctctgtgtgctgcgtgtttgcccagacagatgagaaccgctgcctgaaggccaatgccaagagctgtggggagtgcatccaggccggccccaactgtggctggtgcaccaacagcaccttcctgcaggagggcatgcccaccagcgcccgctgtgatgacctggaggccctgaagaagaagggctgccccccagatgacatcgagaacccccggggcagcaaggacatcaagaagaacaagaatgtgaccaacagaagcaagggcacagctgagaagctgaagccagaggacatcacccagatccagccccagcagctggtgctgcggctgcggtctggagagccccagaccttcaccctgaagttcaagagagctgaggactaccccatctag

SEQ ID NO: 20097 - DNA, 2310 bp, Artificial Sequence
  Description of Artificial Sequence: Synthetic coding sequence
atgctgggcctgcggccccccctgctggccctggtgggcctgctgagcctgggctgtgtgctgagccaggagtgcaccaagttcaaggtgagcagctgcagagaatgtattgaaagtggccctggctgcacctggtgccagaagctgaacttcaccggccctggggaccctgacagcatccgctgtgacacccggccccagctgctgatgaggggctgtgccgcagatgacatcatggaccccaccagcctggccgagacccaggaggaccacaacggcggccagaagcagctgagcccccagaaggtgaccctgtacctgcggcccggccaggccgccgccttcaacgtgaccttccggcgggccaagggctaccccatcgacctgtactacctgatggacctgagctacagcatgctggatgacctgagaaatgtgaagaagctgggcggggacctgctgcgggccctgaatgagatcacagaaagtggccgcatcggcttcggcagctttgtggacaagacagtgctgccctttgtgaacacccacccagacaagctgaggaacccctgccccaacaaggagaaggagtgccagcccccatttgccttccgccacgtgctgaagctgaccaacaacagcaaccagttccagacagaggtgggcaagcagctgatcagcggcaacctggatgcccctgagggcggcctggatgccatgatgcaggtggccgcctgcccagaggagatcggctggagaaatgtgacccggctgctggtgtttgccacagatgatggcttccactttgctggagatggcaagctgggcgccatcctgaccccaaatgatggccgctgccacctggaggacaacctgtacaagaggagcaatgaatttgactaccccagcgtgggccagctggcccacaagctggccgagaacaacatccagcccatctttgctgtgaccagcaggatggtgaagacctatgagaagctgacagagatcatccccaagtctgctgtgggggagctgtctgaggacagcagcaatgtggtgcagctgatcaagaatgcctacaacaagctgagcagcagggtcttcctggaccacaatgccctgcctgacaccctgaaggtgacctatgacagcttctgcagcaatggagtgacccacaggaaccagcccaggggggactgtgatggagtgcagatcaacgtgcccatcaccttccaggtgaaggtgacagccacagagtgcatccaggagcagagctttgtgatccgggccctgggcttcacagacatcgtgacagtgcaggtgctgccccagtgtgagtgccgctgccgggaccagagccgggacaggagcctgtgccacggcaagggcttcctggagtgtggcatctgccgctgtgacaccggctacatcggcaagaactgtgagtgccagacccagggccgcagcagccaggagctggagggcagctgcaggaaggacaacaacagcatcatctgcagcggcctgggggactgtgtgtgtggccagtgcctgtgccacaccagtgatgtgcctgggaagctgatctacggccagtactgtgaatgtgacaccatcaactgtgagcgctacaacggccaggtgtgtggcggccctggccggggcctgtgcttctgtgggaaatgtcgctgccaccctggctttgagggcagcgcctgccagtgtgagaggaccacagagggctgcctgaacccccggcgggtggagtgcagcggccggggccgctgccgctgcaatgtgtgtgagtgccacagcggctaccagctgcccctgtgccaggagtgccccggctgccccagcccctgtgggaagtacatcagctgtgccgagtgcctgaagtttgagaagggcccctttgggaagaactgcagcgctgcctgccccggcctgcagctgagcaacaaccctgtgaagggccgcacctgcaaggagcgggacagcgagggctgctgggtggcctacaccctggagcagcaggacggcatggaccgctacctgatctacgtggatgagagccgggagtgtgtggccggccccaacattgctgccatcgtgggcggcaccgtggccggcatcgtgctgattggcatcctgctgctggtgatctggaaggccctgatccacctgagtgacctgcgggagtaccgccgctttgagaaggagaagctgaagagccagtggaacaatgacaaccccctcttcaagagcgccaccaccaccgtgatgaaccccaagtttgctgagagctag

SEQ ID NO: 20098 - DNA, 969 bp, Artificial Sequence
  Description of Artificial Sequence: Synthetic coding sequence
ggccgcctgggcaaggacctggccactggagtgctgagccaggagtgcaccaagttcaaggtgagcagctgccgggagtgcatcgagagcggccctggctgcacctggtgccagaagctgaacttcaccggccctggggaccctgacagcatccgctgtgacacccggccccagctgctgatgaggggctgtgccgcagatgacatcatggaccccaccagcctggccgagacccaggaggaccacaatggaggccagaagcagctgagcccccagaaggtgaccctgtacctgcggcccggccaggccgccgccttcaacgtgaccttcagaagagccaagggctaccccatcgacctgtactacctgatggacctgagctacagcatgctggatgacctgagaaatgtgaagaagctgggcggggacctgctgcgggccctgaatgagatcacagagagcggcagaattggatttggcagctttgtggacaagacagtgctgccctttgtgaacacccacccagacaagctgaggaacccctgccccaacaaggagaaggagtgccagcccccatttgccttcagacatgtgctgaagctgaccaacaacagcaaccagttccagacagaggtgggcaagcagctgatcagcggcaacctggatgcccctgagggcggcctggatgccatgatgcaggtggccgcctgcccagaggagatcggctggagaaatgtgacccggctgctggtgtttgccacagatgatggcttccactttgctggagatggcaagctgggcgccatcctgaccccaaatgatggccgctgccacctggaggacaacctgtacaagaggagcaatgaatttgactaccccagcgtgggccagctggcccacaagctggccgagaacaacatccagcccatctttgctgtgaccagcaggatggtgaagacctatgaatag

SEQ ID NO: 20099 - DNA, 2310 bp, Artificial Sequence; identical to SEQ ID NO: 20097
  Description of Artificial Sequence: Synthetic coding sequence

SEQ ID NO: 20100 - DNA, 2310 bp, Artificial Sequence; identical to SEQ ID NO: 20097
  Description of Artificial Sequence: Synthetic coding sequence

SEQ ID NO: 20101 - DNA, 2310 bp, Artificial Sequence; identical to SEQ ID NO: 20097
  Description of Artificial Sequence: Synthetic coding sequence

SEQ ID NO: 20102 - DNA, 2310 bp, Artificial Sequence; identical to SEQ ID NO: 20097
  Description of Artificial Sequence: Synthetic coding sequence

SEQ ID NO: 20103 - DNA, 363 bp, Artificial Sequence
  Description of Artificial Sequence: Synthetic coding sequence
atgctgggcctgcggccccccctgctggccctggtgggcctgctgagcctgggctgtgtgctgagccaggagtgcaccaagttcaaggtgagcagctgcagagaatgtattgaaagtggccctggctgcacctggtgccagaagctgaacttcaccggccctggggaccctgacagcatccgctgtgacacccggccccagctgctgatgaggggctgtgccgcagatgacatcatggaccccaccagcctggccgagacccaggaggaccacaacggcggccagaagcagctgagcccccagaaggtgaccctgtacctgcggcccggccaggccgccgccttcaacgtgaccttcagatag

SEQ ID NO: 20104 - DNA, 213 bp, Artificial Sequence
  Description of Artificial Sequence: Synthetic coding sequence
atgctgggcctgcggccccccctgctggccctggtgggcctgctgagcctgggctgtgtgctgagccaggagtgcaccaagttcaaggtgagcagctgcagagaatgtattgaaagtggccctggctgcacctggtgccagaagctgaacttcaccggccctggggaccctgacagcatccgctgtgacacccggccccagctgctgatgtag

SEQ ID NO: 20105 - DNA, 150 bp, Artificial Sequence
  Description of Artificial Sequence: Synthetic coding sequence
atgctgggcctgcggccccccctgctggccctggtgggcctgctgagcctgggctgtgtgctgagccaggagtgcaccaagttcaaggtgagcagctgcagagaatgtattgaaagtggccctggctgcacctggtgccagaagctgtag

SEQ ID NO: 20106 - DNA, 483 bp, Artificial Sequence
  Description of Artificial Sequence: Synthetic coding sequence
atgctgggcctgcggccccccctgctggccctggtgggcctgctgagcctgggctgtgtgctgagccaggagtgcaccaagttcaaggtgagcagctgcagagaatgtattgaaagtggccctggctgcacctggtgccagaagctgaacttcaccggccctggggaccctgacagcatccgctgtgacacccggccccagctgctgatgaggggctgtgccgcagatgacatcatggaccccaccagcctggccgagacccaggaggaccacaacggcggccagaagcagctgagcccccagaaggtgaccctgtacctgcggcccggccaggccgccgccttcaacgtgaccttccggcgggccaagggctaccccatcgacctgtactacctgatggacctgagctacagcatgctggatgacctgagaaatgtgaagaagctgggcggggacctgctgcgggccctgaatgagatctag

SEQ ID NO: 20107 - DNA, 501 bp, Artificial Sequence
  Description of Artificial Sequence: Synthetic coding sequence
atgctgggcctgcggccccccctgctggccctggtgggcctgctgagcctgggctgtgtgctgagccaggagtgcaccaagttcaaggtgagcagctgcagagaatgtattgaaagtggccctggctgcacctggtgccagaagctgaacttcaccggccctggggaccctgacagcatccgctgtgacacccggccccagctgctgatgaggggctgtgccgcagatgacatcatggaccccaccagcctggccgagacccaggaggaccacaacggcggccagaagcagctgagcccccagaaggtgaccctgtacctgcggcccggccaggccgccgccttcaacgtgaccttccggcgggccaagggctaccccatcgacctgtactacctgatggacctgagctacagcatgctggatgacctgagaaatgtgaagaagctgggcggggacctgctgcgggccctgaatgagatcacagaaagtggccgcatctag

SEQ ID NO: 20108 - DNA, 1137 bp, Artificial Sequence
  Description of Artificial Sequence: Synthetic coding sequence
atgctgggcctgcggccccccctgctggccctggtgggcctgctgagcctgggctgtgtgctgagccaggagtgcaccaagttcaaggtgagcagctgcagagaatgtattgaaagtggccctggctgcacctggtgccagaagctgaacttcaccggccctggggaccctgacagcatccgctgtgacacccggccccagctgctgatgaggggctgtgccgcagatgacatcatggaccccaccagcctggccgagacccaggaggaccacaacggcggccagaagcagctgagcccccagaaggtgaccctgtacctgcggcccggcttcggcagctttgtggacaagacagtgctgccctttgtgaacacccacccagacaagctgaggaacccctgccccaacaaggagaaggagtgccagcccccatttgccttcagacatgtgctgaagctgaccaacaacagcaaccagttccagacagaggtgggcaagcagctgatcagcggcaacctggatgcccctgagggcggcctggatgccatgatgcaggtggccgcctgcccagaggagatcggctggagaaatgtgacccggctgctggtgtttgccacagatgatggcttccactttgctggagatggcaagctgggcgccatcctgaccccaaatgatggccgctgccacctggaggacaacctgtacaagaggagcaatgaatttgactaccccagcgtgggccagctggcccacaagctggccgagaacaacatccagcccatctttgctgtgaccagcaggatggtgaagacctatgagaagctgacagagatcatccccaagtctgctgtgggggagctgtctgaggacagcagcaatgtggtgcagctgatcaagaatgcctacaacaagctgagcagcagggtcttcctggaccacaatgccctgcctgacaccctgaaggtgacctatgacagcttctgcagcaatggagtgacccacaggaaccagcccaggggggactgtgatggagtgcagatcaacgtgcccatcaccttccaggtgaaggtgacagccacagagtgcatccaggagcagagctttgtgattggccgctgggccagcaggacatag

SEQ ID NO: 20109 - DNA, 2367 bp, Artificial Sequence
  Description of Artificial Sequence: Synthetic coding sequence
atgagggcccggccccggccccggcccctgtgggccaccgtgctggccctgggcgccctggccggcgtgggcgtgggcggccccaacatctgcaccacccggggcgtgagcagctgccagcagtgcctggccgtgagccccatgtgtgcctggtgcagtgatgaggccctgcccctgggcagcccccgctgtgacctgaaggagaacctgctgaaggacaactgtgcccctgagagcattgagttccctgtgtctgaggcccgggtgctggaggaccggcccctgagtgacaagggcagcggggacagcagccaggtgacccaggtgagcccccagagaattgccctgcggctgcggccagatgacagcaagaacttcagcatccaggtgcggcaggtggaggactaccctgtggacatctactacctgatggacctgagctacagcatgaaggatgacctgtggagcatccagaacctgggcaccaagctggccacccagatgaggaagctgaccagcaacctgagaattggatttggagcctttgtggacaagcctgtgagcccctacatgtacatcagccccccagaggccctggagaacccctgctatgacatgaagaccacctgcctgcccatgtttggctacaagcacgtgctgaccctgacagaccaggtgacccgcttcaatgaggaggtgaagaagcagagcgtgtccaggaacagagatgcccctgagggcggctttgatgccatcatgcaggccaccgtgtgtgatgagaagattggctggagaaatgatgccagccacctgctggtgttcaccacagatgccaagacccacatcgccctggatggccgcctggccggcatcgtgcagcccaatgatggccagtgccacgtgggcagtgacaaccactacagcgccagcaccaccatggactaccccagcctgggcctgatgacagagaagctgagccagaagaacatcaacctgatctttgctgtgacagaaaatgtggtgaacctgtaccagaactacagcgagctgatccctggcaccaccgtgggcgtgctgtccatggacagcagcaatgtgctgcagctgattgtggatgcctacggcaagatccgcagcaaggtggagctggaggtgcgggacctgcctgaggagctgagcctgtccttcaatgccacctgcctgaacaatgaagtcatccctggcctgaagagctgcatgggcctgaagattggagacacagtgtccttcagcattgaggccaaggtgcggggctgcccccaggagaaggagaagagcttcaccatcaagcctgtgggcttcaaggacagcctcatcgtgcaggtgacctttgactgtgactgtgcctgccaggcccaggccgagcccaacagccaccgctgcaacaatggaaatggcacctttgaatgtggggtgtgccgctgtggccctggctggctgggcagccagtgtgagtgcagcgaggaggactaccggcccagccagcaggatgaatgtagcccccgggagggccagcctgtgtgcagccagagaggagagtgcctgtgtggccagtgtgtgtgccacagcagtgactttgggaagatcaccgggaagtactgtgaatgtgatgacttcagctgtgtgcgctacaagggggagatgtgcagcggccacggccagtgcagctgtggggactgcctgtgtgacagcgactggacaggctactactgcaactgcaccaccaggacagacacctgcatgagcagcaatggcctgctgtgcagcggccggggcaaatgtgaatgtggcagctgtgtgtgcatccagcccggcagctatggagacacctgtgagaagtgccccacctgcccagatgcctgcaccttcaagaaggaatgtgtggagtgcaagaagtttgacagaggagccctgcatgatgagaacacctgcaaccgctactgcagagatgaaattgaatctgtgaaggagctgaaggacaccgggaaggatgctgtgaactgcacctacaagaatgaagatgactgtgtggtgcgcttccagtactatgaggacagcagcggcaagagcatcctgtatgtggtggaggagcctgagtgccccaagggccctgacatcctggtggtgctgctgtctgtgatgggcgccatcctgctgattggcctggccgccctgctgatctggaagctgctgatcaccatccatgacaggaaggagtttgccaagtttgaggaggagcgggcccgggccaagtgggacacagccaacaaccccctgtacaaggaggccaccagcaccttcaccaacatcacctaccggggcacctag

SEQ ID NO: 20110 - DNA, 2256 bp, Artificial Sequence
  Description of Artificial Sequence: Synthetic coding sequence
atgtgtgcctggtgcagtgatgaggccctgcccctgggcagcccccgctgtgacctgaaggagaacctgctgaaggacaactgtgcccctgagagcattgagttccctgtgtctgaggcccgggtgctggaggaccggcccctgagtgacaagggcagcggggacagcagccaggtgacccaggtgagcccccagagaattgccctgcggctgcggccagatgacagcaagaacttcagcatccaggtgcggcaggtggaggactaccctgtggacatctactacctgatggacctgagctacagcatgaaggatgacctgtggagcatccagaacctgggcaccaagctggccacccagatgaggaagctgaccagcaacctgcgcatcggctttggagcctttgtggacaagcctgtgagcccctacatgtacatcagccccccagaggccctggagaacccctgctatgacatgaagaccacctgcctgcccatgtttggctacaagcacgtgctgaccctgacagaccaggtgacccgcttcaatgaggaggtgaagaagcagagcgtgtccaggaacagagatgcccctgagggcggctttgatgccatcatgcaggccaccgtgtgtgatgagaagattggctggagaaatgatgccagccacctgctggtgttcaccacagatgccaagacccacatcgccctggatggccgcctggccggcatcgtgcagcccaatgatggccagtgccacgtgggcagtgacaaccactacagcgccagcaccaccatggactaccccagcctgggcctgatgacagagaagctgagccagaagaacatcaacctgatctttgctgtgacagaaaatgtggtgaacctgtaccagaactacagcgagctgatccctggcaccaccgtgggcgtgctgtccatggacagcagcaatgtgctgcagctgattgtggatgcctacggcaagatccgcagcaaggtggagctggaggtgcgggacctgcctgaggagctgagcctgtccttcaatgccacctgcctgaacaatgaggtgattcctggcctgaagagctgcatgggcctgaagatcggggacacagtgtccttcagcattgaggccaaggtgcggggctgcccccaggagaaggagaagagcttcaccatcaagcctgtgggcttcaaggacagcctgattgtgcaggtgacctttgactgtgactgtgcctgccaggcccaggccgagcccaacagccaccgctgcaacaatggaaatggcacctttgaatgtggggtgtgccgctgtggccctggctggctgggcagccagtgtgaatgttctgaggaggactaccggcccagccagcaggatgagtgcagcccccgggagggccagcctgtgtgcagccagagaggagaatgtctgtgtggccagtgtgtgtgccacagcagtgactttgggaagatcaccgggaagtactgtgaatgtgatgacttcagctgtgtgcgctacaagggggagatgtgcagcggccacggccagtgcagctgtggggactgcctgtgtgacagcgactggacaggctactactgcaactgcaccaccaggacagacacctgcatgagcagcaatggcctgctgtgcagcggccggggcaaatgtgaatgtggcagctgtgtgtgcatccagcccggcagctatggagacacctgtgagaagtgccccacctgcccagatgcctgcaccttcaagaaggaatgtgtggagtgcaagaagtttgacagaggagccctgcatgatgagaacacctgcaaccgctactgcagagatgaaattgagagcgtgaaggagctgaaggacaccgggaaggatgctgtgaactgcacctacaagaatgaagatgactgtgtggtgcgcttccagtactatgaggacagcagcggcaagagcatcctgtatgtggtggaggagccagaatgtcccaagggccctgacatcctggtggtgctgctgtctgtgatgggcgccatcctgctgattggcctggccgccctgctgatctggaagctgctgatcaccatccatgacaggaaggagtttgccaagtttgaggaggagcgggcccgggccaagtgggacacagagatcctgctgtactactgcagcttcatcctggtgcaccagagcctggagagcctgaggacagagttcaccagcaagcagaaggatggcaactag

SEQ ID NO: 20111 - DNA, 2367 bp, Artificial Sequence; identical to SEQ ID NO: 20109
  Description of Artificial Sequence: Synthetic coding sequence

SEQ ID NO: 20112 - DNA, 1359 bp, Artificial Sequence
  Description of Artificial Sequence: Synthetic coding sequence
atggatgacatcttcacccagtgccgggagggcaatgctgtggccgtgcggctgtggctggacaacacagaaaatgacctgaaccagggagatgaccacggcttcagccccctgcactgggcctgccgggagggccgctctgctgtggtggagatgctgatcatgagaggagcccgcatcaacgtgatgaacagaggagatgacacccccctgcacctggccgccagccacggccaccgggacatcgtgcagaagctgctgcagtacaaggctgacatcaatgctgtgaatgaacatggaaatgtgcccctgcactacgcctgcttctggggccaggaccaggtggccgaggacctggtggccaacggggccctggtgtccatctgcaacaagtacggggagatgcctgtggacaaggccaaggcccccctgcgggagctgctgcgggagcgggcagagaagatgggccagaacctgaaccgcatcccctacaaggacaccttctggaagggcaccaccaggacccggcccagaaatggcaccctgaacaagcacagcggcatcgacttcaagcagctgaacttcctgaccaagctgaatgaaaaccacagcggggagctgtggaagggccgctggcagggcaatgacatcgtggtgaaggtgctgaaggtgcgggactggagcaccaggaagagccgggacttcaatgaggagtgcccccggctgcgcatcttcagccaccccaacgtgctgcctgtgctgggcgcctgccagagccccccagccccccaccccaccctcatcacccactggatgccctacggcagcctgtacaacgtgctgcacgagggcaccaactttgtggtggaccagagccaggccgtgaagtttgccctggacatggcccggggcatggccttcctgcacaccctggagcccctcatccccaggcatgccctgaacagccgctctgtgatgattgatgaggacatgacagcccgcatctccatggctgatgtgaagttctccttccagtgccccggccgcatgtatgccccagcctgggtggcccctgaggccctgcagaagaagccagaggacaccaacagaagatctgctgacatgtggagctttgctgtgctgctgtgggagctggtgacccgggaggtgccctttgctgacctgagcaacatggagatcggcatgaaggtggccctggagggcctgcggcccaccatccccccaggcatcagcccccacgtgtgcaagctgatgaagatctgcatgaatgaagatcctgccaagaggcccaagtttgacatgattgtgcccatcctggagaagatgcaggacaagtag

SEQ ID NO: 20113 - DNA, 1359 bp, Artificial Sequence; identical to SEQ ID NO: 20112
  Description of Artificial Sequence: Synthetic coding sequence

SEQ ID NO: 20114 - DNA, 1359 bp, Artificial Sequence; identical to SEQ ID NO: 20112
  Description of Artificial Sequence: Synthetic coding sequence

SEQ ID NO: 20115 - DNA, 957 bp, Artificial Sequence
  Description of Artificial Sequence: Synthetic coding sequence
atgcctgtggacaaggccaaggcccccctgcgggagctgctgcgggagcgggcagagaagatgggccagaacctgaaccgcatcccctacaaggacaccttctggaagggcaccaccaggacccggcccagaaatggcaccctgaacaagcacagcggcatcgacttcaagcagctgaacttcctgaccaagctgaatgaaaaccacagcggggagctgtggaagggccgctggcagggcaatgacatcgtggtgaaggtgctgaaggtgcgggactggagcaccaggaagagccgggacttcaatgaggagtgcccccggctgcgcatcttcagccaccccaacgtgctgcctgtgctgggcgcctgccagagccccccagccccccaccccaccctcatcacccactggatgccctacggcagcctgtacaacgtgctgcacgagggcaccaactttgtggtggaccagagccaggccgtgaagtttgccctggacatggcccggggcatggccttcctgcacaccctggagcccctcatccccaggcatgccctgaacagccgctctgtgatgattgatgaggacatgacagcccgcatctccatggctgatgtgaagttctccttccagtgccccggccgcatgtatgccccagcctgggtggcccctgaggccctgcagaagaagccagaggacaccaacagaagatctgctgacatgtggagctttgctgtgctgctgtgggagctggtgacccgggaggtgccctttgctgacctgagcaacatggagatcggcatgaaggtggccctggagggcctgcggcccaccatccccccaggcatcagcccccacgtgtgcaagctgatgaagatctgcatgaatgaagatcctgccaagaggcccaagtttgacatgattgtgcccatcctggagaagatgcaggacaagtag

SEQ ID NO: 20116 - DNA, 978 bp, Artificial Sequence
  Description of Artificial Sequence: Synthetic coding sequence
atgcccatcaccaggatgaggatgaggccctggctggagatgcagatcaacagcaaccagatccctggcctcatctggatcaacaaggaggagatgatcttccagatcccctggaagcatgctgccaagcacggctgggacatcaacaaggatgcctgcctcttccgctcctgggccatccacacaggccgctacaaggccggggagaaggagccagaccccaagacctggaaggccaacttccgctgtgccatgaacagcctgcctgacatcgaggaggtgaaggaccagagcagaaataaaggcagcagcgctgtgcgggtgtacaggatgctgccccccctgaccaagaaccagaggaaggagaggaagagcaagagcagcagagatgccaagagcaaggccaagaggaagagctgtggggacagcagcccagacaccttcagtgatggcctgagcagcagcaccctgcctgatgaccacagcagctacacagtgcccggctacatgcaggacctggaggtggagcaggccctgaccccagccctgagcccctgtgctgtgagcagcaccctgcctgactggcacatccctgtggaggtggtgcctgacagcaccagtgacctgtacaacttccaggtgagccccatgcccagcaccagcgaggccaccacagatgaagatgaggagggcaagctgcctgaggacatcatgaagctgctggagcagagcgagtggcagcccaccaacgtggatggcaagggctacctgctgaatgaacctggggtgcagcccacctctgtgtatggagacttcagctgcaaggaggagcctgagattgacagccctggaggagacatcggcctgagcctgcagagggtcttcacagacctgaagaacatggatgccacctggctggacagcctgctgacccctgtgcggctgcccagcatccaggccatcccctgtgccccctag

SEQ ID NO: 20117 - DNA, 978 bp, Artificial Sequence; identical to SEQ ID NO: 20116
  Description of Artificial Sequence: Synthetic coding sequence

SEQ ID NO: 20118 - DNA, 579 bp, Artificial Sequence
  Description of Artificial Sequence: Synthetic coding sequence
atgcccatcaccaggatgaggatgaggccctggctggagatgcagatcaacagcaaccagatccctggcctcatctggatcaacaaggaggagatgatcttccagatcccctggaagcatgctgccaagcacggctgggacatcaacaaggatgcctgcctcttccgctcctgggccatccacacaggccgctacaaggccggggagaaggagccagaccccaagacctggaaggccaacttccgctgtgccatgaacagcctgcctgacatcgaggaggtgaaggaccagagcagaaataaaggcagcagcgctgtgcgggtgtacaggatgctgccccccctgaccaagaaccagaggaaggagaggaagagcaagagcagcagagatgccaagagcaaggccaagaggaagagctgtggggacagcagcccagacaccttcagtgatggcctgagcagcagcaccctgcctgatgaccacagcagctacacagtgcccggctacatgcaggacctggaggtggagcaggccctgaccccagccctgagcccctgtgctgtgagcagcaccctgtag

SEQ ID NO: 20119 - DNA, 1356 bp, Artificial Sequence
  Description of Artificial Sequence: Synthetic coding sequence
atgaacctggagggcggcggccggggcggggagtttggcatgtctgctgtgtcctgtggaaatggcaagctgcggcagtggctgattgaccagattgacagcggcaagtacccaggcctggtgtgggagaatgaggagaagagcatcttccgcatcccctggaagcatgctgggaagcaggactacaaccgggaggaggatgctgccctcttcaaggcctgggccctcttcaagggcaagttccgggagggcatcgacaagccagacccccccacctggaagacccggctgcgctgtgccctgaacaagagcaatgactttgaggagctggtggagaggagccagctggacatcagtgacccctacaaggtgtacagaattgtgcctgagggcgccaagaagggggccaagcagctgaccctggaggacccccagatgtccatgagccacccctacaccatgaccaccccctaccccagcctgcctgcccagcaggtgcacaactacatgatgccacccctggaccgctcctggagggactatgtgcctgaccagccccaccctgagatcccctaccagtgccccatgaccttcggcccccggggccaccactggcagggccctgcctgtgaaaatggctgccaggtgacaggcaccttctacgcctgtgcccctcctgagagccaggcccctggggtgcccacagagcccagcatccgctctgctgaggccctggccttcagtgactgccgcctgcacatctgcctgtactaccgggagatcctggtgaaggagctgaccaccagcagccctgagggctgccgcatcagccacggccacacctatgatgccagcaacctggaccaggtgctcttcccctacccagaggacaatggccagaggaagaacatcgagaagctgctgagccacctggagcggggcgtggtgctgtggatggccccagatggcctgtatgccaagaggctgtgccagagccgcatctactgggatggccccctggccctgtgcaatgaccggcccaacaagctggagcgggaccagacctgcaagctgtttgacacccagcagttcctgtctgagctgcaggcctttgcccaccacggccgcagcctgccccgcttccaggtgaccctgtgctttggagaggagttcccagacccccagaggcagaggaagctgatcacagcccacgtggagcccctgctggcccggcagctgtactactttgcccagcagaacagcggccacttcctgcggggctatgacctgcctgagcacatcagcaaccctgaggactaccacaggagcatccgccacagcagcatccaggagtag

SEQ ID NO: 20120 - DNA, 1443 bp, Artificial Sequence
  Description of Artificial Sequence: Synthetic coding sequence
ctgggccccacagctgccctgagcagcgagagccgggcccgggccgcccaggccggcggcggcccccgggcccgggcccggacccggggcatgaacctggagggcggcggccggggcggggagtttggcatgtctgctgtgtcctgtggaaatggcaagctgcggcagtggctgattgaccagattgacagcggcaagtacccaggcctggtgtgggagaatgaggagaagagcatcttccgcatcccctggaagcatgctgggaagcaggactacaaccgggaggaggatgctgccctcttcaaggcctgggccctcttcaagggcaagttccgggagggcatcgacaagccagacccccccacctggaagacccggctgcgctgtgccctgaacaagagcaatgactttgaggagctggtggagaggagccagctggacatcagtgacccctacaaggtgtacagaattgtgcctgagggcgccaagaagggggccaagcagctgaccctggaggacccccagatgtccatgagccacccctacaccatgaccaccccctaccccagcctgcctgcccaggtgcacaactacatgatgccacccctggaccgctcctggagggactatgtgcctgaccagccccaccctgagatcccctaccagtgccccatgaccttcggcccccggggccaccactggcagggccctgcctgtgaaaatggctgccaggtgacaggcaccttctacgcctgtgcccctcctgagagccaggcccctggggtgcccacagagcccagcatccgctctgctgaggccctggccttcagtgactgccgcctgcacatctgcctgtactaccgggagatcctggtgaaggagctgaccaccagcagccctgagggctgccgcatcagccacggccacacctatgatgccagcaacctggaccaggtgctcttcccctacccagaagataatggccagaggaagaacatcgagaagctgctgagccacctggagcggggcgtggtgctgtggatggccccagatggcctgtatgccaagaggctgtgccagagccgcatctactgggatggccccctggccctgtgcaatgaccggcccaacaagctggagcgggaccagacctgcaagctgtttgacacccagcagttcctgtctgagctgcaggcctttgcccaccacggccgcagcctgccccgcttccaggtgaccctgtgcttcggggaggagttcccagacccccagaggcagaggaagctgatcacagcccacgtggagcccctgctggcccggcagctgtactactttgcccagcagaacagcggccacttcctgcggggctatgacctgcctgagcacatcagcaaccctgaggactaccacaggagcatccgccacagcagcatccaggagtag

SEQ ID NO: 20121 - DNA, 1497 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggcccccgggacatgccaccccagccctacaagatctatgaggtgtgcagcaatggacctgcccccacagacagccagcccccagaggactacagctttggagctggggaggaggaggaggaggaggaggagctgcagaggatgctgcccagcctgagcctgacagaagatgtgaagtggccacccaccctgcagccccccaccctgcggccccccaccctgcagccccccaccctgcagccccctgtggtgctgggccccccagccccagaccccagccccctggcccctcctcctggcaacccagctggcttccgggagctgctgtctgaggtgctggagcccggccccctgcctgccagcctgcccccagctggggagcagctgctgcctgacctgctgatcagcccccacatgctgcccctgacagacctggagatcaagttccagtaccggggccggcccccccgggccctgaccatcagcaacccccacggctgccgcctcttctacagccagctggaggccacccaggagcaggtggagctgtttggccccatcagcctggagcaggtgcgcttccccagccctgaggacatccccagcgacaagcagcgcttctacaccaaccagctgctggatgtgctggaccggggcctcatcctgcagctgcagggccaggacctgtatgccatccggctgtgccagtgcaaggtgttctggagcggcccctgtgccagcgcccatgacagctgccccaaccccatccagcgggaggtgaagaccaagctgttcagcctggagcacttcctgaatgaactcatcctcttccagaagggccagaccaacaccccacctccatttgagatcttcttctgctttggagaggagtggccagacaggaagccccgggagaagaagctgatcaccgtgcaggtggtgcctgtggccgcccggctgctgctggagatgttttctggagagctgtcctggagcgctgacagcatccggctgcagatcagcaacccagacctgaaggacaggatggtggagcagttcaaggagctgcaccacatctggcagagccagcagaggctgcagcctgtggcccaggcccctcctggagctggcctgggcgtgggccagggcccctggcccatgcaccctgctggcatgcagtag

SEQ ID NO: 20122 - DNA, 1545 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggcccccgggacatgccaccccagccctacaagatctatgaggtgtgcagcaatggacctgcccccacagacagccagcccccagaggactacagctttggagctggggaggaggaggaggaggaggaggagctgcagaggatgctgcccagcctgagcctgacagatgctgtgcagagcggcccccacatgaccccctacagcctgctgaaggaggatgtgaagtggccacccaccctgcagccccccaccctgcggccccccaccctgcagccccccaccctgcagccccctgtggtgctgggccccccagccccagaccccagccccctggcccctcctcctggcaacccagctggcttccgggagctgctgtctgaggtgctggagcccggccccctgcctgccagcctgcccccagctggggagcagctgctgcctgacctgctgatcagcccccacatgctgcccctgacagacctggagatcaagttccagtaccggggccggcccccccgggccctgaccatcagcaacccccacggctgccgcctcttctacagccagctggaggccacccaggagcaggtggagctgtttggccccatcagcctggagcaggtgcgcttccccagccctgaggacatccccagcgacaagcagcgcttctacaccaaccagctgctggatgtgctggaccggggcctcatcctgcagctgcagggccaggacctgtatgccatccggctgtgccagtgcaaggtgttctggagcggcccctgtgccagcgcccatgacagctgccccaaccccatccagcgggaggtgaagaccaagctgttcagcctggagcacttcctgaatgaactcatcctcttccagaagggccagaccaacaccccacctccatttgagatcttcttctgctttggagaggagtggccagacaggaagccccgggagaagaagctgatcaccgtgcaggtggtgcctgtggccgcccggctgctgctggagatgttttctggagagctgtcctggagcgctgacagcatccggctgcagatcagcaacccagacctgaaggacaggatggtggagcagttcaaggagctgcaccacatctggcagagccagcagaggctgcagcctgtggcccaggcccctcctggagctggcctgggcgtgggccagggcccctggcccatgcaccctgctggcatgcagtag

SEQ ID NO: 20123 - DNA, 1497 bp, Artificial Sequence; identical to SEQ ID NO: 20121
  Description of Artificial Sequence: Synthetic coding sequence

SEQ ID NO: 20124 - DNA, 1467 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggcccccgggacatgccaccccagccctacaagatctatgaggtgtgcagcaatggacctgcccccacagacagccagcccccagaggactacagctttggagctggggaggaggaggaggaggaggaggagctgcagaggatgctgcccagcctgagcctgacagaagatgtgaagtggccacccaccctgcagccccccaccctgcagccccctgtggtgctgggccccccagccccagaccccagccccctggcccctcctcctggcaacccagctggcttccgggagctgctgtctgaggtgctggagcccggccccctgcctgccagcctgcccccagctggggagcagctgctgcctgacctgctgatcagcccccacatgctgcccctgacagacctggagatcaagttccagtaccggggccggcccccccgggccctgaccatcagcaacccccacggctgccgcctcttctacagccagctggaggccacccaggagcaggtggagctgtttggccccatcagcctggagcaggtgcgcttccccagccctgaggacatccccagcgacaagcagcgcttctacaccaaccagctgctggatgtgctggaccggggcctcatcctgcagctgcagggccaggacctgtatgccatccggctgtgccagtgcaaggtgttctggagcggcccctgtgccagcgcccatgacagctgccccaaccccatccagcgggaggtgaagaccaagctgttcagcctggagcacttcctgaatgaactcatcctcttccagaagggccagaccaacaccccacctccatttgagatcttcttctgctttggagaggagtggccagacaggaagccccgggagaagaagctgatcaccgtgcaggtggtgcctgtggccgcccggctgctgctggagatgttttctggagagctgtcctggagcgctgacagcatccggctgcagatcagcaacccagacctgaaggacaggatggtggagcagttcaaggagctgcaccacatctggcagagccagcagaggctgcagcctgtggcccaggcccctcctggagctggcctgggcgtgggccagggcccctggcccatgcaccctgctggcatgcagtag

SEQ ID NO: 20125 - DNA, 684 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggcccccgggacatgccaccccagccctacaagatctatgaggtgtgcagcaatggacctgcccccacagacagccagcccccagaggactacagctttggagctggggaggaggaggaggaggaggaggagaggatgagcagcggccggcccctgtgcagccggcccctgtgtggccgcctgctgtgcagccggcccctgtgcagccggccctggtgctgggtgcccctgctgcagaccccagccccctggctgctgcccctggccaccctgctggccagcggcagcttcagcctgcgctcctggagcctgggcccctgcctgcctgcctgccccctgcaggccaacagcagctgccagacctgctag

SEQ ID NO: 20126 - DNA, 474 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggcccccgggacatgccaccccagccctacaagatctatgaggtgtgcagcaatggacctgcccccacagacagccagcccccagaggactacagctttggagctggggaggaggaggaggaggaggaggagatgcagtgcagcctggcccccacctag

SEQ ID NO: 20127 - DNA, 321 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggatag

SEQ ID NO: 20128 - DNA, 180 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggacggctag

SEQ ID NO: 20129 - DNA, 1497 bp, Artificial Sequence; identical to SEQ ID NO: 20121
  Description of Artificial Sequence: Synthetic coding sequence

SEQ ID NO: 20130 - DNA, 426 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggcccccgggacatgccaccccagccctacaagatctatgaggtgtgcagcaatggacctgcccccacagacagccagcccccagaggactacagctttggagctggatag

SEQ ID NO: 20131 - DNA, 459 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggcccccgggacatgccaccccagccctacaagatctatgaggtgtgcagcaatggacctgcccccacagacagccagcccccagaggactacagctttggagctggggaggaggaggaggaggaggaggaggtgtctgtgtag

SEQ ID NO: 20132 - DNA, 1239 bp, Artificial Sequence
  Description of Artificial Sequence: Synthetic coding sequence
atgaaccagagcatccctgtggcccccaccccaccaagaagagtgcggctgaagccctggctggtggcccaggtgaacagctgccagtacccaggcctgcagtgggtgaatggagagaagaagctgttctgcatcccctggaggcatgccaccaggcatggccccagccaggatggagacaacaccatcttcaaggcctgggccaaggagaccgggaagtacacagaaggagtggatgaagctgaccctgccaagtggaaggccaacctgcgctgtgccctgaacaagagccgggacttccgcctcatctatgatggcccccgggacatgccaccccagccctacaagatctatgaggtgtgcagcaatggacctgcccccacagacagccagcccccagaggactacagctttggagctggggaggaggaggaggaggaggaggagctgcagaggatgctgcccagcctgagcctgactgtgacagacctggagatcaagttccagtaccggggccggcccccccgggccctgaccatcagcaacccccacggctgccgcctcttctacagccagctggaggccacccaggagcaggtggagctgtttggccccatcagcctggagcaggtgcgcttccccagccctgaggacatccccagcgacaagcagcgcttctacaccaaccagctgctggatgtgctggaccggggcctcatcctgcagctgcagggccaggacctgtatgccatccggctgtgccagtgcaaggtgttctggagcggcccctgtgccagcgcccatgacagctgccccaaccccatccagcgggaggtgaagaccaagctgttcagcctggagcacttcctgaatgaactcatcctcttccagaagggccagaccaacaccccacctccatttgagatcttcttctgctttggagaggagtggccagacaggaagccccgggagaagaagctgatcaccgtgcaggtggtgcctgtggccgcccggctgctgctggagatgttttctggagagctgtcctggagcgctgacagcatccggctgcagatcagcaacccagacctgaaggacaggatggtggagcagttcaaggagctgcaccacatctggcagagccagcagaggctgcagcctgtggcccaggcccctcctggagctggcctgggcgtgggccagggcccctggcccatgcaccctgctggcatgcagtag

SEQ ID NO: 20133 - DNA, 570 bp, Artificial Sequence
  Description of Artificial Sequence: Synthetic coding sequence
atggccagcccctttgccctgctgatggtgctggtggtgctgagctgcaagagcagctgcagcctgggctgtgacctgcctgagacccacagcctggacaacagaaggaccctgatgctgctggcccagatgagccgcatcagccccagcagctgcctgatggacagacatgactttggcttcccccaggaggagtttgatggcaaccagttccagaaggccccagccatctctgtgctgcacgagctgatccagcagatcttcaacctcttcaccaccaaggacagcagcgctgcctgggatgaggacctgctggacaagttctgcacagagctgtaccagcagctgaatgacctggaggcctgtgtgatgcaggaggagcgggtgggggagacccccctgatgaatgctgacagcatcctggccgtgaagaagtacttccgccgcatcaccctgtacctgacagagaagaagtacagcccctgtgcctgggaggtggtgcgggcagagatcatgaggagcctgagcctgagcaccaacctgcaggagcggctgcggaggaaggagtag

SEQ ID NO: 20134 - DNA, 516 bp, Artificial Sequence
  Description of Artificial Sequence: Synthetic coding sequence
atgctggtgaacttcatcctgcgctgtggcctgctgctggtgaccctgagcctggccatcgccaagcacaagcagagcagcttcaccaagagctgctacccccggggcaccctgagccaggccgtggatgccctgtacatcaaggccgcctggctgaaggccaccatccctgaggaccgcatcaagaacatccggctgctgaagaagaagaccaagaagcagttcatgaagaactgccagttccaggagcagctgctgtccttcttcatggaggatgtgtttggccagctgcagctgcagggctgcaagaagatccgctttgtggaggacttccacagcctgcggcagaagctgagccactgcatcagctgtgccagcagcgcccgggagatgaagagcatcaccaggatgaagaggatcttctaccgcatcggcaacaagggcatctacaaggccatcagcgagctggacatcctgctgtcctggatcaagaagctgctggagagcagccagtag

SEQ ID NO: 20135 - DNA, 543 bp, Artificial Sequence
  Description of Artificial Sequence: Synthetic coding sequence
atggccctggccgacctgtatgaggagggcggcggcggcggcggggagggggaggacaatgctgacagcaaggagaccatctgccggcccagcggcaggaagagcagcaagatgcaggccttccgcatctgggatgtgaaccagaagaccttctacctgaggaacaaccagctggtggccggctacctgcagggccccaacgtgaacctggaggagaagattgatgtggtgcccatcgagccccacgccctcttcctgggcatccatggaggcaagatgtgcctgagctgtgtgaagtctggagatgagacccggctgcagctggaggccgtgaacatcacagacctgtctgagaacaggaagcaggacaagagatttgccttcatccgcagtgacagcggccccaccaccagctttgaatctgctgcctgccccggctggttcctgtgcacagccatggaggccgaccagcctgtgtccctgaccaacatgccagatgagggcgtgatggtgaccaagttctacttccaggaggatgaatag

SEQ ID NO: 20136 - DNA, 480 bp, Artificial Sequence
  Description of Artificial Sequence: Synthetic coding sequence
atggccctggagaccatctgccggcccagcggcaggaagagcagcaagatgcaggccttccgcatctgggatgtgaaccagaagaccttctacctgaggaacaaccagctggtggccggctacctgcagggccccaacgtgaacctggaggagaagattgatgtggtgcccatcgagccccacgccctcttcctgggcatccacggcggcaagatgtgcctgagctgtgtgaagtctggagatgagacccggctgcagctggaggccgtgaacatcacagacctgtctgaaaataggaagcaggacaagagatttgccttcatccgcagtgacagcggccccaccaccagctttgagagcgctgcctgccccggctggttcctgtgcacagccatggaggccgaccagcctgtgtccctgaccaacatgccagatgaaggagtgatggtgaccaagttctacttccaggaggatgaatag

SEQ ID NO: 20137 - DNA, 534 bp, Artificial Sequence
  Description of Artificial Sequence: Synthetic coding sequence
atggagatctgccggggcctgcggagccacctgatcaccctgctgctcttcctgttccacagcgagaccatctgccggcccagcggcaggaagagcagcaagatgcaggccttccgcatctgggatgtgaaccagaagaccttctacctgaggaacaaccagctggtggccggctacctgcagggccccaacgtgaacctggaggagaagattgatgtggtgcccatcgagccccacgccctcttcctgggcatccacggcggcaagatgtgcctgagctgtgtgaagtctggagatgagacccggctgcagctggaggccgtgaacatcacagacctgtctgaaaataggaagcaggacaagagatttgccttcatccgcagtgacagcggccccaccaccagctttgagagcgctgcctgccccggctggttcctgtgcacagccatggaggccgaccagcctgtgtccctgaccaacatgccagatgaaggagtgatggtgaccaagttctacttccaggaggatgaatag

SEQ ID NO: 20138 - DNA, 432 bp, Artificial Sequence
  Description of Artificial Sequence: Synthetic coding sequence
atgcaggccttccgcatctgggatgtgaaccagaagaccttctacctgaggaacaaccagctggtggccggctacctgcagggccccaacgtgaacctggaggagaagattgatgtggtgcccatcgagccccacgccctcttcctgggcatccacggcggcaagatgtgcctgagctgtgtgaagtctggagatgagacccggctgcagctggaggccgtgaacatcacagacctgtctgaaaataggaagcaggacaagagatttgccttcatccgcagtgacagcggccccaccaccagctttgagagcgctgcctgccccggctggttcctgtgcacagccatggaggccgaccagcctgtgtccctgaccaacatgccagatgaaggagtgatggtgaccaagttctacttccaggaggatgaatag

SEQ ID NO: 20139 - DNA, 1470 bp, Artificial Sequence
  Description of Artificial Sequence: Synthetic coding sequence
atggagcccggcctggagcacgccctgcggaggacccccagctggagcagcctgggcggcagcgagcaccaggagatgtccttcctggagcaggagaacagcagctcctggcccagccctgctgtgaccagcagcagcgagcgcatccggggcaagagaagagccaaggccctgcgctggacccggcagaagtctgtggaggagggggagcccccaggccagggcgagggccccaggagcaggcctgctgctgagagcacaggcctggaggccaccttccccaagaccacccccctggcccaggccgaccctgctggggtgggcaccccacccaccggctgggactgcctgcccagcgactgcacagccagcgctgctggcagcagcacagatgatgtggagctggccacagagttccctgccacagaggcctgggagtgtgagctggagggcctgctggaggagaggcctgccctgtgcctgagcccccaggcccccttccccaagctgggctgggatgatgagctgaggaagccaggggcccagatctacatgaggttcatgcaggagcacacctgctatgatgccatggccaccagcagcaagctggtgatctttgacaccatgctggagatcaagaaggccttctttgccctggtggccaacggggtgcgggccgcccccctgtgggacagcaagaagcagagctttgtgggcatgctgaccatcacagacttcatcctggtgctgcaccgctactaccgcagccccctggtgcagatctatgaaattgagcagcacaagattgagacctggagggagatctacctgcagggctgcttcaagcccctggtgtccatcagccccaatgacagcctgtttgaggccgtgtacaccctcatcaagaaccgcatccaccggctgcctgtgctggaccctgtgtctggaaatgtgctgcacatcctgacccacaagaggctgctgaagttcctgcacatcttcggcagcctgctgccccggcccagcttcctgtaccgcaccatccaggacctgggcatcggcaccttccgggacctggccgtggtgctggagacagcccccatcctgacagccctggacatctttgtggaccggcgggtgtctgccctgcctgtggtgaatgaatgtggccaggtggtgggcctgtacagcagatttgatgtgatccacctggccgcccagcagacctacaaccacctggacatgtctgtgggggaggccctgcggcagaggaccctgtgcctggagggcgtgctgagctgccagccccatgagagcctgggggaggtgattgacagaattgcccgggagcaggtgcaccggctggtgctggtggatgagacccagcacctgctgggcgtggtgtccctgagtgacatcctgcaggccctggtgctgagccctgctggcattgatgccctgggcgcctag

SEQ ID NO: 20140 - DNA, 1710 bp, Artificial Sequence
  Description of Artificial Sequence: Synthetic coding sequence
atgaaggtgctgctgcggctcatctgcttcatcgccctgctgatcagcagcctggaggccgacaagtgcaaggagcgggaggagaagatcatcctggtgtcctctgccaatgaaattgatgtgcggccctgccccctgaaccccaatgagcacaagggcaccatcacctggtacaaggatgacagcaagacccctgtgtccacagagcaggccagccgcatccaccagcacaaggagaagctgtggtttgtgcctgccaaggtggaggacagcggccactactactgtgtggtgaggaacagcagctactgcctgcgcatcaagatcagcgccaagtttgtggagaatgagcccaacctgtgctacaatgcccaggccatcttcaagcagaagctgcctgtggccggagatggcggcctggtgtgcccctacatggagttcttcaagaatgaaaataatgagctgcccaagctgcagtggtacaaggactgcaagcccctgctgctggacaacatccacttctctggagtgaaggacaggctcatcgtgatgaatgtggccgagaagcaccggggcaactacacctgccacgccagctacacctacctgggcaagcagtaccccatcaccagggtgattgagttcatcaccctggaggagaacaagcccaccaggcctgtgattgtgtccccagccaatgagaccatggaggtggacctgggcagccagatccagctgatctgcaatgtgacaggccagctgagtgacatcgcctactggaagtggaatggatctgtgattgatgaagatgatcctgtgctgggggaggactactacagcgtggagaacccagccaacaagaggaggagcaccctcatcaccgtgctgaacatcagcgagattgagagccgcttctacaagcaccccttcacctgctttgccaagaacacccacggcattgatgctgcctacatccagctgatctaccctgtgaccaacttccagaagcacatgattggcatctgtgtgaccctgaccgtcatcatcgtgtgcagcgtcttcatctacaagatcttcaagattgatattgtgctgtggtacagagacagctgctatgacttcctgcccatcaaggccagtgatggcaagacctatgatgcctacatcctgtaccccaagacagtgggggagggcagcaccagtgactgtgacatctttgtgttcaaggtgctgcctgaggtgctggagaagcagtgtggctacaagctgttcatctacggcagagatgattatgtgggggaggacatcgtggaggtgatcaatgaaaatgtgaagaagagccggcggctcatcatcatcctggtgcgggagaccagcggcttctcctggctgggcggcagcagcgaggagcagatcgccatgtacaatgccctggtgcaggacggcatcaaggtggtgctgctggagctggagaagatccaggactatgagaagatgcctgagagcatcaagttcatcaagcagaagcacggggccatccgctggagcggggacttcacccagggcccccagagcgccaagacccgcttctggaagaatgtgcgctaccacatgcctgtgcagaggaggagccccagcagcaagcaccagctgctgagccctgccaccaaggagaagctgcagcgggaggcccacgtgcccctgggctag

SEQ ID NO: 20141 - DNA, 549 bp, Artificial Sequence
  Description of Artificial Sequence: Synthetic coding sequence
atgaaggtgctgctgcggctcatctgcttcatcgccctgctgatcagcagcctggaggccgacaagtgcaaggagcgggaggagaagatcatcctggtgtcctctgccaatgaaattgatgtgcggccctgccccctgaaccccaatgagcacaagggcaccatcacctggtacaaggatgacagcaagacccctgtgtccacagagcaggccagccgcatccaccagcacaaggagaagctgtggtttgtgcctgccaaggtggaggacagcggccactactactgtgtggtgaggaacagcagctactgcctgcgcatcaagatcagcgccaagtttgtggagaatgagcccaacctgtgctacaatgcccaggccatcttcaagcagaagctgcctgtggccggagatggcggcctggtgtgcccctacatggagttcttcaagaatgaaaataatgagctgcccaagctgcagtggtacaaggactgcaagcccctgctgctggacaacatccacttctctggagtgaaggacaggctcatctag

SEQ ID NO: 20142 - DNA, 345 bp, Artificial Sequence
  Description of Artificial Sequence: Synthetic coding sequence
atgaaggtgctgctgcggctcatctgcttcatcgccctgctgatcagcagcctggaggccgacaagtgcaaggagcgggaggagaagatcatcctggtgtcctctgccaatgaaattgatgtgcggccctgccccctgaaccccaatgagcacaagggcaccatcacctggtacaaggatgacagcaagacccctgtgtccacagagcaggccagccgcatccaccagcacaaggagaagctgtggtttgtgcctgccaaggtggaggacagcggccactactactgtgtggtgaggaacagcagctactgcctgcgcatcaagatcagcgccaagtttgtgtag

SEQ ID NO: 20143 - DNA, 321 bp, Artificial Sequence
  Description of Artificial Sequence: Synthetic coding sequence
atgaaggtgctgctgcggctcatctgcttcatcgccctgctgatcagcagcctggaggccgacaagtgcaaggagcgggaggagaagatcatcctggtgtcctctgccaatgaaattgatgtgcggccctgccccctgaaccccaatgagcacaagggcaccatcacctggtacaaggatgacagcaagacccctgtgtccacagagcaggccagccgcatccaccagcacaaggagaagctgtggtttgtgcctgccaaggtggaggacagcggccactactactgtgtggtgaggaacagcagctactgcctgaggtag

SEQ ID NO: 20144 - DNA, 243 bp, Artificial Sequence
  Description of Artificial Sequence: Synthetic coding sequence
atgaaggtgctgctgcggctcatctgcttcatcgccctgctgatcagcagcctggaggccgacaagtgcaaggagcgggaggagaagatcatcctggtgtcctctgccaatgaaattgatgtgcggccctgccccctgaaccccaatgagcacaagggcaccatcacctggtacaaggatgacagcaagacccctgtgtccacagagcaggccagccgcatccaccagcacaaggagaagtag

SEQ ID NO: 20145 - DNA, 810 bp, Artificial Sequence
  Description of Artificial Sequence: Synthetic coding sequence
atggccgaggtgcctgagctggccagcgagatgatggcctactacagcggaaatgaagatgacctcttctttgaagcagatggccccaagcagatgaagtgcagcttccaggacctggacctgtgccccctggatggcggcatccagctgcgcatcagtgaccaccactacagcaagggcttccggcaggccgcctctgtggtggtggccatggacaagctgaggaagatgctggtgccctgcccccagaccttccaggagaatgacctgagcaccttcttccccttcatctttgaggaggagcccatcttctttgacacctgggacaatgaggcctacgtgcatgatgcccctgtgcgcagcctgaactgcaccctgcgggacagccagcagaagagcctggtgatgagcggcccctatgagctgaaggccctgcacctgcagggccaggacatggagcagcaggtggtgttctccatgagctttgtgcagggcgaggagagcaatgacaagatccctgtggccctgggcctgaaggagaagaacctgtacctgagctgtgtgctgaaggatgacaagcccaccctgcagctggagagcgtggaccccaagaactaccccaagaagaagatggagaagagatttgtgttcaacaagattgagatcaacaacaagctggagtttgagagcgcccagttccccaactggtacatcagcaccagccaggccgagaacatgcctgtgttcctgggcggcaccaagggcggccaggacatcacagacttcaccatgcagtttgtgagcagctag

SEQ ID NO: 20146 - DNA, 336 bp, Artificial Sequence
  Description of Artificial Sequence: Synthetic coding sequence
atggccgaggtgcctgagctggccagcgagatgatggcctactacagcggaaatgaagatgacctcttctttgaagcagatggccccaagcagatgaagtgcagcttccaggacctggacctgtgccccctggatggcggcatccagctgcgcatcagtgaccaccactacagcaagggcttccggcaggccgcctctgtggtggtggccatggacaagctgaggaagatgctggtgccctgcccccagaccttccaggagaatgacctgagcaccttcttccccttcatctttgaggaggagcccatcttctttgacacctgggacaatgaatag

SEQ ID NO: 20147 - DNA, 432 bp, Artificial Sequence
  Description of Artificial Sequence: Synthetic coding sequence
atggccgaggtgcctgagctggccagcgagatgatggcctactacagcggaaatgaagatgacctcttctttgaagcagatggccccaagcagatgaagtgcagcttccaggacctggacctgtgccccctggatggcggcatccagctgcgcatcagtgaccaccactacagcaagggcttccggcaggccgcctctgtggtggtggccatggacaagctgaggaagatgctggtgccctgcccccagaccttccaggagaatgacctgagcaccttcttccccttcatctttgaggaggagcccatcttctttgacacctgggacaatgaggcctacgtgcatgatgcccctgtgcgcagcctgaactgcaccctgcgggacagccagcagaagagcctggtgatgagcggcccctatgagctgaagtag

SEQ ID NO: 20148 - DNA, 378 bp, Artificial Sequence
  Description of Artificial Sequence: Synthetic coding sequence
atggccgaggtgcctgagctggccagcgagatgatggcctactacagcggaaatgaagatgacctcttctttgaagcagatggccccaagcagatgaagtgcagcttccaggacctggacctgtgccccctggatggcggcatccagctgcgcatcagtgaccaccactacagcaagggcttccggcaggccgcctctgtggtggtggccatggacaagctgaggaagatgctggtgccctgcccccagaccttccaggagaatgacctgagcaccttcttccccttcatctttgaggaggagcccatcttctttgacacctgggacaatgaggcctacgtgcatgatgcccctgtgcgcagcctgaactgcacctag

SEQ ID NO: 20149 - DNA, 762 bp, Artificial Sequence
  Description of Artificial Sequence: Synthetic coding sequence
atgtggcccccaggcagcgccagccagcccccacccagccctgctgctgccaccggcctgcaccctgctgcccggcctgtgtccctgcagtgccgcctgtccatgtgcccagcccggagcctgctgctggtggccaccctggtgctgctggaccacctgagcctggccaggaacctgcctgtggccaccccagaccccggcatgttcccctgcctgcaccacagccagaacctgctgcgggctgtgagcaacatgctgcagaaggcccggcagaccctggagttctacccctgcaccagcgaggagattgaccacgaggacatcaccaaggacaagaccagcacagtggaggcctgcctgcccctggagctgaccaagaatgaaagctgcctgaacagccgggagaccagcttcatcaccaacggcagctgcctggccagcaggaagaccagcttcatgatggccctgtgcctgagcagcatctatgaggacctgaagatgtaccaggtggagttcaagaccatgaatgccaagctgctgatggaccccaagaggcagatcttcctggaccagaacatgctggccgtgattgatgagctgatgcaggccctgaacttcaacagcgagaccgtgccccagaagagcagcctggaggagccagacttctacaagaccaagatcaagctgtgcatcctgctgcacgccttccgcatccgggctgtgaccatcgacagagtgatgagctacctgaatgccagctag

SEQ ID NO: 20150 - DNA, 720 bp, Artificial Sequence
  Description of Artificial Sequence: Synthetic coding sequence
atgtggcccccaggcagcgccagccagcccccacccagccctgctgctgccaccggcctgcaccctgctgcccggcctgtgtccctgcagtgccgcctgtccatgtgcccagcccggagcctgctgctggtggccaccctggtgctgctggaccacctgagcctggccaggaacctgcctgtggccaccccagaccccggcatgttcccctgcctgcaccacagccagaacctgctgcgggctgtgagcaacatgctgcagaaggcccggcagaccctggagttctacccctgcaccagcgaggagattgaccacgaggacatcaccaaggacaagaccagcacagtggaggcctgcctgcccctggagctgaccaagaatggcagctgcctggccagcaggaagaccagcttcatgatggccctgtgcctgagcagcatctatgaggacctgaagatgtaccaggtggagttcaagaccatgaatgccaagctgctgatggaccccaagaggcagatcttcctggaccagaacatgctggccgtgattgatgagctgatgcaggccctgaacttcaacagcgagaccgtgccccagaagagcagcctggaggagccagacttctacaagaccaagatcaagctgtgcatcctgctgcacgccttccgcatccgggctgtgaccatcgacagagtgatgagctacctgaatgccagctag

SEQ ID NO: 20151 - DNA, 648 bp, Artificial Sequence
  Description of Artificial Sequence: Synthetic coding sequence
atgtggcccccaggcagcgccagccagcccccacccagccctgctgctgccaccggcctgcaccctgctgcccggcctgtgtccctgcagtgccgcctgtccatgtgcccagcccggagcctgctgctggtggccaccctggtgctgctggaccacctgagcctggccaggaacctgcctgtggccaccccagaccccggcatgttcccctgcctgcaccacagccagaacctgctgcgggctgtgagcaacatgctgcagaagaatgaaagctgcctgaacagccgggagaccagcttcatcaccaacggcagctgcctggccagcaggaagaccagcttcatgatggccctgtgcctgagcagcatctatgaggacctgaagatgtaccaggtggagttcaagaccatgaatgccaagctgctgatggaccccaagaggcagatcttcctggaccagaacatgctggccgtgattgatgagctgatgcaggccctgaacttcaacagcgagaccgtgccccagaagagcagcctggaggagccagacttctacaagaccaagatcaagctgtgcatcctgctgcacgccttccgcatccgggctgtgaccatcgacagagtgatgagctacctgaatgccagctag

SEQ ID NO: 20152 - DNA, 489 bp, Artificial Sequence
  Description of Artificial Sequence: Synthetic coding sequence
atgaggatcagcaagccccacctgcggagcatcagcatccagtgctacctgtgcctgctgctgaacagccacttcctgacagaagctggcatccacgtgttcatcctgggctgcttctctgctggcctgcccaagacagaggccaactgggtgaatgtcatcagtgacctgaagaagattgaagatctcatccagagcatgcacattgatgccaccctgtacacagaaagtgatgtgcaccccagctgcaaggtgacagccatgaagtgcttcctgctggagctgcaggtgatcagcctggagagcggagatgccagcatccatgacacagtggagaacctgatcatcctggccaacaacagcctgagcagcaatggaaatgtgacagaaagtggctgcaaggaatgtgaggagctggaggagaagaacatcaaggagttcctgcagagctttgtgcacatcgtgcagatgttcatcaacaccagctag

SEQ ID NO: 20153 - DNA, 489 bp, Artificial Sequence; identical to SEQ ID NO: 20152
  Description of Artificial Sequence: Synthetic coding sequence

SEQ ID NO: 20154 - DNA, 408 bp, Artificial Sequence
  Description of Artificial Sequence: Synthetic coding sequence
atggtgctgggcaccatcgacctgtgcagctgcttctctgctggcctgcccaagacagaggccaactgggtgaatgtcatcagtgacctgaagaagattgaggacctgatccagagcatgcacattgatgccaccctgtacacagaaagtgatgtgcaccccagctgcaaggtgacagccatgaagtgcttcctgctggagctgcaggtgatcagcctggagagcggagatgccagcatccatgacacagtggagaacctgatcatcctggccaacaacagcctgagcagcaatggaaatgtgacagagagcggctgcaaggaatgtgaggagctggaggagaagaacatcaaggagttcctgcagagctttgtgcacatcgtgcagatgttcatcaacaccagctag

SEQ ID NO: 20155 - DNA, 408 bp, Artificial Sequence; identical to SEQ ID NO: 20154
  Description of Artificial Sequence: Synthetic coding sequence

SEQ ID NO: 20156 - DNA, 408 bp, Artificial Sequence; identical to SEQ ID NO: 20154
  Description of Artificial Sequence: Synthetic coding sequence

SEQ ID NO: 20157 - DNA, 489 bp, Artificial Sequence; identical to SEQ ID NO: 20152
  Description of Artificial Sequence: Synthetic coding sequence

SEQ ID NO: 20158 - DNA, 582 bp, Artificial Sequence
  Description of Artificial Sequence: Synthetic coding sequence
atggctgctgagcctgtggaggacaactgcatcaactttgtggccatgaagttcatcgacaacaccctgtacttcatcgccgaggatgatgagaacctggagagtgactactttgggaagctggagagcaagctgagcgtcatccggaacctgaatgaccaggtgctcttcatcgaccagggcaaccggcccctgtttgaggacatgacagacagcgactgccgggacaatgcccccaggaccatcttcatcatctccatgtacaaggacagccagccccggggcatggctgtgaccatctctgtgaagtgtgagaagatcagcaccctgagctgtgagaacaagatcatctccttcaaggagatgaaccccccagacaacatcaaggacaccaagagtgacatcatcttcttccagaggtctgtgcccggccatgacaacaagatgcagtttgagagcagcagctatgagggctacttcctggcctgtgagaaggagcgggacctcttcaagctgatcctgaagaaggaggatgagctgggggacaggagcatcatgttcaccgtgcagaatgaagattag

SEQ ID NO: 20159 - DNA, 570 bp, Artificial Sequence
  Description of Artificial Sequence: Synthetic coding sequence
atggctgctgagcctgtggaggacaactgcatcaactttgtggccatgaagttcatcgacaacaccctgtacttcatcgagaacctggagagtgactactttgggaagctggagagcaagctgagcgtcatccggaacctgaatgaccaggtgctcttcatcgaccagggcaaccggcccctgtttgaggacatgacagacagcgactgccgggacaatgcccccaggaccatcttcatcatctccatgtacaaggacagccagccccggggcatggctgtgaccatctctgtgaagtgtgagaagatcagcaccctgagctgtgagaacaagatcatctccttcaaggagatgaaccccccagacaacatcaaggacaccaagagtgacatcatcttcttccagaggtctgtgcccggccatgacaacaagatgcagtttgagagcagcagctatgagggctacttcctggcctgtgagaaggagcgggacctcttcaagctgatcctgaagaaggaggatgagctgggggacaggagcatcatgttcaccgtgcagaatgaagattag

SEQ ID NO: 20160 - DNA, 582 bp, Artificial Sequence; identical to SEQ ID NO: 20158
  Description of Artificial Sequence: Synthetic coding sequence

SEQ ID NO: 20161 - DNA, 1782 bp, Artificial Sequence
  Description of Artificial Sequence: Synthetic coding sequence
atggagaccccacccctgcccccagcctgcaccaagcagggccaccagaagcccctggacagcaaggatgacaacacagagaagcactgccctgtgacagtgaacccctggcacatgaagaaggccttcaaggtgatgaatgagctgcggagccagaacctgctgtgtgatgtgaccatcgtggccgaggacatggagatcagcgcccaccgggtggtgctggccgcctgcagcccctacttccacgccatgttcaccggggagatgtctgagagccgggccaagagggtgcgcatcaaggaggtggatggctggaccctgaggatgctgattgattatgtgtacacagctgagatccaggtgacagaggagaatgtgcaggtgctgctgcctgctgctggcctgctgcagctgcaggatgtgaagaagacctgctgtgagttcctggagagccagctgcaccctgtgaactgcctgggcatccgggcctttgctgacatgcacgcctgcacagacctgctgaacaaggccaacacctatgcagagcagcactttgctgatgtggtgctgtctgaggagttcctgaacctgggcatcgagcaggtgtgcagcctcatcagcagtgacaagctgaccatcagcagcgaggagaaggtgtttgaggccgtcatcgcctgggtgaaccacgacaaggatgtgcggcaggagttcatggcccggctgatggagcacgtgcggctgcccctgctgccccgggagtacctggtgcagagggtggaggaggaggccctggtgaagaacagcagcgcctgcaaggactacctgattgaggccatgaagtaccacctgctgcccacagagcagaggatcctgatgaagtctgtgaggacccggctgcggacccccatgaacctgcccaagctgatggtggtggtgggcggccaggcccccaaggccatccgctctgtggagtgctatgacttcaaggaggagcgctggcaccaggtggccgagctgcccagccgccgctgccgggccggcatggtgtacatggccggcctggtgtttgctgtgggcggcttcaacggcagcctgcgggtgaggacagtggacagctatgaccctgtgaaggaccagtggacctctgtggccaacatgagggacagaagaagcaccctgggcgctgctgtgctgaatggcctgctgtatgctgtgggcggctttgatggcagcacaggcctgagctctgtggaggcctacaacatcaagagcaatgagtggttccacgtggcccccatgaacacccggcgcagctctgtgggcgtgggcgtggtgggcggcctgctgtatgctgtgggcggctatgatggagccagccggcagtgcctgagcacagtggagtgctacaatgccaccaccaatgagtggacctacatcgccgagatgagcaccaggagaagtggagctggggtgggcgtgctgaacaacctgctgtatgctgtgggcggccatgatggccccctggtgaggaagtctgtggaggtgtatgaccccaccaccaatgcctggaggcaggtggccgacatgaacatgtgcagaagaaatgctggggtgtgtgctgtgaatggcctgctgtatgtggtgggcggagatgatggcagctgcaacctggcctctgtggagtactacaaccccaccacagacaagtggacagtggtgagcagctgcatgagcacaggccgctcctatgctggggtgacagtgattgacaagcccctgtag

SEQ ID NO: 20162 - DNA, 1131 bp, Artificial Sequence
  Description of Artificial Sequence: Synthetic coding sequence
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagcagcttcagtgatgagctgtatgtggatgtgacctacatcgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcgacttcaccatgaatgacaccaccgtgtggatctctgtggccgtgctgtctgctgtgatctgcctgatcatcgtgtgggccgtggccctgaagggctacagcatggtgacctgcatcttcccccctgtgcccggccccaagatcaagggctttgatgcccacctgctggagaagggcaagtctgaggagctgctgagcgccctgggctgccaggacttcccccccaccagtgactatgaggacctgctggtggagtacctggaggtggatgacagcgaggaccagcacctgatgtctgtgcacagcaaggagcaccccagccagggcgaccccctgatgctgggcgccagccactacaagaacctgaagagctaccggcccaggaagatcagcagccagggccgcctggccgtgttcaccaaggccaccctgaccaccgtgcagtag

SEQ ID NO: 20163 - DNA, 414 bp, Artificial Sequence
  Description of Artificial Sequence: Synthetic coding sequence
atgggcctgaccagccagctgctgcccccactcttcttcctgctggcctgtgccggcaactttgtgcacggccacaagtgtgacatcaccctgcaggagatcatcaagaccctgaacagcctgacagagcagaagaacaccacagagaaggagaccttctgccgggccgccaccgtgctgcggcagttctacagccaccacgagaaggacacccgctgcctgggcgccacagcccagcagttccaccgccacaagcagctgatccgcttcctgaagaggctggacaggaacctgtggggcctggccggcctgaacagctgccctgtgaaggaggccaaccagagcaccctggagaacttcctggagcggctgaagaccatcatgagggagaagtacagcaagtgcagcagctag

SEQ ID NO: 20164 - DNA, 639 bp, Artificial Sequence
  Description of Artificial Sequence: Synthetic coding sequence
atgaacagcttcagcaccagcgcctttggacctgtggccttcagcctgggcctgctgctggtgctgcctgctgccttccctgcccctgtgcccccaggagaggacagcaaggatgtggccgccccccaccggcagcccctgaccagcagcgagagaattgacaagcagatccgctacatcctggatggcatcagcgccctgaggaaggagacctgcaacaagagcaacatgtgtgagagcagcaaggaggccctggccgagaacaacctgaacctgcccaagatggccgagaaggatggctgcttccagagcggcttcaatgaggagacctgcctggtgaagatcatcaccggcctgctggagtttgaggtgtacctggagtacctgcagaacagatttgagagcagcgaggagcaggcccgggctgtgcagatgagcaccaaggtgctgatccagttcctgcagaagaaggccaagaacctggatgccatcaccaccccagaccccaccaccaatgccagcctgctgaccaagctgcaggcccagaaccagtggctgcaggacatgaccacccacctgatcctgcgctccttcaaggagttcctgcagagcagcctgcgggccctgcggcagatgtag

SEQ ID NO: 20165 - DNA, 369 bp, Artificial Sequence
  Description of Artificial Sequence: Synthetic coding sequence
atgtgtgagagcagcaaggaggccctggccgagaacaacctgaacctgcccaagatggccgagaaggatggctgcttccagagcggcttcaatgaggagacctgcctggtgaagatcatcaccggcctgctggagtttgaggtgtacctggagtacctgcagaacagatttgagagcagcgaggagcaggcccgggctgtgcagatgagcaccaaggtgctgatccagttcctgcagaagaaggtgggcgtgagcagcttcccccagctgggcgtgggggaggaccggctgaaggacagcgtgctggacaacagcggcatgcagtgccacttccagaagaggcggctgcacgtgaacaagagggtgtag

SEQ ID NO: 20166 - DNA, 639 bp, Artificial Sequence; identical to SEQ ID NO: 20164
  Description of Artificial Sequence: Synthetic coding sequence

SEQ ID NO: 20167 - DNA, 597 bp, Artificial Sequence
  Description of Artificial Sequence: Synthetic coding sequence
atgaacagcttcagcaccagcgcctttggacctgtggccttcagcctgggcctgctgctggtgctgcctgctgccttccctgcccctgtgcccccaggagaggacagcaaggatgtggccgccccccaccggcagcccctgaccagcagcgagagaattgacaagcagatccgctacatcctggatggcatcagcgccctgaggaaggagacctgcaacaagagcaacatgtgtgagagcagcaaggaggccctggccgagaacaacctgaacctgcccaagatggccgagaaggatggctgcttccagagcggcttcaatgaggagacctgcctggtgaagatcatcaccggcctgctggagtttgaggtgtacctggagtacctgcagaacagatttgagagcagcgaggagcaggcccgggctgtgcagatgagcaccaaggtgctgatccagttcctgcagaagaaggtgggcgtgagcagcttcccccagctgggcgtgggggaggaccggctgaaggacagcgtgctggacaacagcggcatgcagtgccacttccagaagaggcggctgcacgtgaacaagagggtgtag

SEQ ID NO: 20168 - DNA, 759 bp, Artificial Sequence
  Description of Artificial Sequence: Synthetic coding sequence
atgaacagcttcagcaccagcaagtgcaggaagagcctggccctggagctgcctgctgctgtggagccctgtgtgcgggagggctgtgtggcccagggcggcctggccggcggccagcagcagaggcaggcccccagctgtgctgtgagcagccccctgcggagcctgcccagcggcaccggggcctttggacctgtggccttcagcctgggcctgctgctggtgctgcctgctgccttccctgcccctgtgcccccaggagaggacagcaaggatgtggccgccccccaccggcagcccctgaccagcagcgagagaattgacaagcagatccgctacatcctggatggcatcagcgccctgaggaaggagacctgcaacaagagcaacatgtgtgagagcagcaaggaggccctggccgagaacaacctgaacctgcccaagatggccgagaaggatggctgcttccagagcggcttcaatgaggagacctgcctggtgaagatcatcaccggcctgctggagtttgaggtgtacctggagtacctgcagaacagatttgagagcagcgaggagcaggcccgggctgtgcagatgagcaccaaggtgctgatccagttcctgcagaagaaggtgggcgtgagcagcttcccccagctgggcgtgggggaggaccggctgaaggacagcgtgctggacaacagcggcatgcagtgccacttccagaagaggcggctgcacgtgaacaagagggtgtag

SEQ ID NO: 20169 - DNA, 459 bp, Artificial Sequence
  Description of Artificial Sequence: Synthetic coding sequence
atgaacagcttcagcaccagcgcctttggacctgtggccttcagcctgggcctgctgctggtgctgcctgctgccttccctgcccctgtgcccccaggagaggacagcaaggatgtggccgccccccaccggcagcccctgaccagcagcgagagaattgacaagcagatccgctacatcctggatggcatcagcgccctgaggaaggagacctgcaacaagagcaacatgtgtgagagcagcaaggaggccctggccgagaacaacctgaacctgcccaagatggccgagaaggatggctgcttccagagcggcttcaatgaggagacctgcctggtgaagatcatcaccggcctgctggagtttgaggtgtacctggagtacctgcagaacagatttgagagcagcgaggagcaggcccgggctgtgcagatgagcaccaaggtgctgatccagtag

SEQ ID NO: 20170 - DNA, 300 bp, Artificial Sequence
  Description of Artificial Sequence: Synthetic coding sequence
atgaccagcaagctggccgtggccctgctggccgccttcctgatctctgctgccctgtgtgagggcgctgtgctgcccaggtctgccaaggagctgcgctgccagtgcatcaagacctacagcaagcccttccaccccaagttcatcaaggagctgcgggtgattgaaagtggcccccactgtgccaacacagagatcatcgtgaagctgagtgatggccgggagctgtgcctggaccccaaggagaactgggtgcagagggtggtggagaagttcctgaagagagctgagaacagctag

SEQ ID NO: 20171 - DNA, 2139 bp, Artificial Sequence
  Description of Artificial Sequence: Synthetic coding sequence
atggccggcggccctggccctggagagcctgctgcccctggggcccagcacttcctgtatgaggtgcccccctgggtgatgtgccgcttctacaaggtgatggatgccctggagcctgctgactggtgccagtttgctgccctgattgtgcgggaccagacagagctgcggctgtgtgagaggagcggccagaggacagcctctgtgctgtggccctggatcaacagaaatgcccgggtggccgacctggtgcacatcctgacccacctgcagctgctgcgggcccgggacatcatcacagcctggcaccccccagcccccctgcccagccctggcaccacagccccccggcccagcagcatcccagccccagctgaggccgaggcctggagccccaggaagctgcccagcagcgccagcaccttcctgagccctgccttccctggcagccagacccacagcggccctgagctgggcctggtgcccagccctgccagcctgtggcccccaccacccagccctgcccccagcagcaccaagccaggccctgagagctctgtgtccctgctgcagggcgcccggcccttccccttctgctggcccctgtgtgagatcagccggggcacccacaacttcagcgaggagctgaagatcggggagggcggcttcggctgtgtgtacagagctgtgatgaggaacacagtgtatgctgtgaagaggctgaaggaaaatgctgacctggagtggacagctgtgaagcagagcttcctgacagaggtggagcagctgagccgcttccgccaccccaacatcgtggactttgctggctactgtgcccagaatggcttctactgcctggtgtatggcttcctgcccaacggcagcctggaggaccggctgcactgccagacccaggcctgcccccccctgtcctggccccagaggctggacatcctgctgggcacagcccgggccatccagttcctgcaccaggacagccccagcctcatccacggggacatcaagagcagcaatgtgctgctggatgagcggctgacccccaagctgggggactttggcctggcccgcttcagcagatttgctggcagcagccccagccagagctccatggtggcccggacccagacagtgcggggcaccctggcctacctgcctgaggagtacatcaagacaggccgcctggccgtggacacagacaccttctcctttggagtggtggtgctggagaccctggccggccagagagctgtgaagacccatggagcccggaccaagtacctgaaggacctggtggaggaggaggccgaggaggccggcgtggccctgcggagcacccagagcaccctgcaggccggcctggccgcagatgcctgggccgcccccatcgccatgcagatctacaagaagcacctggacccccggcccggcccctgccccccagagctgggcctgggcctgggccagctggcctgctgctgcctgcacagaagagccaagagaagaccacccatgacccaggtgtatgagcggctggagaagctgcaggccgtggtggccggcgtgcccggccacagcgaggccgccagctgcatcccccccagcccccaggagaacagctatgtgagcagcacaggccgggcccacagcggggccgccccctggcagcccctggccgcccccagcggggccagcgcccaggccgctgagcagctgcagaggggccccaaccagcctgtggagagtgatgagagcctgggcggcctgtctgctgccctgcgctcctggcacctgacccccagctgccccctggaccctgcccccctgcgggaggccggctgcccccagggcgacacagctggggagagctcctggggcagcggccctggcagccggcccacagctgtggagggcctggccctgggcagcagcgccagcagcagcagcgagcccccccagatcatcatcaacccagcccggcagaagatggtgcagaagctggccctgtatgaagatggagccctggacagcctgcagctgctgagcagcagcagcctgcccggcctgggcctggagcaggaccggcagggccctgaggagagtgatgagttccagagctag

SEQ ID NO: 20172 - DNA, 2082 bp, Artificial Sequence
  Description of Artificial Sequence: Synthetic coding sequence
atggccggcggccctggccctggagagcctgctgcccctggggcccagcacttcctgtatgaggtgcccccctgggtgatgtgccgcttctacaaggtgatggatgccctggagcctgctgactggtgccagtttggaggctggaggagagctgctgggggccgggaggcccggggcctgctggcccccaccccagatgcccccaggcctgctgctgccctgattgtgcgggaccagacagagctgcggctgtgtgagaggagcggccagaggacagcctctgtgctgtggccctggatcaacagaaatgcccgggtggccgacctggtgcacatcctgacccacctgcagctgctgcgggcccgggacatcatcacagcctggcaccccccagcccccctgcccagccctggcaccacagccccccggcccagcagcatcccagccccagctgaggccgaggcctggagccccaggaagctgcccagcagcgccagcaccttcctgagccctgccttccctggcagccagacccacagcggccctgagctgggcctggtgcccagccctgccagcctgtggcccccaccacccagccctgcccccagcagcaccaagccaggccctgagagctctgtgtccctgctgcagggcgcccggcccttccccttctgctggcccctgtgtgagatcagccggggcacccacaacttcagcgaggagctgaagatcggggagggcggcttcggctgtgtgtacagagctgtgatgaggaacacagtgtatgctgtgaagaggctgaaggaaaatgctgacctggagtggacagctgtgaagcagagcttcctgacagaggtggagcagctgagccgcttccgccaccccaacatcgtggactttgctggctactgtgcccagaatggcttctactgcctggtgtatggcttcctgcccaacggcagcctggaggaccggctgcactgccagacccaggcctgcccccccctgtcctggccccagaggctggacatcctgctgggcacagcccgggccatccagttcctgcaccaggacagccccagcctcatccacggggacatcaagagcagcaatgtgctgctggatgagcggctgacccccaagctgggggactttggcctggcccgcttcagcagatttgctggcagcagccccagccagagctccatggtggcccggacccagacagtgcggggcaccctggcctacctgcctgaggagtacatcaagacaggccgcctggccgtggacacagacaccttctcctttggagtggtggtgctggagaccctggccggccagagagctgtgaagacccatggagcccggaccaagtacctgaaggacctggtggaggaggaggccgaggaggccggcgtggccctgcggagcacccagagcaccctgcaggccggcctggccgcagatgcctgggccgcccccatcgccatgcagatctacaagaagcacctgggccagctggcctgctgctgcctgcaccggcgggccaagaggcggccccccatgacccaggagaacagctatgtgagcagcacaggccgggcccacagcggggccgccccctggcagcccctggccgcccccagcggggccagcgcccaggccgctgagcagctgcagaggggccccaaccagcctgtggagagtgatgagagcctgggcggcctgtctgctgccctgcgctcctggcacctgacccccagctgccccctggaccctgcccccctgcgggaggccggctgcccccagggcgacacagctggggagagctcctggggcagcggccctggcagccggcccacagctgtggagggcctggccctgggcagcagcgccagcagcagcagcgagcccccccagatcatcatcaacccagcccggcagaagatggtgcagaagctggccctgtatgaagatggagccctggacagcctgcagctgctgagcagcagcagcctgcccggcctgggcctggagcaggaccggcagggccctgaggagagtgatgagttccagagctag

SEQ ID NO: 20173 - DNA, 2049 bp, Artificial Sequence
  Description of Artificial Sequence: Synthetic coding sequence
atggccggcggccctggccctggagagcctgctgcccctggggcccagcacttcctgtatgaggtgcccccctgggtgatgtgccgcttctacaaggtgatggatgccctggagcctgctgactggtgccagtttgctgccctgattgtgcgggaccagacagagctgcggctgtgtgagaggagcggccagaggacagcctctgtgctgtggccctggatcaacagaaatgcccgggtggccgacctggtgcacatcctgacccacctgcagctgctgcgggcccgggacatcatcacagcctggcaccccccagcccccctgcccagccctggcaccacagccccccggcccagcagcatcccagccccagctgaggccgaggcctggagccccaggaagctgcccagcagcgccagcaccttcctgagccctgccttccctggcagccagacccacagcggccctgagctgggcctggtgcccagccctgccagcctgtggcccccaccacccagccctgcccccagcagcaccaagccaggccctgagagctctgtgtccctgctgcagggcgcccggcccttccccttctgctggcccctgtgtgagatcagccggggcacccacaacttcagcgaggagctgaagatcggggagggcggcttcggctgtgtgtacagagctgtgatgaggaacacagtgtatgctgtgaagaggctgaaggaaaatgctgacctggagtggacagctgtgaagcagagcttcctgacagaggtggagcagctgagccgcttccgccaccccaacatcgtggactttgctggctactgtgcccagaatggcttctactgcctggtgtatggcttcctgcccaacggcagcctggaggaccggctgcactgccagacccaggcctgcccccccctgtcctggccccagaggctggacatcctgctgggcacagcccgggccatccagttcctgcaccaggacagccccagcctcatccacggggacatcaagagcagcaatgtgctgctggatgagcggctgacccccaagctgggggactttggcctggcccgcttcagcagatttgctggcagcagccccagccagagctccatggtggcccggacccagacagtgcggggcaccctggcctacctgcctgaggagtacatcaagacaggccgcctggccgtggacacagacaccttctcctttggagtggtggtgctggagaccctggccggccagagagctgtgaagacccatggagcccggaccaagtacctgaaggacctggtggaggaggaggccgaggaggccggcgtggccctgcggagcacccagagcaccctgcaggccggcctggccgcagatgcctgggccgcccccatcgccatgcagatctacaagaagcacctggacccccggcccggcccctgccccccagagctgggcctgggcctgggccagctggcctgctgctgcctgcacagaagagccaagagaagaccacccatgacccaggagaacagctatgtgagcagcacaggccgggcccacagcggggccgccccctggcagcccctggccgcccccagcggggccagcgcccaggccgctgagcagctgcagaggggccccaaccagcctgtggagagtgatgagagcctgggcggcctgtctgctgccctgcgctcctggcacctgacccccagctgccccctggaccctgcccccctgcgggaggccggctgcccccagggcgacacagctggggagagctcctggggcagcggccctggcagccggcccacagctgtggagggcctggccctgggcagcagcgccagcagcagcagcgagcccccccagatcatcatcaacccagcccggcagaagatggtgcagaagctggccctgtatgaagatggagccctggacagcctgcagctgctgagcagcagcagcctgcccggcctgggcctggagcaggaccggcagggccctgaggagagtgatgagttccagagctag

SEQ ID NO: 20174 - DNA, 2127 bp, Artificial Sequence
  Description of Artificial Sequence: Synthetic coding sequence
atggccggcggccctggccctggagagcctgctgcccctggggcccagcacttcctgtatgaggtgcccccctgggtgatgtgccgcttctacaaggtgatggatgccctggagcctgctgactggtgccagtttggaggctggaggagagctgctgggggccgggaggcccggggcctgctggcccccaccccagatgcccccaggcctgctgctgccctgattgtgcgggaccagacagagctgcggctgtgtgagaggagcggccagaggacagcctctgtgctgtggccctggatcaacagaaatgcccgggtggccgacctggtgcacatcctgacccacctgcagctgctgcgggcccgggacatcatcacagcctggcaccccccagcccccctgcccagccctggcaccacagccccccggcccagcagcatcccagccccagctgaggccgaggcctggagccccaggaagctgcccagcagcgccagcaccttcctgagccctgccttccctggcagccagacccacagcggccctgagctgggcctggtgcccagccctgccagcctgtggcccccaccacccagccctgcccccagcagcaccaagccaggccctgagagctctgtgtccctgctgcagggcgcccggcccttccccttctgctggcccctgtgtgagatcagccggggcacccacaacttcagcgaggagctgaagatcggggagggcggcttcggctgtgtgtacagagctgtgatgaggaacacagtgtatgctgtgaagaggctgaaggaaaatgctgacctggagtggacagctgtgaagcagagcttcctgacagaggtggagcagctgagccgcttccgccaccccaacatcgtggactttgctggctactgtgcccagaatggcttctactgcctggtgtatggcttcctgcccaacggcagcctggaggaccggctgcactgccagacccaggcctgcccccccctgtcctggccccagaggctggacatcctgctgggcacagcccgggccatccagttcctgcaccaggacagccccagcctcatccacggggacatcaagagcagcaatgtgctgctggatgagcggctgacccccaagctgggggactttggcctggcccgcttcagcagatttgctggcagcagccccagccagagctccatggtggcccggacccagacagtgcggggcaccctggcctacctgcctgaggagtacatcaagacaggccgcctggccgtggacacagacaccttctcctttggagtggtggtgctggagaccctggccggccagagagctgtgaagacccatggagcccggaccaagtacctgaaggacctggtggaggaggaggccgaggaggccggcgtggccctgcggagcacccagagcaccctgcaggccggcctggccgcagatgcctgggccgcccccatcgccatgcagatctacaagaagcacctggacccccggcccggcccctgccccccagagctgggcctgggcctgggccagctggcctgctgctgcctgcacagaagagccaagagaagaccacccatgacccaggagaacagctatgtgagcagcacaggccgggcccacagcggggccgccccctggcagcccctggccgcccccagcggggccagcgcccaggccgctgagcagctgcagaggggccccaaccagcctgtggagagtgatgagagcctgggcggcctgtctgctgccctgcgctcctggcacctgacccccagctgccccctggaccctgcccccctgcgggaggccggctgcccccagggcgacacagctggggagagctcctggggcagcggccctggcagccggcccacagctgtggagggcctggccctgggcagcagcgccagcagcagcagcgagcccccccagatcatcatcaacccagcccggcagaagatggtgcagaagctggccctgtatgaagatggagccctggacagcctgcagctgctgagcagcagcagcctgcccggcctgggcctggagcaggaccggcagggccctgaggagagtgatgagttccagagctag

SEQ ID NO: 20175 - DNA, 1902 bp, Artificial Sequence
  Description of Artificial Sequence: Synthetic coding sequence
atggccggcggccctggccctggagagcctgctgcccctggggcccagcacttcctgtatgaggtgcccccctgggtgatgtgccgcttctacaaggtgatggatgccctggagcctgctgactggtgccagtttgctgccctgattgtgcgggaccagacagagctgcggctgtgtgagaggagcggccagaggacagcctctgtgctgtggccctggatcaacagaaatgcccgggtggccgacctggtgcacatcctgacccacctgcagctgctgcgggcccgggacatcatcacagcctggcaccccccagcccccctgcccagccctggcaccacagccccccggcccagcagcatcccagccccagctgaggccgaggcctggagccccaggaagctgcccagcagcgccagcaccttcctgagccctgccttccctggcagccagacccacagcggccctgagctgggcctggtgcccagccctgccagcctgtggcccccaccacccagccctgcccccagcagcaccaagccaggccctgagagctctgtgtccctgctgcagggcgcccggcccttccccttctgctggcccctgtgtgagatcagccggggcacccacaacttcagcgaggagctgaagatcggggagggcggcttcggctgtgtgtacagagctgtgatgaggaacacagtgtatgctgtgaagaggctgaaggaaaatgctgacctggagtggacagctgtgaagcagagcttcctgacagaggtggagcagctgagccgcttccgccaccccaacatcgtggactttgctggctactgtgcccagaatggcttctactgcctggtgtatggcttcctgcccaacggcagcctggaggaccggctgcactgccagacccaggcctgcccccccctgtcctggccccagaggctggacatcctgctgggcacagcccgggccatccagttcctgcaccaggacagccccagcctcatccacggggacatcaagagcagcaatgtgctgctggatgagcggctgacccccaagctgggggactttggcctggcccgcttcagcagatttgctggcagcagccccagccagagctccatggtggcccggacccagacagtgcggggcaccctggcctacctgcctgaggagtacatcaagacaggccgcctggccgtggacacagacaccttctcctttggagtggtggtgctggagaccctggccggccagagagctgtgaagacccatggagcccggaccaagtacctggtgtatgaaaggctggagaagctgcaggccgtggtggccggcgtgcccggccacagcgaggccgccagctgcatcccccccagcccccaggagaacagctatgtgagcagcacaggccgggcccacagcggggccgccccctggcagcccctggccgcccccagcggggccagcgcccaggccgctgagcagctgcagaggggccccaaccagcctgtggagagtgatgagagcctgggcggcctgtctgctgccctgcgctcctggcacctgacccccagctgccccctggaccctgcccccctgcgggaggccggctgcccccagggcgacacagctggggagagctcctggggcagcggccctggcagccggcccacagctgtggagggcctggccctgggcagcagcgccagcagcagcagcgagcccccccagatcatcatcaacccagcccggcagaagatggtgcagaagctggccctgtatgaagatggagccctggacagcctgcagctgctgagcagcagcagcctgcccggcctgggcctggagcaggaccggcagggccctgaggagagtgatgagttccagagctag

SEQ ID NO: 20176 - DNA, 1245 bp, Artificial Sequence
  Description of Artificial Sequence: Synthetic coding sequence
atgagcaagaagatcagcggcggctctgtggtggagatgcagggagatgagatgacccgcatcatctgggagctgatcaaggagaagctgatcttcccctacgtggagctggacctgcacagctatgacctgggcattgaaaatagagatgccaccaatgaccaggtgaccaaggatgctgctgaggccatcaagaagcacaacgtgggcgtgaagtgtgccaccatcaccccagatgagaagagggtggaggagttcaagctgaagcagatgtggaagagccccaacggcaccatccggaacatcctgggcggcaccgtcttccgggaggccatcatctgcaagaacatcccccggctggtgtctggctgggtgaagcccatcatcatcggcagacatgcctatggagaccagtaccgggccacagactttgtggtgcccggccctgggaaggtggagatcacctacacccccagtgatggcacccagaaggtgacctacctggtgcacaactttgaggagggcggcggcgtggccatgggcatgtacaaccaggacaagagcattgaggactttgcccacagcagcttccagatggccctgagcaagggctggcccctgtacctgagcaccaagaacaccatcctgaagaagtatgatggccgcttcaaggacatcttccaggagatctatgacaagcagtacaagagccagtttgaggcccagaagatctggtatgagcaccggctgattgatgacatggtggcccaggccatgaagtctgagggcggcttcatctgggcctgcaagaactatgatggagatgtgcagagcgacagcgtggcccagggctacggcagcctgggcatgatgacctctgtgctggtgtgcccagatggcaagacagtggaggccgaggccgcccatggaacagtgaccaggcactacaggatgtaccagaagggccaggagaccagcaccaaccccatcgccagcatctttgcctggacccggggcctggcccaccgggccaagctggacaacaacaaggagctggccttctttgccaatgccctggaggaggtgtccattgagaccattgaagctggcttcatgaccaaggacctggccgcctgcatcaagggcctgcccaacgtgcagaggagtgactacctgaacacctttgagttcatggacaagctgggggagaacctgaagatcaagctggcccaggccaagctgtag

SEQ ID NO: 20177 - DNA, 474 bp, Artificial Sequence
  Description of Artificial Sequence: Synthetic coding sequence
atgagcaagaagatcagcggcggctctgtggtggagatgcagggagatgagatgacccgcatcatctgggagctgatcaaggagaagctgatcttcccctacgtggagctggacctgcacagctatgacctgggcattgaaaatagagatgccaccaatgaccaggtgaccaaggatgctgctgaggccatcaagaagcacaacgtgggcgtgaagtgtgccaccatcaccccagatgagaagagggtggaggagttcaagctgaagcagatgtggaagagccccaacggcaccatccggaacatcctgggcggcaccgtcttccgggaggccatcatctgcaagaacatcccccggctggtgtctggctgggtgaagcccatcatcatcggcagacatgcctatggagaccagtaccgggccacagactttgtggtgcccggccctgggaaggtggagatcacctacacctag

SEQ ID NO: 20178 - DNA, 1245 bp, Artificial Sequence; identical to SEQ ID NO: 20176
  Description of Artificial Sequence: Synthetic coding sequence

SEQ ID NO: 20179 - DNA, 225 bp, Artificial Sequence
  Description of Artificial Sequence: Synthetic coding sequence
atgagcaagaagatcagcggcggctctgtggtggagatgcagggagatgagatgacccgcatcatctgggagctgatcaaggagaagctgatcttcccctacgtggagctggacctgcacagctatgacctgggcattgaaaatagagatgccaccaatgaccaggtgaccaaggatgctgctgaggccatcaagaagcacaacgtgggcgtgaagtgtgcctag

SEQ ID NO: 20180 - DNA, 1245 bp, Artificial Sequence; identical to SEQ ID NO: 20176
  Description of Artificial Sequence: Synthetic coding sequence

SEQ ID NO: 20181 - DNA, 189 bp, Artificial Sequence
  Description of Artificial Sequence: Synthetic coding sequence
atgagcaagaagatcagcggcggctctgtggtggagatgcagggagatgagatgacccgcatcatctgggagctgatcaaggagaagctgatcttcccctacgtggagctggacctgcacagctatgacctgggcattgaaaatagagatgccaccaatgaccaggtgaccaaggatgctgctgagtag

SEQ ID NO: 20182 - DNA, 1359 bp, Artificial Sequence
  Description of Artificial Sequence: Synthetic coding sequence
atggccggctacctgcgggtggtgcgcagcctgtgccgggccagcggcagcaggcctgcctgggccccagctgccctgacagcccccaccagccaggagcagccccggcggcactacgccgacaagaggatcaaggtggccaagcctgtggtggagatggatggagatgagatgacccgcatcatctggcagttcatcaaggagaagctgatcctgccccacgtggacatccagctgaagtactttgacctgggcctgcccaacagagaccagacagatgaccaggtgaccatcgacagcgccctggccacccagaagtacagcgtggccgtgaagtgtgccaccatcaccccagatgaggcccgggtggaggagttcaagctgaagaagatgtggaagagccccaacggcaccatccggaacatcctgggcggcaccgtcttccgggagcccatcatctgcaagaacatcccccggctggtgcccggctggaccaagcccatcaccatcggcagacatgcccatggagaccagtacaaggccacagactttgtggccgacagagctggcaccttcaagatggtgttcacccccaaggatggcagcggcgtgaaggagtgggaggtgtacaacttccctgctgggggcgtgggcatgggcatgtacaacacagatgagagcatcagcggctttgcccacagctgcttccagtatgccatccagaagaagtggcccctgtacatgagcaccaagaacaccatcctgaaggcctatgatggccgcttcaaggacatcttccaggagatctttgacaagcactacaagacagactttgacaagaacaagatctggtatgagcaccggctgattgatgacatggtggcccaggtgctgaagagcagcggcggctttgtgtgggcctgcaagaactatgatggagatgtgcagagcgacatcctggcccagggcttcggcagcctgggcctgatgacctctgtgctggtgtgcccagatggcaagaccatcgaggccgaggccgcccacggcaccgtgaccaggcactaccgggagcaccagaagggccggcccaccagcaccaaccccatcgccagcatctttgcctggacccggggcctggagcaccggggcaagctggatggcaaccaggacctgatccgctttgcccagatgctggagaaggtgtgtgtggagaccgtggagagcggggccatgaccaaggacctggccggctgcatccacggcctgagcaatgtgaagctgaatgagcacttcctgaacaccacagacttcctggacaccatcaagagcaacctggaccgggccctgggccggcagtag

SEQ ID NO: 20183 - DNA, 969 bp, Artificial Sequence
  Description of Artificial Sequence: Synthetic coding sequence
atgtggaagagccccaacggcaccatccggaacatcctgggcggcaccgtcttccgggagcccatcatctgcaagaacatcccccggctggtgcccggctggaccaagcccatcaccatcggcagacatgcccatggagaccagtacaaggccacagactttgtggccgacagagctggcaccttcaagatggtgttcacccccaaggatggcagcggcgtgaaggagtgggaggtgtacaacttccctgctgggggcgtgggcatgggcatgtacaacacagatgagagcatcagcggctttgcccacagctgcttccagtatgccatccagaagaagtggcccctgtacatgagcaccaagaacaccatcctgaaggcctatgatggccgcttcaaggacatcttccaggagatctttgacaagcactacaagacagactttgacaagaacaagatctggtatgagcaccggctgattgatgacatggtggcccaggtgctgaagagcagcggcggctttgtgtgggcctgcaagaactatgatggagatgtgcagagcgacatcctggcccagggcttcggcagcctgggcctgatgacctctgtgctggtgtgcccagatggcaagaccatcgaggccgaggccgcccacggcaccgtgaccaggcactaccgggagcaccagaagggccggcccaccagcaccaaccccatcgccagcatctttgcctggacccggggcctggagcaccggggcaagctggatggcaaccaggacctgatccgctttgcccagatgctggagaaggtgtgtgtggagaccgtggagagcggggccatgaccaaggacctggccggctgcatccacggcctgagcaatgtgaagctgaatgagcacttcctgaacaccacagacttcctggacaccatcaagagcaacctggaccgggccctgggccggcagtag

SEQ ID NO: 20184 - DNA, 1203 bp, Artificial Sequence
  Description of Artificial Sequence: Synthetic coding sequence
atggatggagatgagatgacccgcatcatctggcagttcatcaaggagaagctgatcctgccccacgtggacatccagctgaagtactttgacctgggcctgcccaacagagaccagacagatgaccaggtgaccatcgacagcgccctggccacccagaagtacagcgtggccgtgaagtgtgccaccatcaccccagatgaggcccgggtggaggagttcaagctgaagaagatgtggaagagccccaacggcaccatccggaacatcctgggcggcaccgtcttccgggagcccatcatctgcaagaacatcccccggctggtgcccggctggaccaagcccatcaccatcggcagacatgcccatggagaccagtacaaggccacagactttgtggccgacagagctggcaccttcaagatggtgttcacccccaaggatggcagcggcgtgaaggagtgggaggtgtacaacttccctgctgggggcgtgggcatgggcatgtacaacacagatgagagcatcagcggctttgcccacagctgcttccagtatgccatccagaagaagtggcccctgtacatgagcaccaagaacaccatcctgaaggcctatgatggccgcttcaaggacatcttccaggagatctttgacaagcactacaagacagactttgacaagaacaagatctggtatgagcaccggctgattgatgacatggtggcccaggtgctgaagagcagcggcggctttgtgtgggcctgcaagaactatgatggagatgtgcagagcgacatcctggcccagggcttcggcagcctgggcctgatgacctctgtgctggtgtgcccagatggcaagaccatcgaggccgaggccgcccacggcaccgtgaccaggcactaccgggagcaccagaagggccggcccaccagcaccaaccccatcgccagcatctttgcctggacccggggcctggagcaccggggcaagctggatggcaaccaggacctgatccgctttgcccagatgctggagaaggtgtgtgtggagaccgtggagagcggggccatgaccaaggacctggccggctgcatccacggcctgagcaatgtgaagctgaatgagcacttcctgaacaccacagacttcctggacaccatcaagagcaacctggaccgggccctgggccggcagtag

SEQ ID NO: 20185 - DNA, 3657 bp, Artificial Sequence
  Description of Artificial Sequence: Synthetic coding sequence
atgaggagccccaggacccggggccgcagcggccggcccctgagcctgctgctggccctgctgtgtgccctgcgggccaaggtgtgtggggccagcggccagtttgagctggagatcctgtccatgcagaatgtgaatggagagctgcagaatggaaactgctgcggcggggccagaaatcctggggacaggaagtgcaccagagatgaatgtgacacctacttcaaggtgtgcctgaaggagtaccagagccgggtgacagctgggggcccctgcagctttggcagcggcagcacccctgtgattggaggcaacaccttcaacctgaaggccagcagaggaaatgacaggaaccgcatcgtgctgcccttctcctttgcctggcccaggagctacaccctgctggtggaggcctgggacagcagcaatgacacagtgcagcctgacagcatcatcgagaaggccagccacagcggcatgatcaaccccagccggcagtggcagaccctgaagcagaacacaggagtggcccactttgagtaccagatccgggtgacctgtgatgactactactacggcttcggctgcaacaagttctgccggcccagagatgacttcttcggccactacgcctgtgaccagaatggaaacaagacctgcatggagggctggatgggccctgagtgcaacagagccatctgccggcagggctgcagccccaagcacggcagctgcaagctgcccggggactgccgctgccagtatggctggcagggcctgtactgtgacaagtgcatcccccaccctggctgtgtgcacggcatctgcaatgagccctggcagtgcctgtgtgagaccaactggggcggccagctgtgtgacaaggacctgaactactgcggcacccaccagccctgcctgaatggaggcacctgcagcaacacaggccctgacaagtaccagtgcagctgcccagagggctacagcggccccaactgtgaaattgctgagcacgcctgcctgagtgacccctgccacaacagaggcagctgcaaggagaccagcctgggctttgaatgtgaatgttctcctggctggacaggccccacctgcagcaccaacattgatgactgcagccccaacaactgcagccatggaggcacctgccaggacctggtgaatggcttcaagtgtgtgtgccccccccagtggacaggcaagacctgccagctggatgccaatgaatgtgaggccaagccctgtgtgaatgccaagagctgcaagaacctgattgccagctactactgtgactgcctgcccggctggatgggccagaactgtgacatcaacatcaatgactgcctgggccagtgccagaatgatgccagctgccgggacctggtgaatggctaccgctgcatctgccccccaggctacgccggggaccactgtgagcgggacattgatgaatgtgccagcaacccctgcctgaatggaggccactgccagaatgagatcaaccgcttccagtgcctgtgccccaccggcttcagcggcaacctgtgccagctggacatcgactactgtgagcccaacccctgccagaatggagcccagtgctacaacagagccagtgactacttctgcaagtgcccagaagattatgagggcaagaactgcagccacctgaaggaccactgcaggaccaccccctgtgaggtgattgacagctgcaccgtggccatggccagcaatgacaccccagagggcgtgcgctacatcagcagcaatgtgtgtggcccccacggcaagtgcaagagccagagcggcggcaagttcacctgtgactgcaacaagggcttcaccggcacctactgccacgagaacatcaatgactgtgagagcaacccctgcagaaatggaggcacctgcattgatggagtgaacagctacaagtgcatctgcagtgatggctgggagggcgcctactgtgagaccaacatcaatgactgcagccagaacccctgccacaacggcggcacctgccgggacctggtgaatgacttctactgtgactgcaagaatggctggaagggcaagacctgccacagccgggacagccagtgtgatgaggccacctgcaacaacggcggcacctgctatgatgaaggagatgccttcaagtgcatgtgccctgggggctgggagggcaccacctgcaacatcgccaggaacagcagctgcctgcccaacccctgccacaatggaggcacctgtgtggtgaatggagagagcttcacctgtgtgtgcaaggagggctgggagggccccatctgtgcccagaacaccaatgactgcagcccccacccctgctacaacagcggcacctgtgtggatggagacaactggtaccgctgtgaatgtgcccctggctttgctggccctgactgccgcatcaacatcaatgaatgccagagcagcccctgtgcctttggagccacctgtgtggatgagatcaatggctaccgctgtgtgtgccccccaggccacagcggggccaagtgccaggaggtgtctggccggccctgcatcaccatgggcagcgtcatcccagatggagccaagtgggatgatgactgcaacacctgccagtgcctgaatggccgcatcgcctgcagcaaggtgtggtgtggcccccggccctgcctgctgcacaagggccacagcgagtgccccagcggccagagctgcatccccatcctggatgaccagtgctttgtgcacccctgcacaggagtgggagaatgtcgcagcagcagcctgcagcctgtgaagaccaagtgcaccagtgacagctactaccaggacaactgtgccaacatcaccttcaccttcaacaaggagatgatgagccctggcctgaccacagagcacatctgcagcgagctgaggaacctgaacatcctgaagaatgtgtctgctgagtacagcatctacatcgcctgtgagcccagccccagcgccaacaatgagatccacgtggccatctctgctgaggacatcagagatgatggcaaccccatcaaggagatcacagacaagatcatcgacctggtgtccaagagagatggcaacagcagcctgattgctgctgtggccgaggtgcgggtgcagaggcggcccctgaagaacagaacagacttcctggtgcccctgctgagctctgtgctgactgtggcctggatctgctgcctggtgacagccttctactggtgcctgaggaagaggaggaagccaggcagccacacccacagcgccagcgaggacaacaccaccaacaacgtgcgggagcagctgaaccagatcaagaaccccatcgagaagcatggagccaacacagtgcccatcaaggactatgagaacaagaacagcaagatgagcaagatccgcacccacaacagcgaggtggaggaggatgacatggacaagcaccagcagaaggccaggtttgccaagcagcctgcctacaccctggtggaccgggaggagaagcccccaaatggcacccccaccaagcaccccaactggaccaacaagcaggacaacagagacctggagagcgcccagagcctgaacaggatggagtacatcgtgtag

SEQ ID NO: 20186 - DNA, 3180 bp, Artificial Sequence
  Description of Artificial Sequence: Synthetic coding sequence
atgatcaaccccagccggcagtggcagaccctgaagcagaacacaggagtggcccactttgagtaccagatccgggtgacctgtgatgactactactacggcttcggctgcaacaagttctgccggcccagagatgacttcttcggccactacgcctgtgaccagaatggaaacaagacctgcatggagggctggatgggccctgagtgcaacagagccatctgccggcagggctgcagccccaagcacggcagctgcaagctgcccggggactgccgctgccagtatggctggcagggcctgtactgtgacaagtgcatcccccaccctggctgtgtgcacggcatctgcaatgagccctggcagtgcctgtgtgagaccaactggggcggccagctgtgtgacaaggacctgaactactgcggcacccaccagccctgcctgaatggaggcacctgcagcaacacaggccctgacaagtaccagtgcagctgcccagagggctacagcggccccaactgtgaaattgctgagcacgcctgcctgagtgacccctgccacaacagaggcagctgcaaggagaccagcctgggctttgaatgtgagtgcagccctggctggacaggccccacctgcagcaccaacattgatgactgcagccccaacaactgcagccacggcggcacctgccaggacctggtgaatggcttcaagtgtgtgtgccccccccagtggacaggcaagacctgccagctggatgccaatgaatgtgaggccaagccctgtgtgaatgccaagagctgcaagaacctgattgccagctactactgtgactgcctgcccggctggatgggccagaactgtgacatcaacatcaatgactgcctgggccagtgccagaatgatgccagctgccgggacctggtgaatggctaccgctgcatctgccccccaggctacgccggggaccactgtgagcgggacattgatgaatgtgccagcaacccctgcctgaatggaggccactgccagaatgagatcaaccgcttccagtgcctgtgccccaccggcttcagcggcaacctgtgccagctggacatcgactactgtgagcccaacccctgccagaatggagcccagtgctacaacagagccagtgactacttctgcaagtgcccagaggactatgagggcaagaactgcagccacctgaaggaccactgcaggaccaccccctgtgaggtgattgacagctgcaccgtggccatggccagcaatgacaccccagagggcgtgcgctacatcagcagcaatgtgtgtggcccccacggcaagtgcaagagccagagcggcggcaagttcacctgtgactgcaacaagggcttcaccggcacctactgccacgagaacatcaatgactgtgagagcaacccctgcagaaatggaggcacctgcattgatggagtgaacagctacaagtgcatctgcagtgatggctgggagggcgcctactgtgagaccaacatcaatgactgcagccagaacccctgccacaatggaggcacctgccgggacctggtgaatgacttctactgtgactgcaagaatggctggaagggcaagacctgccacagccgggacagccagtgtgatgaggccacctgcaacaatggaggcacctgctatgatgaaggagatgccttcaagtgcatgtgccctgggggctgggagggcaccacctgcaacatcgccaggaacagcagctgcctgcccaacccctgccacaacggcggcacctgtgtggtgaatggagagagcttcacctgtgtgtgcaaggagggctgggagggccccatctgtgcccagaacaccaatgactgcagcccccacccctgctacaacagcggcacctgtgtggatggagacaactggtaccgctgtgaatgtgcccctggctttgctggccctgactgccgcatcaacatcaatgaatgccagagcagcccctgtgccttcggggccacctgtgtggatgagatcaatggctaccgctgtgtgtgccccccaggccacagcggggccaagtgccaggaggtgtctggccggccctgcatcaccatgggcagcgtcatcccagatggagccaagtgggatgatgactgcaacacctgccagtgcctgaatggaagaattgcctgcagcaaggtgtggtgtggcccccggccctgcctgctgcacaagggccacagtgaatgtcccagcggccagagctgcatccccatcctggatgaccagtgctttgtgcacccctgcaccggggtgggggagtgccgcagcagcagcctgcagcctgtgaagaccaagtgcaccagtgacagctactaccaggacaactgtgccaacatcaccttcaccttcaacaaggagatgatgagccctggcctgaccacagagcacatctgcagcgagctgaggaacctgaacatcctgaagaatgtgtctgctgagtacagcatctacatcgcctgtgagcccagccccagcgccaacaatgagatccacgtggccatctctgctgaggacatcagagatgatggcaaccccatcaaggagatcacagacaagatcatcgacctggtgtccaagagagatggcaacagcagcctgattgctgctgtggccgaggtgcgggtgcagaggcggcccctgaagaacagaacagacttcctggtgcccctgctgagctctgtgctgactgtggcctggatctgctgcctggtgacagccttctactggtgcctgaggaagaggaggaagccaggcagccacacccacagcgccagcgaggacaacaccaccaacaacgtgcgggagcagctgaaccagatcaagaaccccatcgagaagcacggggccaacacagtgcccatcaaggactatgagaacaagaacagcaagatgagcaagatccgcacccacaacagcgaggtggaggaggatgacatggacaagcaccagcagaaggccaggtttgccaagcagcctgcctacaccctggtggaccgggaggagaagccacccaacggcacccccaccaagcaccccaactggaccaacaagcaggacaacagagacctggagagcgcccagagcctgaacaggatggagtacatcgtgtag

SEQ ID NO: 20187 - DNA, 3399 bp, Artificial Sequence
  Description of Artificial Sequence: Synthetic coding sequence
atgggcatggcctgcctgaccatgacagagatggagggcaccagcaccagcagcatctaccagaatggagacatctctggaaatgccaacagcatgaagcagattgatcctgtgctgcaggtgtacctgtaccacagcctgggcaagtctgaggccgactacctgaccttccccagcggggagtatgtggccgaggagatctgcatcgccgccagcaaggcctgtggcatcacccctgtgtaccacaacatgtttgccctgatgtctgaaacagagcgcatctggtacccacccaaccacgtgttccacattgatgagagcaccaggcacaacgtgctgtaccgcatccgcttctacttcccccgctggtactgcagcggcagcaacagagcctaccgccacggcatcagcagaggagctgaggcccccctgctggatgactttgtgatgagctacctgtttgcccagtggaggcatgactttgtgcacggctggatcaaggtgcctgtgacccatgagacccaggaggagtgcctgggcatggctgtgctggacatgatgagaattgccaaggaaaatgaccagacccccctggccatctacaacagcatctcctacaagaccttcctgcccaagtgcatccgggccaagatccaggactaccacatcctgaccaggaagaggatccgctaccgcttccgccgcttcatccagcagttcagccagtgcaaggccacagccaggaacctgaagctgaagtacctgatcaacctggagaccctgcagagcgccttctacacagagaagtttgaggtgaaggagcccggcagcggccccagcggggaggagatctttgccaccatcatcatcactggaaatggaggcatccagtggagccggggcaagcacaaggagagcgagaccctgacagagcaggacctgcagctgtactgtgacttccccaacatcattgatgtgtccatcaagcaggccaaccaggagggcagcaatgaaagccgggtggtgaccatccacaagcaggacggcaagaacctggagattgagctgagcagcctgcgggaggccctgagctttgtgtccctgattgatggctactaccgcctgacagcagatgcccaccactacctgtgcaaggaggtggcccctcctgctgtgctggagaacatccagagcaactgccacggccccatctccatggactttgccatcagcaagctgaagaaggccggcaaccagacaggcctgtatgtgctgcgctgcagccccaaggacttcaacaagtacttcctgacctttgctgtggagcgggagaatgtgattgagtacaagcactgcctgatcaccaagaatgaaaatgaggagtacaacctgagcggcaccaagaagaacttcagcagcctgaaggacctgctgaactgctaccagatggagaccgtgcggagtgacaacatcatcttccagttcaccaagtgctgcccccccaagcccaaggacaagagcaacctgctggtgttccgcaccaatggagtgtctgatgtgcccaccagccccaccctgcagaggcccacccacatgaaccagatggtgttccacaagatcagaaatgaagatctcatcttcaatgaaagcctgggccagggcaccttcaccaagatcttcaagggcgtgcggcgggaggtgggggactatggccagctgcacgagacagaggtgctgctgaaggtgctggacaaggcccacaggaactacagcgagagcttctttgaagctgcctccatgatgagcaagctgagccacaagcacctggtgctgaactatggagtgtgtgtgtgtggagatgagaacatcctggtgcaggagtttgtgaagtttggcagcctggacacctacctgaagaagaacaagaactgcatcaacatcctgtggaagctggaggtggccaagcagctggcctgggccatgcacttcctggaggagaacaccctcatccatggaaatgtgtgtgccaagaacatcctgctgatccgggaggaggacaggaagacaggcaacccccccttcatcaagctgagtgaccccggcatcagcatcaccgtgctgcccaaggacatcctgcaggagcgcatcccctgggtgcccccagagtgcatcgagaaccccaagaacctgaacctggccacagacaagtggagctttggcaccaccctgtgggagatctgcagcggcggggacaagcccctgagcgccctggacagccagaggaagctgcagttctatgaagatagacaccagctgcctgcccccaagtgggccgagctggccaacctgatcaacaactgcatggactatgagccagacttccggcccagcttccgggccatcatccgggacctgaacagcctcttcaccccagactatgagctgctgacagaaaatgacatgctgcccaacatgagaattggagccctgggcttcagcggggcctttgaagatcgggaccccacccagtttgaggagcggcacctgaagttcctgcagcagctgggcaaaggaaactttggatctgtggagatgtgccgctatgaccccctgcaggacaacacaggagaggtggtggccgtgaagaagctgcagcacagcacagaggagcacctgcgggactttgagcgggagattgagatcctgaagagcctgcagcacgacaacatcgtgaagtacaagggcgtgtgctacagcgctggaagaagaaacctgaagctgatcatggagtacctgccctacggcagcctgcgggactacctgcagaagcacaaggagagaattgaccacatcaagctgctgcagtacaccagccagatctgcaagggcatggagtacctgggcaccaagcgctacatccaccgggacctggccaccaggaacatcctggtggagaatgaaaatagagtgaagatcggggactttggcctgaccaaggtgctgccccaggacaaggagtactacaaggtgaaggagcctggagagagccccatcttctggtacgcccctgagagcctgacagagagcaagttctctgtggccagtgatgtgtggagctttggagtggtgctgtatgagctgttcacctacatcgagaagagcaagagccccccagctgagttcatgaggatgattggaaatgacaagcagggccagatgattgtgttccacctgattgagctgctgaagaacaacggccgcctgcccaggccagatggctgcccagatgagatctacatgatcatgacagagtgctggaacaacaacgtgaaccagaggcccagcttccgggacctggccctgcgggtggaccagatccgggacaacatggccggctag

SEQ ID NO: 20188 - DNA, 3399 bp, Artificial Sequence; identical to SEQ ID NO: 20187
  Description of Artificial Sequence: Synthetic coding sequence

SEQ ID NO: 20189 - DNA, 2952 bp, Artificial Sequence
  Description of Artificial Sequence: Synthetic coding sequence
atgagctacctgtttgcccagtggaggcatgactttgtgcacggctggatcaaggtgcctgtgacccatgagacccaggaggagtgcctgggcatggctgtgctggacatgatgagaattgccaaggaaaatgaccagacccccctggccatctacaacagcatctcctacaagaccttcctgcccaagtgcatccgggccaagatccaggactaccacatcctgaccaggaagaggatccgctaccgcttccgccgcttcatccagcagttcagccagtgcaaggccacagccaggaacctgaagctgaagtacctgatcaacctggagaccctgcagagcgccttctacacagagaagtttgaggtgaaggagcccggcagcggccccagcggggaggagatctttgccaccatcatcatcactggaaatggaggcatccagtggagccggggcaagcacaaggagagcgagaccctgacagagcaggacctgcagctgtactgtgacttccccaacatcattgatgtgtccatcaagcaggccaaccaggagggcagcaatgaaagccgggtggtgaccatccacaagcaggacggcaagaacctggagattgagctgagcagcctgcgggaggccctgagctttgtgtccctgattgatggctactaccgcctgacagcagatgcccaccactacctgtgcaaggaggtggcccccccagctgtgctggagaacatccagagcaactgccacggccccatctccatggactttgccatcagcaagctgaagaaggccggcaaccagacaggcctgtatgtgctgcgctgcagccccaaggacttcaacaagtacttcctgacctttgctgtggagagagaaaatgtcatcgagtacaagcactgcctgatcaccaagaatgaaaatgaggagtacaacctgagcggcaccaagaagaacttcagcagcctgaaggacctgctgaactgctaccagatggagaccgtgcggagtgacaacatcatcttccagttcaccaagtgctgcccccccaagcccaaggacaagagcaacctgctggtgttccgcaccaacggggtgtctgatgtgcccaccagccccaccctgcagaggcccacccacatgaaccagatggtgttccacaagatcagaaatgaagacctgatcttcaatgaaagcctgggccagggcaccttcaccaagatcttcaagggcgtgagaagagaggtgggggactatggccagctgcatgaaacagaggtgctgctgaaggtgctggacaaggcccacaggaactacagcgagagcttctttgaggccgcctccatgatgagcaagctgagccacaagcacctggtgctgaactacggcgtgtgtgtgtgtggagatgagaacatcctggtgcaggagtttgtgaagtttggcagcctggacacctacctgaagaagaacaagaactgcatcaacatcctgtggaagctggaggtggccaagcagctggcctgggccatgcacttcctggaggagaacaccctcatccacggcaatgtgtgtgccaagaacatcctgctgatccgggaggaggacaggaagacaggcaacccccccttcatcaagctgagtgaccccggcatcagcatcaccgtgctgcccaaggacatcctgcaggagcgcatcccctgggtgcccccagaatgtattgagaaccccaagaacctgaacctggccacagacaagtggagctttggcaccaccctgtgggagatctgcagcggcggggacaagcccctgagcgccctggacagccagaggaagctgcagttctatgaggacagacaccagctgcctgcccccaagtgggccgagctggccaacctgatcaacaactgcatggactatgagccagacttccggcccagcttccgggccatcatccgggacctgaacagcctcttcaccccagactatgagctgctgacagaaaatgacatgctgcccaacatgagaattggagccctgggcttcagcggggcctttgaggaccgggaccccacccagtttgaggagcggcacctgaagttcctgcagcagctgggcaagggcaactttggatctgtggagatgtgccgctatgaccccctgcaggacaacacaggagaggtggtggccgtgaagaagctgcagcacagcacagaggagcacctgcgggactttgagcgggagattgagatcctgaagagcctgcagcacgacaacatcgtgaagtacaagggcgtgtgctacagcgctggaagaagaaacctgaagctgatcatggagtacctgccctacggcagcctgcgggactacctgcagaagcacaaggagagaattgaccacatcaagctgctgcagtacaccagccagatctgcaagggcatggagtacctgggcaccaagcgctacatccaccgggacctggccaccaggaacatcctggtggagaatgaaaatagagtgaagattggagactttggcctgaccaaggtgctgccccaggacaaggagtactacaaggtgaaggagcccggggagagccccatcttctggtacgcccctgagagcctgacagagagcaagttctctgtggccagtgatgtgtggagctttggagtggtgctgtatgagctgttcacctacatcgagaagagcaagagccccccagctgagttcatgaggatgattggaaatgacaagcagggccagatgattgtgttccacctgattgagctgctgaagaacaacggccgcctgcccaggccagatggctgcccagatgagatctacatgatcatgacagagtgctggaacaacaacgtgaaccagaggcccagcttccgggacctggccctgcgggtggaccagatccgggacaacatggccggctag

SEQ ID NO: 20190 - DNA, 732 bp, Artificial Sequence
  Description of Artificial Sequence: Synthetic coding sequence
atgactggaattgctgctgccagcttcttcagcaacacctgccgctttggaggctgcggcctgcacttccccaccctggccgacctgattgagcacatcgaggacaaccacatcgacacagacccccgggtgctggagaagcaggagctgcagcagcccacctacgtggccctgagctacatcaaccgcttcatgacagatgctgcccggcgggagcaggagagcctgaagaagaagatccagcccaagctgagcctgaccctgagcagctctgtgtccagaggaaatgtgtccaccccacccaggcacagcagcggcagcctgaccccacctgtgaccccacccatcacccccagcagcagcttccgcagcagcacccccaccggctctgaatatgatgaggaggaggtggactatgaggagagtgacagtgatgagagctggaccacagagagcgccatcagcagcgaggccatcctgagctccatgtgcatgaatggaggagaggagaagccctttgcctgccctgtgcccggctgcaagaagcgctacaagaatgtgaatggcatcaagtaccacgccaagaatggccacaggacccagatccgggtgaggaagcccttcaagtgccgctgtgggaagagctacaagacagcccagggcctgcggcaccacaccatcaacttccacccccctgtgtctgctgagatcatcaggaagatgcagcagtag

SEQ ID NO: 20191 - DNA, 1044 bp, Artificial Sequence
  Description of Artificial Sequence: Synthetic coding sequence
atgtgcaccaagatggagcagcccttctaccatgatgacagctacacagccaccggctacggccgggcccctgggggcctgagcctgcatgactacaagctgctgaagcccagcctggccgtgaacctggccgacccctaccgcagcctgaaggcccctggggcccggggccctggccctgagggcggcggcggcggcagctacttcagcggccagggcagtgacaccggggccagcctgaagctggccagcagcgagctggagcggctgattgtgcccaacagcaatggagtcatcaccaccacccccaccccacctggccagtacttctacccccggggcggcggcagcggcggcggggccggcggggccggcggcggcgtgacagaggagcaggagggctttgctgatggctttgtgaaggccctggatgacctgcacaagatgaaccacgtgaccccacccaacgtgtccctgggcgccaccggcggccccccagctggccctggaggagtgtatgccggccctgagcccccacctgtgtacaccaacctgagcagctacagccctgccagcgccagcagtggaggagctggagctgctgtgggcaccggcagcagctaccccaccaccaccatctcctacctgccccacgcccccccatttgctgggggccacccagcccagctgggcctgggccgcggggccagcaccttcaaggaggagccccagacagtgcctgaggcccggagcagagatgccaccccacctgtgagccccatcaacatggaggaccaggagcgcatcaaggtggagaggaagaggctgaggaaccggctggccgccaccaagtgcaggaagaggaagctggagagaattgcccggctggaggacaaggtgaagaccctgaaggccgagaatgccggcctgagcagcacagctggcctgctgcgggagcaggtggcccagctgaagcagaaggtgatgacccacgtgtccaatggctgccagctgctgctgggcgtgaagggccacgccttctag

SEQ ID NO: 20192 - DNA, 996 bp, Artificial Sequence
  Description of Artificial Sequence: Synthetic coding sequence
atgacagccaagatggagaccaccttctatgatgatgccctgaatgccagcttcctgcccagcgagagcggcccctacggctacagcaaccccaagatcctgaagcagagcatgaccctgaacctggccgaccctgtgggcagcctgaagccccacctgcgggccaagaacagcgacctgctgaccagcccagatgtgggcctgctgaagctggccagccctgagctggagcggctcatcatccagagcagcaatggccacatcaccaccacccccacccccacccagttcctgtgccccaagaatgtgacagatgagcaggagggctttgctgagggctttgtgcgggccctggccgagctgcacagccagaacaccctgcccagcgtgaccagcgctgcccagcctgtgaatggagctggcatggtggccccagctgtggcctctgtggccggcggcagcggcagcggcggcttcagcgccagcctgcacagcgagccccctgtgtatgccaacctgagcaacttcaaccctggggccctgagcagcggcggcggggcccccagctatggagctgctggcctggccttccctgcccagccccagcagcagcagcagcccccccaccacctgccccagcagatgcctgtgcagcacccccggctgcaggccctgaaggaggagccccagacagtgcctgagatgcctggagagaccccacccctgagccccatcgacatggagagccaggagcgcatcaaggccgagaggaagaggatgaggaacagaattgctgccagcaagtgcaggaagaggaagctggagagaattgcccggctggaggagaaggtgaagaccctgaaggcccagaacagcgagctggccagcacagccaacatgctgcgggagcaggtggcccagctgaagcagaaggtgatgaaccacgtgaacagcggctgccagctgatgctgacccagcagctgcagaccttctag

SEQ ID NO: 20193 - DNA, 831 bp, Artificial Sequence
  Description of Artificial Sequence: Synthetic coding sequence
atgagggccccccacctgcacctgtctgctgccagcggggcccgggccctggccaagctgctgcccctgctgatggcccagctgtgggccgctgaggccgccctgctgccccagaatgacacccggctggaccctgaggcctacggcagcccctgtgcccggggcagccagccctggcaggtgtccctcttcaacggcctgtccttccactgtgccggcgtgctggtggaccagagctgggtgctgacagctgcccactgcggcaacaagcccctgtgggcccgggtgggagatgaccacctgctgctgctgcagggcgagcagctgcggaggaccaccaggtctgtggtgcaccccaagtaccaccagggcagcggccccatcctgcccaggagaacagatgaacatgacctgatgctgctgaagctggcccggcctgtggtgctgggcccccgggtgcgggccctgcagctgccctaccgctgtgcccagcccggggaccagtgccaggtggccggctggggcaccacagctgcccggcgggtgaagtacaacaagggcctgacctgcagcagcatcaccatcctgagccccaaggaatgtgaggtgttctacccaggagtggtgaccaacaacatgatctgtgccggcctggaccggggccaggacccctgccagagcgacagcggcggccccctggtgtgtgatgagaccctgcagggcatcctgtcctggggcgtgtacccctgtggcagcgcccagcaccctgctgtgtacacccagatctgcaagtacatgtcctggatcaacaaggtgatccgcagcaactag

SEQ ID NO: 20194 - DNA, 831 bp, Artificial Sequence; identical to SEQ ID NO: 20193
  Description of Artificial Sequence: Synthetic coding sequence

SEQ ID NO: 20195 - DNA, 831 bp, Artificial Sequence; identical to SEQ ID NO: 20193
  Description of Artificial Sequence: Synthetic coding sequence

SEQ ID NO: 20196 - DNA, 657 bp, Artificial Sequence
  Description of Artificial Sequence: Synthetic coding sequence
atgtgggtgcctgtggtgttcctgaccctgtctgtgacctggattggagctgcccccctcatcctgagcagaattgtgggcggctgggagtgtgagaagcacagccagccctggcaggtgctggtggccagccggggccgggctgtgtgtggcggcgtgctggtgcacccccagtgggtgctgacagctgcccactgcatcaggaagccaggagatgacagcagccatgacctgatgctgctgcggctgtctgagcctgctgagctgacagatgctgtgaaggtgatggacctgcccacccaggagcccgccctgggcaccacctgctacgccagcggctggggcagcattgagcctgaggagttcctgacccccaagaagctgcagtgtgtggacctgcacgtgatcagcaatgatgtgtgtgcccaggtgcacccccagaaggtgaccaagttcatgctgtgtgccggccgctggacaggaggcaagagcacctgcagcggggacagcggcggccccctggtgtgcaatggagtgctgcagggcatcacctcctggggcagcgagccctgtgccctgcctgagcggcccagcctgtacaccaaggtggtgcactacaggaagtggatcaaggacaccatcgtggccaacccctag

SEQ ID NO: 20197 - DNA, 1590 bp, Artificial Sequence
  Description of Artificial Sequence: Synthetic coding sequence
atgagcaccaatgaaaatgccaacaccccagctgcccggctgcaccgcttcaagaacaagggcaaggacagcacagagatgagaagaagacgcatcgaggtgaatgtggagctgaggaaggccaagaaggatgaccagatgctgaagagaagaaatgtgtcctccttcccagatgatgccaccagccccctgcaggagaacagaaacaaccagggcaccgtgaactggagcgtggatgacatcgtgaagggcatcaacagcagcaatgtggagaaccagctgcaggccacccaggccgccaggaagctgctgagccgggagaagcagccccccatcgacaacatcatccgggccggcctcatccccaagtttgtgtccttcctgggccgcacagactgcagccccatccagtttgagagcgcctgggccctgaccaacatcgccagcggcaccagcgagcagaccaaggctgtggtggatggaggagccatcccagccttcatcagcctgctggccagcccccacgcccacatcagcgagcaggccgtgtgggccctgggcaacattgctggagatggcagcgtcttccgggacctggtgatcaagtatggagctgtggaccccctgctggccctgctggccgtgcctgacatgagcagcctggcctgtggctacctgaggaacctgacctggaccctgagcaacctgtgcaggaacaagaacccagccccacccattgatgctgtggagcagatcctgcccaccctggtgcggctgctgcaccatgatgatcctgaggtgctggccgacacctgctgggccatctcctacctgacagatggccccaatgaaagaattggcatggtggtgaagacaggagtggtgccccagctggtgaagctgctgggcgccagcgagctgcccatcgtgaccccagccctgcgggccatcggcaacatcgtgactggaacagatgagcagacccaggtggtgattgatgctggggccctggccgtgttccccagcctgctgaccaaccccaagaccaacatccagaaggaggccacctggaccatgagcaacatcacagctggccggcaggaccagatccagcaggtggtgaaccacggcctggtgcccttcctggtgtctgtgctgagcaaggctgacttcaagacccagaaggaggccgtgtgggccgtgaccaactacaccagcggcggcaccgtggagcagatcgtgtacctggtgcactgcggcatcatcgagcccctgatgaacctgctgacagccaaggacaccaagatcatcctggtgatcctggatgccatcagcaacatcttccaggccgctgagaagctgggggagacagagaagctgagcatcatgattgaggagtgtggcggcctggacaagattgaggccctgcagaaccatgaaaatgaatctgtgtacaaggccagcctgagcctcatcgagaagtacttctctgtggaggaggaggaggaccagaatgtggtgcctgagaccaccagcgagggctacaccttccaggtgcaggatggagcccctggcaccttcaacttctag

SEQ ID NO: 20198 - DNA, 1590 bp, Artificial Sequence; identical to SEQ ID NO: 20197
  Description of Artificial Sequence: Synthetic coding sequence

SEQ ID NO: 20199 - DNA, 1968 bp, Artificial Sequence
  Description of Artificial Sequence: Synthetic coding sequence
atgcccctgaagtggaagaccagcagccctgccatctggaagtttcctgtgcctgtgctgaagaccagccgcagcacccccctgagccctgcctacatcagcctggtggaggaggaggaccagcacatgaagctgagcctgggcggcagcgagatgggcctgagcagccacctgcagagcagcaaggccggccccacccgcatcttcaccagcaacacccacagctctgtggtgctgcagggctttgaccagctgcggctggagggcctgctgtgtgatgtgaccctgatgcctggggacacagatgatgccttccctgtgcaccgggtgatgatggccagcgccagtgactacttcaaggccatgttcaccggcggcatgaaggagcaggacctgatgtgcatcaagctgcacggcgtgtccaaggtgggcctgaggaagatcatcgacttcatctacacagccaagctgagcctgaacatggacaacctgcaggacaccctggaggccgccagcttcctgcagatcctgcctgtgctggacttctgcaaggtgttcctgatctctggagtgaccctggacaactgtgtggaggtgggccgcatcgccaacacctacaacctgacagaggtggacaagtatgtgaacagctttgtgctgaagaacttccctgccctgctgagcactggagagttcctgaagctgccctttgagcggctggcctttgtgctgagcagcaacagcctgaagcactgcacagagctggagctgttcaaggccacctgccgctggctgcggctggaggagcccaggatggactttgctgccaagctgatgaagaacatccgcttccccctgatgaccccccaggagctgatcaactacgtgcagacagtggacttcatgaggacagacaacacctgtgtgaacctgctgctggaggccagcaactaccagatgatgccctacatgcagcctgtgatgcagagcgacagaacagccatccgcagtgacaccacccacctggtgaccctgggcggcgtgctgcggcagcagctggtggtgtccaaggagctgaggatgtatgatgagaaggcccacgagtggaagagcctggcccccatggatgccccccgctaccagcacggcattgctgtgattggcaacttcctgtatgtggtgggcggccagagcaactatgacaccaagggcaagacagctgtggacaccgtcttccgctttgacccccgctacaacaagtggatgcaggtggccagcctgaatgagaagaggaccttcttccacctgagcgccctgaagggctacctgtatgctgtgggcggcagaaatgctgctggggagctgcccaccgtggagtgctacaaccccaggaccaatgagtggacctacgtggccaagatgtctgagccccactacggccacgccggcaccgtgtatggaggagtgatgtacatcagcggcggcatcacccatgacaccttccagaaggagctgatgtgctttgatcctgacacagacaagtggatccagaaggcccccatgaccaccgtgcggggcctgcactgcatgtgcaccgtgggggagcggctgtatgtgattggaggcaaccacttccggggcaccagtgactatgatgatgtgctgagctgtgagtactacagccccatcctggaccagtggacccccatcgccgccatgctgcggggccagagtgatgtgggcgtggccgtgtttgagaacaagatctacgtggtgggcggctacagctggaacaaccgctgcatggtggagatcgtgcagaagtatgaccctgacaaggatgagtggcacaaggtgtttgacctgcctgagagcctgggcggcatccgggcctgcaccctgactgtgttccccccagaggagaccacccccagccccagccgggagagccccctgagcgccccctag

SEQ ID NO: 20200 - DNA, 1815 bp, Artificial Sequence
  Description of Artificial Sequence: Synthetic coding sequence
atgggcctgagcagccacctgcagagcagcaaggccggccccacccgcatcttcaccagcaacacccacagctctgtggtgctgcagggctttgaccagctgcggctggagggcctgctgtgtgatgtgaccctgatgcctggggacacagatgatgccttccctgtgcaccgggtgatgatggccagcgccagtgactacttcaaggccatgttcaccggcggcatgaaggagcaggacctgatgtgcatcaagctgcatggagtgtccaaggtgggcctgaggaagatcatcgacttcatctacacagccaagctgagcctgaacatggacaacctgcaggacaccctggaggccgccagcttcctgcagatcctgcctgtgctggacttctgcaaggtgttcctgatcagcggcgtgaccctggacaactgtgtggaggtgggcagaattgccaacacctacaacctgacagaggtggacaagtatgtgaacagctttgtgctgaagaacttccctgccctgctgagcactggagagttcctgaagctgccctttgagcggctggcctttgtgctgagcagcaacagcctgaagcactgcacagagctggagctgttcaaggccacctgccgctggctgcggctggaggagcccaggatggactttgctgccaagctgatgaagaacatccgcttccccctgatgaccccccaggagctgatcaactacgtgcagacagtggacttcatgaggacagacaacacctgtgtgaacctgctgctggaggccagcaactaccagatgatgccctacatgcagcctgtgatgcagagcgacagaacagccatccgcagtgacaccacccacctggtgaccctgggcggcgtgctgcggcagcagctggtggtgtccaaggagctgaggatgtatgatgagaaggcccacgagtggaagagcctggcccccatggatgccccccgctaccagcacggcattgctgtgattggcaacttcctgtatgtggtgggcggccagagcaactatgacaccaagggcaagacagctgtggacacagtgttccgctttgacccccgctacaacaagtggatgcaggtggccagcctgaatgagaagaggaccttcttccacctgagcgccctgaagggctacctgtatgctgtgggcggcagaaatgctgctggggagctgcccaccgtggagtgctacaaccccaggaccaatgagtggacctacgtggccaagatgtctgagccccactacggccatgctggcaccgtgtatggaggagtgatgtacatcagcggcggcatcacccatgacaccttccagaaggagctgatgtgctttgatcctgacacagacaagtggatccagaaggcccccatgaccaccgtgcggggcctgcactgcatgtgcaccgtgggggagcggctgtatgtgattggaggcaaccacttccggggcaccagtgactatgatgatgtgctgagctgtgagtactacagccccatcctggaccagtggacccccatcgccgccatgctgcggggccagagtgatgtgggcgtggccgtgtttgagaacaagatctacgtggtgggcggctacagctggaacaaccgctgcatggtggagatcgtgcagaagtatgaccctgacaaggatgagtggcacaaggtgtttgacctgcctgagagcctgggcggcatccgggcctgcaccctgaccgtcttccccccagaggagaccacccccagccccagccgggagagccccctgagcgccccctag

SEQ ID NO: 20201 - DNA, 1815 bp, Artificial Sequence; identical to SEQ ID NO: 20200
  Description of Artificial Sequence: Synthetic coding sequence

SEQ ID NO: 20202 - DNA, 1815 bp, Artificial Sequence; identical to SEQ ID NO: 20200
  Description of Artificial Sequence: Synthetic coding sequence

SEQ ID NO: 20203 - DNA, 1815 bp, Artificial Sequence; identical to SEQ ID NO: 20200
  Description of Artificial Sequence: Synthetic coding sequence

SEQ ID NO: 20204 - DNA, 117 bp, Artificial Sequence
  Description of Artificial Sequence: Synthetic coding sequence
atgggcctgagcagccacctgcagagcagcaaggccggccccacccgcatcttcaccagcaacacccacagctctgtggtgctgcagggctttgaccagctgcggctggagggctag

SEQ ID NO: 20205 - DNA, 1815 bp, Artificial Sequence; identical to SEQ ID NO: 20200
  Description of Artificial Sequence: Synthetic coding sequence

SEQ ID NO: 20206 - DNA, 1977 bp, Artificial Sequence
  Description of Artificial Sequence: Synthetic coding sequence
atgatgagggtgcagaccctgcgggagaagtgggcctactggaggcggcggcagctgagcctgaagcaggccgacttcaaggacatcttcaagaagagcaccagcggcagcctggtggaggaggaggaccagcacatgaagctgagcctgggcggcagcgagatgggcctgagcagccacctgcagagcagcaaggccggccccacccgcatcttcaccagcaacacccacagctctgtggtgctgcagggctttgaccagctgcggctggagggcctgctgtgtgatgtgaccctgatgcctggggacacagatgatgccttccctgtgcaccgggtgatgatggccagcgccagtgactacttcaaggccatgttcaccggcggcatgaaggagcaggacctgatgtgcatcaagctgcatggagtgtccaaggtgggcctgaggaagatcatcgacttcatctacacagccaagctgagcctgaacatggacaacctgcaggacaccctggaggccgccagcttcctgcagatcctgcctgtgctggacttctgcaaggtgttcctgatcagcggcgtgaccctggacaactgtgtggaggtgggcagaattgccaacacctacaacctgacagaggtggacaagtatgtgaacagctttgtgctgaagaacttccctgccctgctgagcactggagagttcctgaagctgccctttgagcggctggcctttgtgctgagcagcaacagcctgaagcactgcacagagctggagctgttcaaggccacctgccgctggctgcggctggaggagcccaggatggactttgctgccaagctgatgaagaacatccgcttccccctgatgaccccccaggagctgatcaactacgtgcagacagtggacttcatgaggacagacaacacctgtgtgaacctgctgctggaggccagcaactaccagatgatgccctacatgcagcctgtgatgcagagcgacagaacagccatccgcagtgacaccacccacctggtgaccctgggcggcgtgctgcggcagcagctggtggtgtccaaggagctgaggatgtatgatgagaaggcccacgagtggaagagcctggcccccatggatgccccccgctaccagcacggcattgctgtgattggcaacttcctgtatgtggtgggcggccagagcaactatgacaccaagggcaagacagctgtggacacagtgttccgctttgacccccgctacaacaagtggatgcaggtggccagcctgaatgagaagaggaccttcttccacctgagcgccctgaagggctacctgtatgctgtgggcggcagaaatgctgctggggagctgcccaccgtggagtgctacaaccccaggaccaatgagtggacctacgtggccaagatgtctgagccccactacggccatgctggcaccgtgtatggaggagtgatgtacatcagcggcggcatcacccatgacaccttccagaaggagctgatgtgctttgatcctgacacagacaagtggatccagaaggcccccatgaccaccgtgcggggcctgcactgcatgtgcaccgtgggggagcggctgtatgtgattggaggcaaccacttccggggcaccagtgactatgatgatgtgctgagctgtgagtactacagccccatcctggaccagtggacccccatcgccgccatgctgcggggccagagtgatgtgggcgtggccgtgtttgagaacaagatctacgtggtgggcggctacagctggaacaaccgctgcatggtggagatcgtgcagaagtatgaccctgacaaggatgagtggcacaaggtgtttgacctgcctgagagcctgggcggcatccgggcctgcaccctgaccgtcttccccccagaggagaccacccccagccccagccgggagagccccctgagcgccccctag

SEQ ID NO: 20207 - DNA, 1920 bp, Artificial Sequence
  Description of Artificial Sequence: Synthetic coding sequence
atggaccacctgcacagaggagagctggtggccgccatcctgaggaacagaagcctggtggaggaggaggaccagcacatgaagctgagcctgggcggcagcgagatgggcctgagcagccacctgcagagcagcaaggccggccccacccgcatcttcaccagcaacacccacagctctgtggtgctgcagggctttgaccagctgcggctggagggcctgctgtgtgatgtgaccctgatgcctggggacacagatgatgccttccctgtgcaccgggtgatgatggccagcgccagtgactacttcaaggccatgttcaccggcggcatgaaggagcaggacctgatgtgcatcaagctgcacggcgtgtccaaggtgggcctgaggaagatcatcgacttcatctacacagccaagctgagcctgaacatggacaacctgcaggacaccctggaggccgccagcttcctgcagatcctgcctgtgctggacttctgcaaggtgttcctgatctctggagtgaccctggacaactgtgtggaggtgggccgcatcgccaacacctacaacctgacagaggtggacaagtatgtgaacagctttgtgctgaagaacttccctgccctgctgagcactggagagttcctgaagctgccctttgagcggctggcctttgtgctgagcagcaacagcctgaagcactgcacagagctggagctgttcaaggccacctgccgctggctgcggctggaggagcccaggatggactttgctgccaagctgatgaagaacatccgcttccccctgatgaccccccaggagctgatcaactacgtgcagacagtggacttcatgaggacagacaacacctgtgtgaacctgctgctggaggccagcaactaccagatgatgccctacatgcagcctgtgatgcagagcgacagaacagccatccgcagtgacaccacccacctggtgaccctgggcggcgtgctgcggcagcagctggtggtgtccaaggagctgaggatgtatgatgagaaggcccacgagtggaagagcctggcccccatggatgccccccgctaccagcacggcattgctgtgattggcaacttcctgtatgtggtgggcggccagagcaactatgacaccaagggcaagacagctgtggacaccgtcttccgctttgacccccgctacaacaagtggatgcaggtggccagcctgaatgagaagaggaccttcttccacctgagcgccctgaagggctacctgtatgctgtgggcggcagaaatgctgctggggagctgcccaccgtggagtgctacaaccccaggaccaatgagtggacctacgtggccaagatgtctgagccccactacggccacgccggcaccgtgtatggaggagtgatgtacatcagcggcggcatcacccatgacaccttccagaaggagctgatgtgctttgatcctgacacagacaagtggatccagaaggcccccatgaccaccgtgcggggcctgcactgcatgtgcaccgtgggggagcggctgtatgtgattggaggcaaccacttccggggcaccagtgactatgatgatgtgctgagctgtgagtactacagccccatcctggaccagtggacccccatcgccgccatgctgcggggccagagtgatgtgggcgtggccgtgtttgagaacaagatctacgtggtgggcggctacagctggaacaaccgctgcatggtggagatcgtgcagaagtatgaccctgacaaggatgagtggcacaaggtgtttgacctgcctgagagcctgggcggcatccgggcctgcaccctgactgtgttccccccagaggagaccacccccagccccagccgggagagccccctgagcgccccctag

SEQ ID NO: 20208 - DNA, 1920 bp, Artificial Sequence; identical to SEQ ID NO: 20207
  Description of Artificial Sequence: Synthetic coding sequence

SEQ ID NO: 20209 - DNA, 1842 bp, Artificial Sequence
  Description of Artificial Sequence: Synthetic coding sequence
atgaagctgagcctgggcggcagcgagatgggcctgagcagccacctgcagagcagcaaggccggccccacccgcatcttcaccagcaacacccacagctctgtggtgctgcagggctttgaccagctgcggctggagggcctgctgtgtgatgtgaccctgatgcctggggacacagatgatgccttccctgtgcaccgggtgatgatggccagcgccagtgactacttcaaggccatgttcaccggcggcatgaaggagcaggacctgatgtgcatcaagctgcacggcgtgtccaaggtgggcctgaggaagatcatcgacttcatctacacagccaagctgagcctgaacatggacaacctgcaggacaccctggaggccgccagcttcctgcagatcctgcctgtgctggacttctgcaaggtgttcctgatctctggagtgaccctggacaactgtgtggaggtgggccgcatcgccaacacctacaacctgacagaggtggacaagtatgtgaacagctttgtgctgaagaacttccctgccctgctgagcactggagagttcctgaagctgccctttgagcggctggcctttgtgctgagcagcaacagcctgaagcactgcacagagctggagctgttcaaggccacctgccgctggctgcggctggaggagcccaggatggactttgctgccaagctgatgaagaacatccgcttccccctgatgaccccccaggagctgatcaactacgtgcagacagtggacttcatgaggacagacaacacctgtgtgaacctgctgctggaggccagcaactaccagatgatgccctacatgcagcctgtgatgcagagcgacagaacagccatccgcagtgacaccacccacctggtgaccctgggcggcgtgctgcggcagcagctggtggtgtccaaggagctgaggatgtatgatgagaaggcccacgagtggaagagcctggcccccatggatgccccccgctaccagcacggcattgctgtgattggcaacttcctgtatgtggtgggcggccagagcaactatgacaccaagggcaagacagctgtggacaccgtcttccgctttgacccccgctacaacaagtggatgcaggtggccagcctgaatgagaagaggaccttcttccacctgagcgccctgaagggctacctgtatgctgtgggcggcagaaatgctgctggggagctgcccaccgtggagtgctacaaccccaggaccaatgagtggacctacgtggccaagatgtctgagccccactacggccacgccggcaccgtgtatggaggagtgatgtacatcagcggcggcatcacccatgacaccttccagaaggagctgatgtgctttgatcctgacacagacaagtggatccagaaggcccccatgaccaccgtgcggggcctgcactgcatgtgcaccgtgggggagcggctgtatgtgattggaggcaaccacttccggggcaccagtgactatgatgatgtgctgagctgtgagtactacagccccatcctggaccagtggacccccatcgccgccatgctgcggggccagagtgatgtgggcgtggccgtgtttgagaacaagatctacgtggtgggcggctacagctggaacaaccgctgcatggtggagatcgtgcagaagtatgaccctgacaaggatgagtggcacaaggtgtttgacctgcctgagagcctgggcggcatccgggcctgcaccctgactgtgttccccccagaggagaccacccccagccccagccgggagagccccctgagcgccccctag

SEQ ID NO: 20210 - DNA, 1419 bp, Artificial Sequence
  Description of Artificial Sequence: Synthetic coding sequence
atgaccacctgcagccggcagttcaccagcagcagctccatgaagggcagctgtggcatcggcggcggcatcggcggcggcagcagccgcatcagctctgtgctggccggcggcagctgccgggcccccagcacctacggcggcggcctgtctgtgagcagcagccgcttcagcagtggaggagcctgtggcctgggcggcggctatggaggcggcttcagcagcagcagcagcagctttggcagcggctttggaggcggctacggcggcggcctgggcgccggcctgggcggcggctttggaggcggctttgctggaggagatggcctgctggtgggcagcgagaaggtgaccatgcagaacctgaatgaccggctggccagctacctggacaaggtgcgggccctggaggaggccaatgctgacctggaggtgaagatccgggactggtaccagaggcagaggcctgctgagatcaaggactacagcccctacttcaagaccatcgaggacctgaggaacaagatcctgacagccaccgtggacaatgccaacgtgctgctgcagattgacaatgcccggctggccgcagatgacttccgcaccaagtatgaaacagagctgaacctgaggatgtctgtggaggccgacatcaatggcctgcggcgggtgctggatgagctgaccctggcccgggctgacctggagatgcagatcgagagcctgaaggaggagctggcctacctgaagaagaaccacgaggaggagatgaatgccctgcggggccaggtgggcggagatgtgaatgtggagatggatgctgcccctggggtggacctgagccgcatcctgaatgagatgagggaccagtatgagaagatggccgagaagaacaggaaggatgctgaggagtggttcttcaccaagacagaggagctgaaccgggaggtggccaccaacagcgagctggtgcagagcggcaagtctgagatcagcgagctgcggaggaccatgcagaacctggagattgagctgcagagccagctgtccatgaaggccagcctggagaacagcctggaggagaccaagggccgctactgcatgcagctggcccagatccaggagatgattggctctgtggaggagcagctggcccagctgcgctgtgagatggagcagcagaaccaggagtacaagatcctgctggatgtgaagacccggctggagcaggagatcgccacctaccgccgcctgctggagggggaggatgcccacctgagcagcagccagttcagcagcggcagccagagcagcagagatgtgaccagcagcagccggcagatccgcaccaaggtgatggatgtgcatgatggcaaggtggtgtccacccatgagcaggtgctgcggaccaagaactag

SEQ ID NO: 20211 - DNA, 1293 bp, Artificial Sequence
  Description of Artificial Sequence: Synthetic coding sequence
atgtccttcaccaccaggagcaccttcagcaccaactaccgcagcctgggctctgtgcaggcccccagctatggagcccggcctgtgtcctctgctgcctctgtgtatgctggggccggcggcagcggcagccgcatctctgtgagccgcagcaccagcttccggggcggcatgggcagcggcggcctggccactggaattgctgggggcctggccggcatgggcggcatccagaatgagaaggagaccatgcagagcctgaatgaccggctggccagctacctggacagagtgcgcagcctggagacagagaacagaaggctggagagcaagatccgggagcacctggagaagaagggcccccaggtgcgggactggagccactacttcaagatcatcgaggacctgcgggcccagatctttgccaacacagtggacaatgcccgcatcgtgctgcagattgacaatgcccggctggccgcagatgacttccgggtgaagtatgaaacagagctggccatgaggcagagcgtggagaatgacatccacggcctgaggaaggtgattgatgacaccaacatcacccggctgcagctggagacagaaattgaggccctgaaggaggagctgctcttcatgaagaagaaccacgaggaggaggtgaagggcctgcaggcccagatcgccagcagcggcctgactgtggaggtggatgcccccaagagccaggacctggccaagatcatggctgacatccgggcccagtatgatgagctggccaggaagaaccgggaggagctggacaagtactggagccagcagatcgaggagagcaccaccgtggtgaccacccagagcgctgaggtgggcgctgctgagaccaccctgacagagctgcggaggacagtgcagagcctggagattgacctggacagcatgaggaacctgaaggccagcctggagaacagcctgcgggaggtggaggcccgctatgccctgcagatggagcagctgaatggcatcctgctgcacctggagagcgagctggcccagaccagggctgagggccagaggcaggcccaggagtatgaggccctgctgaacatcaaggtgaagctggaggccgagatcgccacctacagaaggctgctggaggatggagaggacttcaacctgggagatgccctggacagcagcaacagcatgcagaccatccagaagaccaccaccaggagaattgtggatggcaaggtggtgtctgagaccaatgacaccaaggtgctgcggcactag

SEQ ID NO: 20212 - DNA, 1293 bp, Artificial Sequence; identical to SEQ ID NO: 20211
  Description of Artificial Sequence: Synthetic coding sequence

SEQ ID NO: 20213 - DNA, 1203 bp, Artificial Sequence
  Description of Artificial Sequence: Synthetic coding sequence
atgaccagctacagctaccggcagagcagcgccaccagcagctttggaggcctgggcggcggctctgtgcgctttggacctggggtggccttccgggcccccagcatccatggaggcagcggcggccggggcgtgtctgtgtcctctgccaggtttgtgagcagcagcagcagcggggcctatggaggcggctatggaggagtgctgacagccagtgatggcctgctggccggaaatgagaagctgaccatgcagaacctgaatgaccggctggccagctacctggacaaggtgcgggccctggaggccgccaatggagagctggaggtgaagatccgggactggtaccagaagcagggccctggccccagccgggactacagccactactacaccaccatccaggacctgcgggacaagatcctgggcgccaccatcgagaacagcagaattgtgctgcagattgacaatgcccggctggccgcagatgacttccgcaccaagtttgaaacagagcaggccctgaggatgtctgtggaggccgacatcaatggcctgcggcgggtgctggatgagctgaccctggccaggacagacctggagatgcagatcgagggcctgaaggaggagctggcctacctgaagaagaaccacgaggaggagatcagcaccctgcggggccaggtgggcggccaggtgtctgtggaggtggacagcgcccctggaacagacctggccaagatcctgagtgacatgaggagccagtatgaggtgatggccgagcagaacaggaaggatgctgaggcctggttcaccagcaggacagaggagctgaaccgggaggtggccggccacacagagcagctgcagatgagccgctctgaggtgacagacctgcggaggaccctgcagggcctggagattgagctgcagagccagctgtccatgaaggccgccctggaggacaccctggccgagacagaggccaggtttggagcccagctggcccacatccaggccctgatctctggaattgaggcccagctgggagatgtgcgggctgacagcgagcggcagaaccaggagtaccagaggctgatggacatcaagagccggctggagcaggagatcgccacctaccgcagcctgctggagggccaggaggaccactacaacaacctgagcgccagcaaggtgctgtag

SEQ ID NO: 20214 - DNA, 591 bp, Artificial Sequence
  Description of Artificial Sequence: Synthetic coding sequence
atgaccagctacagctaccggcagagcagcgccaccagcagctttggaggcctgggcggcggctctgtgcgctttggacctggggtggccttccgggcccccagcatccatggaggcagcggcggccggggcgtgtctgtgtcctctgccaggtttgtgagcagcagcagcagcggggcctatggaggcggctatggaggagtgctgacagccagtgatggcctgctggccggaaatgagaagctgaccatgcagaacctgaatgaccggctggccagctacctggacaaggtgcgggccctggaggccgccaatggagagctggagatcctgggcgccaccatcgagaacagccgcatcgtgctgcagattgacaatgcccggctggccgcagatgacttccgcaccaagtttgaaacagagcaggccctgaggatgtctgtggaggccgacatcaatggcctgcggcgggtgctggatgagctgaccctggccaggacagacctggagatgcagatcgagggcctgaaggaggagctggcctacctgaagaagaaccacgaggaggagatcagcaccctgcggggctag

SEQ ID NO: 20215 - DNA, 1773 bp, Artificial Sequence
  Description of Artificial Sequence: Synthetic coding sequence
atgagccggcagagctctgtgtccttccgcagcggcggcagccgctccttcagcacagccagcgccatcacccccagcgtgtccaggaccagcttcacctctgtgagccgcagcggcggcggcggcggcggcggcttcggccgggtgtccctggccggggcctgtggggtgggcggctacggcagccgcagcctgtacaacctgggcggcagcaagaggatcagcatcagcaccagcggcggcagcttcaggaacagatttggagctggagctgggggcggctacggctttggaggaggagctggcagcggctttggatttggaggaggagctgggggcggcttcggcctgggcggcggggccggctttggaggcggctttggaggccctggcttccctgtgtgccccccaggcggcatccaggaggtgacagtgaaccagagcctgctgacccccctgaacctgcagattgaccccagcatccagagggtgaggacagaggagcgggagcagatcaagaccctgaacaacaagtttgccagcttcatcgacaaggtgcgcttcctggagcagcagaacaaggtgctggacaccaagtggaccctgctgcaggagcagggcaccaagacagtgcggcagaacctggagcccctgtttgagcagtacatcaacaacctgcggcggcagctggacagcatcgtgggggagcggggccgcctggacagcgagctgaggaacatgcaggacctggtggaggacttcaagaacaagtatgaagatgagatcaacaagaggaccacagcagaaaatgaatttgtgatgctgaagaaggatgtggatgctgcctacatgaacaaggtggagctggaggccaaggtggatgccctgatggatgagatcaacttcatgaagatgttctttgatgctgagctgagccagatgcagacccacgtgtctgacacctctgtggtgctgtccatggacaacaacagaaacctggacctggacagcatcatcgccgaggtgaaggcccagtatgaggagatcgccaacagaagcaggacagaagctgagagctggtaccagaccaagtatgaggagctgcagcagacagctggaagacatggagatgacctgaggaacaccaagcatgagatcagcgagatgaacaggatgatccagaggctgcgggcagaaattgacaacgtgaagaagcagtgtgccaacctgcagaatgccatcgcagatgctgagcagagaggagagctggccctgaaggatgccaggaacaagctggccgagctggaggaggccctgcagaaggccaagcaggacatggcccggctgctgcgggagtaccaggagctgatgaacaccaagctggccctggatgtggagatcgccacctacaggaagctgctggagggggaggagtgccgcctgagcggggagggcgtgggccctgtgaacatctctgtggtgaccagctctgtgagcagcggctacggcagcggcagcggctacggcggcggcctgggcggcggcctgggcggcggcctgggcggcggcctggccggcggcagcagcggcagctactacagcagcagcagtggaggagtgggcctgggcggcggcctgtctgtgggcggcagcggcttcagcgccagcagcggccggggcctgggcgtgggctttggaagtggcggcggcagcagcagctctgtgaagtttgtgtccaccaccagcagcagcaggaagagcttcaagagctag

SEQ ID NO: 20216 - DNA, 1668 bp, Artificial Sequence
  Description of Artificial Sequence: Synthetic coding sequence
atgagccggcagagctctgtgtccttccgcagcggcggcagccgctccttcagcacagccagcgccatcacccccagcgtgtccaggaccagcttcacctctgtgagccgcagcggcggcggcggcggcggcggcttcggccgggtgtccctggccggggcctgtggggtgggcggctacggctttggaggaggagctggcagcggcttcggctttggaggaggagctgggggcggcttcggcctgggcggcggggccggctttggaggcggctttggaggccctggcttccctgtgtgccccccaggcggcatccaggaggtgacagtgaaccagagcctgctgacccccctgaacctgcagattgaccccagcatccagagggtgaggacagaggagcgggagcagatcaagaccctgaacaacaagtttgccagcttcatcgacaaggtgcgcttcctggagcagcagaacaaggtgctggacaccaagtggaccctgctgcaggagcagggcaccaagacagtgcggcagaacctggagcccctgtttgagcagtacatcaacaacctgcggcggcagctggacagcatcgtgggggagcggggccgcctggacagcgagctgaggaacatgcaggacctggtggaggacttcaagaacaagtatgaagatgagatcaacaagaggaccacagcagaaaatgaatttgtgatgctgaagaaggatgtggatgctgcctacatgaacaaggtggagctggaggccaaggtggatgccctgatggatgagatcaacttcatgaagatgttctttgatgctgagctgagccagatgcagacccacgtgtctgacacctctgtggtgctgtccatggacaacaacagaaacctggacctggacagcatcatcgccgaggtgaaggcccagtatgaggagatcgccaacagaagcaggacagaggccgagagctggtaccagaccaagtatgaggagctgcagcagacagctggaagacatggagatgacctgaggaacaccaagcatgagatcagcgagatgaacaggatgatccagaggctgcgggcagaaattgacaacgtgaagaagcagtgtgccaacctgcagaatgccatcgcagatgctgagcagagaggagagctggccctgaaggatgccaggaacaagctggccgagctggaggaggccctgcagaaggccaagcaggacatggcccggctgctgcgggagtaccaggagctgatgaacaccaagctggccctggatgtggagatcgccacctacaggaagctgctggagggggaggagtgccgcctgtctggagagggcgtgggccctgtgaacatctctgtggtgaccagctctgtgagcagcggctacggcagcggcagcggctatggaggcggcctgggcggcggcctgggcggcggcctgggcggcggcctggccggcggcagcagcggcagctactacagcagcagcagcggcggcgtgggcctgggcggcggcctgtctgtgggcggcagcggcttcagcgccagcagcggccggggcctgggcgtgggcttcggcagcggcggcggcagcagcagctctgtgaagtttgtgtccaccaccagcagcagcaggaagagcttcaagagctag

SEQ ID NO: 20217 - DNA, 399 bp, Artificial Sequence
  Description of Artificial Sequence: Synthetic coding sequence
atgagccggcagagctctgtgtccttccgcagcggcggcagccgctccttcagcacagccagcgccatcacccccagcgtgtccaggaccagcttcacctctgtgagccgcagcggcggcggcggcggcggcggcttcggccgggtgtccctggccggggcctgtggggtgggcggctacggcagccgcagcctgtacaacctgggcggcagcaagaggatcagcatcagcaccagcggcggcagcttcaggaacagatttggagctggagctgggggcggctacggctttggaggaggagctggcagcggctttggatttggaggaggagctgggggcggcttcggcctgggcggcggggccggctttggaggcggctttggaggccctggcttctag

SEQ ID NO: 20218 - DNA, 1410 bp, Artificial Sequence
  Description of Artificial Sequence: Synthetic coding sequence
atgagcatccacttcagcagccctgtgttcaccagccgctctgctgccttcagcggccgcggggcccaggtgcggctgagcagcgcccggcctgggggcctgggcagcagcagcctgtatggcctgggcgccagccggccccgggtggccgtgcgcagcgcctatggaggccctgtgggcgccggcatccgggaggtgaccatcaaccagagcctgctggcccccctgcggctggatgctgaccccagcctgcagagggtgcggcaggaggagagcgagcagatcaagaccctgaacaacaagtttgccagcttcatcgacaaggtgcgcttcctggagcagcagaacaagctgctggagaccaagtggaccctgctgcaggagcagaagagcgccaagagcagccggctgcctgacatctttgaggcccagattgctggcctgcggggccagctggaggccctgcaggtggatggcggccgcctggaggccgagctgcgctccatgcaggatgtggtggaggacttcaagaacaagtatgaagatgagatcaaccacaggacagctgctgaaaatgaatttgtggtgctgaagaaggatgtggatgctgcctacatgagcaaggtggagctggaggccaaggtggatgccctgaatgatgagatcaacttcctgcggaccctgaatgaaacagagctgacagagctgcagagccagatcagtgacacctctgtggtgctgtccatggacaacagccgcagcctggacctggatggcatcatcgccgaggtgaaggcccagtatgaggagatggccaagtgcagcagagctgaggccgaggcctggtaccagaccaagtttgagaccctgcaggcccaggccggcaagcatggagatgacctgaggaacaccagaaatgagatcagcgagatgaacagagccatccagaggctgcaggccgagattgacaacatcaagaaccagagggccaagctggaggccgccatcgccgaggccgaggagcggggggagctggccctgaaggatgcccgggccaagcaggaggagctggaggccgccctgcagaggggcaagcaggacatggcccggcagctgcgggagtaccaggagctgatgtctgtgaagctggccctggacattgaaattgccacctacaggaagctgctggagggggaggagagccggctggccggagatggagtgggcgctgtgaacatctctgtgatgaacagcactggaggcagcagcagcggcggcggcatcggcctgaccctgggcggcaccatgggcagcaatgccctgtccttcagcagcagcgctggccctggcctgctgaaggcctacagcatcagaacagccagcgccagccgccgcagcgcccgggactag

SEQ ID NO: 20219 - DNA, 1338 bp, Artificial Sequence
  Description of Artificial Sequence: Synthetic coding sequence
atgagcatccacttcagcagccctgtgttcaccagccgctctgctgccttcagcggccgcggggcccaggtgcggctgagcagcgcccggcctgggggcctgggcagcagcagcctgtatggcctgggcgccagccggccccgggtggcccccctgcggctggatgctgaccccagcctgcagagggtgcggcaggaggagagcgagcagatcaagaccctgaacaacaagtttgccagcttcatcgacaaggtgcgcttcctggagcagcagaacaagctgctggagaccaagtggaccctgctgcaggagcagaagagcgccaagagcagccggctgcctgacatctttgaggcccagattgctggcctgcggggccagctggaggccctgcaggtggatggcggccgcctggaggccgagctgcgctccatgcaggatgtggtggaggacttcaagaacagatatgaagatgagatcaaccacaggacagctgctgaaaatgaatttgtggtgctgaagaaggatgtggatgctgcctacatgagcaaggtggagctggaggccaaggtggatgccctgaatgatgagatcaacttcctgcggaccctgaatgaaacagagctgacagagctgcagagccagatcagtgacacctctgtggtgctgtccatggacaacagccgcagcctggacctggatggcatcatcgccgaggtgaaggcccagtatgaggagatggccaagtgcagcagagctgaggccgaggcctggtaccagaccaagtttgagaccctgcaggcccaggccggcaagcatggagatgacctgaggaacaccagaaatgagatcagcgagatgaacagagccatccagaggctgcaggccgagattgacaacatcaagaaccagagggccaagctggaggccgccatcgccgaggccgaggagcggggggagctggccctgaaggatgcccgggccaagcaggaggagctggaggccgccctgcagaggggcaagcaggacatggcccggcagctgcgggagtaccaggagctgatgtctgtgaagctggccctggacattgaaattgccacctacaggaagctgctggagggggaggagagccggctggccggagatggagtgggcgctgtgaacatctctgtgatgaacagcactggaggcagcagcagcggcggcggcatcggcctgaccctgggcggcaccatgggcagcaatgccctgtccttcagcagcagcgctggccctggcctgctgaaggcctacagcatcagaacagccagcgccagccgccgcagcgcccgggactag

SEQ ID NO: 20220 - DNA, 1212 bp, Artificial Sequence
  Description of Artificial Sequence: Synthetic coding sequence
atgagcatccacttcagcagccctgtgttcaccagccgctctgctgccttcagcggccgcggggcccaggtgcggctgagcagcgcccggcctgggggcctgggcagcagcagcctgtatggcctgggcgccagccggccccgggtggccgtgcgcagcgcctatggaggccctgtgggcgccggcatccgggaggtgaccatcaaccagagcctgctggcccccctgcggctggatgctgaccccagcctgcagagggtgcggcaggaggagagcgagcagatcaagaccctgaacaacaagtttgccagcttcatcgacaaggtgcgcttcctggagcagcagaacaagctgctggagaccaagtggaccctgctgcaggagcagaagagcgccaagagcagccggctgcctgacatctttgaggcccagattgctggcctgcggggccagctggaggccctgcaggtggatggcggccgcctggaggccgagctgcgctccatgcaggatgtggtggaggacttcaagaacaagtatgaagatgagatcaaccacaggacagctgctgaaaatgaatttgtggtgctgaagaaggatgtggatgctgcctacatgagcaaggtggagctggaggccaaggtggatgccctgaatgatgagatcaacttcctgcggaccctgaatgaaacagagatccacgtgctgcagagccacatcagtgacacctctgtggtggtgaagctggacaacagccaggacctgaacatggactgcatcatcgccgagatcaaggcccagtatgatgacatcgtgacctgctcctgggccaaggccgagagctggtaccacggctgcctggagatgaaggccaccgtcatctggcacggggagaccgtgggctgcaccaaggaggagatcaaggagctgacccacatgatccagaggctgatggccaaggtggagaatgccaagtgccagaacagcaagctggaggtggaggtgacccagagcgagcagcagggcgaggtggccctgagtgacaaccgctgcaagctggtggagctggagggcaccatgcagaaggcccggcagtaccaggaggtgatgaacagcaagctgggcctgaatgtgaaggccgccagcagctgccacctgctggatggagaggagcagaggctgtgtgatggcatctctgctgtgaacatctag

SEQ ID NO: 20221 - DNA, 1452 bp, Artificial Sequence
  Description of Artificial Sequence: Synthetic coding sequence
atgagcatccgggtgacccagaagagctacaaggtgtccaccagcggcccccgggccttcagcagccgcagctacaccagcggccctggcagccgcatcagcagcagcagcttcagccgggtgggcagcagcaacttccggggcggcctgggcggcggctacggcggggccagcggcatgggcggcatcacagctgtgacagtgaaccagagcctgctgagccccctggtgctggaggtggaccccaacatccaggccgtgaggacccaggagaaggagcagatcaagaccctgaacaacaagtttgccagcttcatcgacaaggtgcgcttcctggagcagcagaacaagatgctggagaccaagtggagcctgctgcagcagcagaagacagcccggagcaacatggacaacatgtttgagagctacatcaacaacctgcggcggcagctggagaccctgggccaggagaagctgaagctggaggccgagctgggcaacatgcagggcctggtggaggacttcaagaacaagtatgaagatgagatcaacaagaggacagagatggagaatgaatttgtgctgatcaagaaggatgtggatgaggcctacatgaacaaggtggagctggagagccggctggagggcctgacagatgagatcaacttcctgcggcagctgtatgaggaggagatccgggagctgcagagccagatcagtgacacctctgtggtgctgtccatggacaacagccgcagcctggacatggacagcatcatcgccgaggtgaaggcccagtatgaggacatcgccaacagaagcagagctgaggccgagagcatgtaccagatcaagtatgaggagctgcagagcctggccggcaagcatggagatgacctgcggaggaccaagacagagatcagcgagatgaacagaaacatcagccggctgcaggccgagattgagggcctgaagggccagagggccagcctggaggccgccatcgcagatgctgagcagagaggagagctggccatcaaggatgccaatgccaagctgtctgagctggaggccgccctgcagagggccaagcaggacatggcccggcagctgcgggagtaccaggagctgatgaatgtgaagctggccctggacatcgagatcgccacctacaggaagctgctggagggggaggagagccggctggagagcggcatgcagaacatgagcatccacaccaagaccaccagcggctacgccggcggcctgagcagcgcctatggaggcctgaccagccctggcctgagctacagcctgggcagcagctttggaagtggagctggcagcagcagcttcagcaggaccagcagcagcagagctgtggtggtgaagaagattgagaccagagatggcaagctggtgtctgagagcagtgatgtgctgcccaagtag

SEQ ID NO: 20222 - DNA, 822 bp, Artificial Sequence
  Description of Artificial Sequence: Synthetic coding sequence
atgagcatccgggtgacccagaagagctacaaggtgtccaccagcggcccccgggccttcagcagccgcagctacaccagcggccctggcagccgcatcagcagcagcagcttcagccgggtgggcagcagcaacttccggggcggcctgggcggcggctacggcggggccagcggcatgggcggcatcacagctgtgacagtgaaccagagcctgctgagccccctggtgctggaggtggaccccaacatccaggccgtgaggacccaggagaaggagcagatcaagaccctgaacaacaagtttgccagcttcatcgacaaggtgcgcttcctggagcagcagaacaagatgctggagaccaagtggagcctgctgcagcagcagaagacagcccggagcaacatggacaacatgtttgagagctacatcaacaacctgcggcggcagctggagaccctgggccaggagaagctgaagctggaggccgagctgggcaacatgcagggcctggtggaggacttcaagaacaagtatgaagatgagatcaacaagaggacagagatggagaatgaatttgtgctgatcaagaaggatgtggatgaggcctacatgaacaaggtggagctggagagccggctggagggcctgacagatgagatcaacttcctgcggcagctgtatgaggaggagatccgggagctgcagagccagatcagtgacacctctgtggtgctgtccatggacaacagccgcagcctggacatggacagcatcatcgccgaggtgaaggcccagtatgaggacatcgccaacagatag

SEQ ID NO: 20223 - DNA, 1452 bp, Artificial Sequence; identical to SEQ ID NO: 20221
  Description of Artificial Sequence: Synthetic coding sequence

SEQ ID NO: 20224 - DNA, 534 bp, Artificial Sequence
  Description of Artificial Sequence: Synthetic coding sequence
atgagcatccgggtgacccagaagagctacaaggtgtccaccagcggcccccgggccttcagcagccgcagctacaccagcggccctggcagccgcatcagcagcagcagcttcagccgggtgggcagcagcaacttccggggcggcctgggcggcggctacggcggggccagcggcatgggcggcatcacagctgtgacagtgaaccagagcctgctgagccccctggtgctggaggtggaccccaacatccaggccgtgaggacccaggagaaggagcagatcaagaccctgaacaacaagtttgccagcttcatcgacaaggtgcgcttcctggagcagcagaacaagatgctggagaccaagtggagcctgctgcagcagcagaagacagcccggagcaacatggacaacatgtttgagagctacatcaacaacctgcggcggcagctggagaccctgggccaggagaagctgaagctggaggccgagctgggcaacatgcagggcctggtggaggacttcaagaactag

SEQ ID NO: 20225 - DNA, 1536 bp, Artificial Sequence
  Description of Artificial Sequence: Synthetic coding sequence
atgaatggagtgtcctggagccaggacctgcaggagggcatcagcgcctggtttggccccccagccagcaccccagccagcaccatgagcatccgggtgacccagaagagctacaaggtgtccaccagcggcccccgggccttcagcagccgcagctacaccagcggccctggcagccgcatcagcagcagcagcttcagccgggtgggcagcagcaacttccggggcggcctgggcggcggctacggcggggccagcggcatgggcggcatcacagctgtgacagtgaaccagagcctgctgagccccctggtgctggaggtggaccccaacatccaggccgtgaggacccaggagaaggagcagatcaagaccctgaacaacaagtttgccagcttcatcgacaaggtgcgcttcctggagcagcagaacaagatgctggagaccaagtggagcctgctgcagcagcagaagacagcccggagcaacatggacaacatgtttgagagctacatcaacaacctgcggcggcagctggagaccctgggccaggagaagctgaagctggaggccgagctgggcaacatgcagggcctggtggaggacttcaagaacaagtatgaagatgagatcaacaagaggacagagatggagaatgaatttgtgctgatcaagaaggatgtggatgaggcctacatgaacaaggtggagctggagagccggctggagggcctgacagatgagatcaacttcctgcggcagctgtatgaggaggagatccgggagctgcagagccagatcagtgacacctctgtggtgctgtccatggacaacagccgcagcctggacatggacagcatcatcgccgaggtgaaggcccagtatgaggacatcgccaacagaagcagagctgaggccgagagcatgtaccagatcaagtatgaggagctgcagagcctggccggcaagcatggagatgacctgcggaggaccaagacagagatcagcgagatgaacagaaacatcagccggctgcaggccgagattgagggcctgaagggccagagggccagcctggaggccgccatcgcagatgctgagcagagaggagagctggccatcaaggatgccaatgccaagctgtctgagctggaggccgccctgcagagggccaagcaggacatggcccggcagctgcgggagtaccaggagctgatgaatgtgaagctggccctggacatcgagatcgccacctacaggaagctgctggagggggaggagagccggctggagagcggcatgcagaacatgagcatccacaccaagaccaccagcggctacgccggcggcctgagcagcgcctatggaggcctgaccagccctggcctgagctacagcctgggcagcagctttggaagtggagctggcagcagcagcttcagcaggaccagcagcagcagagctgtggtggtgaagaagattgagaccagagatggcaagctggtgtctgagagcagtgatgtgctgcccaagtag

SEQ ID NO: 20226 - DNA, 1452 bp, Artificial Sequence; identical to SEQ ID NO: 20221
  Description of Artificial Sequence: Synthetic coding sequence

SEQ ID NO: 20227 - DNA, 4071 bp, Artificial Sequence
  Description of Artificial Sequence: Synthetic coding sequence
atgcagagcaaggtgctgctggccgtggccctgtggctgtgtgtggagaccagggctgcctctgtgggcctgcccagcgtgtccctggacctgccccggctgagcatccagaaggacatcctgaccatcaaggccaacaccaccctgcagatcacctgccggggccagagggacctggactggctgtggcccaacaaccagagcggcagcgagcagagggtggaggtgacagagtgcagtgatggcctcttctgcaagaccctgaccatccccaaggtgattggaaatgacaccggggcctacaagtgcttctaccgggagacagacctggccagcgtcatctacgtgtatgtgcaggactaccgcagccccttcatcgcctctgtgtctgaccagcacggcgtggtgtacatcacagagaacaagaacaagacagtggtgatcccctgcctgggcagcatcagcaacctgaatgtgtccctgtgtgcccgctacccagagaagagatttgtgcctgatggcaaccgcatctcctgggacagcaagaagggcttcaccatccccagctacatgatctcctatgccggcatggtgttctgtgaggccaagatcaatgatgagagctaccagagcatcatgtacatcgtggtggtggtgggctaccgcatctatgatgtggtgctgagccccagccacggcatcgagctgtctgtgggggagaagctggtgctgaactgcacagccaggacagagctgaatgtgggcatcgacttcaactgggagtaccccagcagcaagcaccagcacaagaagctggtgaacagagacctgaagacccagagcggcagcgagatgaagaagttcctgagcaccctgaccattgatggagtgaccaggagtgaccagggcctgtacacctgtgccgccagcagcggcctgatgaccaagaagaacagcacctttgtgcgggtgcatgagaagccctttgtggccttcggcagcggcatggagagcctggtggaggccaccgtgggggagcgggtgcgcatcccagccaagtacctgggctacccacctcctgagatcaagtggtacaagaatggcatccccctggagagcaaccacaccatcaaggccggccacgtgctgaccatcatggaggtgtctgagcgggacaccggcaactacaccgtcatcctgaccaaccccatcagcaaggagaagcagagccacgtggtgtccctggtggtgtatgtgcccccccagattggagagaagagcctcatcagccctgtggacagctaccagtatggcaccacccagaccctgacctgcaccgtgtatgccatccccccaccccaccacatccactggtactggcagctggaggaggagtgtgccaatgagcccagccaggccgtgtctgtgaccaacccctacccctgtgaggagtggaggtctgtggaggacttccagggcggcaacaagattgaggtgaacaagaaccagtttgccctgattgagggcaagaacaagacagtgtccaccctggtgatccaggccgccaacgtgtctgccctgtacaagtgtgaggccgtgaacaaggtgggccgcggggagagggtcatctccttccacgtgacccggggccctgagatcaccctgcagcctgacatgcagcccacagagcaggagagcgtgtccctgtggtgcacagctgacaggagcacctttgagaacctgacctggtacaagctgggcccccagcccctgcccatccacgtgggggagctgcccacccctgtgtgcaagaacctggacaccctgtggaagctgaatgccaccatgttcagcaacagcaccaatgacatcctgatcatggagctgaagaatgccagcctgcaggaccagggcgactatgtgtgcctggcccaggacaggaagaccaagaagaggcactgtgtggtgcggcagctgactgtgctggagcgggtggcccccaccatcaccggcaacctggagaaccagaccaccagcatcggggagagcattgaggtgtcctgcacagccagcggcaaccccccaccccagatcatgtggttcaaggacaatgagaccctggtggaggacagcggcatcgtgctgaaggatggcaacagaaacctgaccatcagaagagtgaggaaggaggatgagggcctgtacacctgccaggcctgcagcgtgctgggctgtgccaaggtggaggccttcttcatcatcgagggcgcccaggagaagaccaacctggagatcatcatcctggtgggcacagctgtgattgccatgttcttctggctgctgctggtgatcatcctgaggacagtgaagagggccaatggaggagagctgaagacaggctacctgagcatcgtgatggaccctgatgagctgcccctggatgagcactgtgagcggctgccctatgatgccagcaagtgggagttcccccgggaccggctgaagctgggcaagcccctgggccgcggggccttcggccaggtgattgaagcagatgccttcggcatcgacaagacagccacctgcaggacagtggccgtgaagatgctgaaggagggcgccacccacagcgagcaccgggccctgatgtctgagctgaagatcctgatccacatcggccaccacctgaatgtggtgaacctgctgggcgcctgcaccaagccaggcggccccctgatggtgattgtggagttctgcaagtttggaaacctgagcacctacctgcggagcaagagaaatgaatttgtgccctacaagaccaagggggcccgcttccggcagggcaaggactatgtgggcgccatccctgtggacctgaagaggcggctggacagcatcaccagcagccagagcagcgccagcagcggctttgtggaggagaagagcctgagtgatgtggaggaggaggaggccccagaagatctctacaaggacttcctgaccctggagcacctgatctgctacagcttccaggtggccaagggcatggagttcctggccagcaggaagtgcatccaccgggacctggccgccaggaacatcctgctgtctgagaagaatgtggtgaagatctgtgactttggcctggcccgggacatctacaaggaccctgactatgtgaggaaaggagatgcccggctgcccctgaagtggatggcccctgagaccatctttgacagagtgtacaccatccagagtgatgtgtggagctttggagtgctgctgtgggagatcttcagcctgggcgccagcccctacccaggagtgaagattgatgaggagttctgccggcggctgaaggagggcaccaggatgagggccccagactacaccaccccagagatgtaccagaccatgctggactgctggcacggggagcccagccagaggcccaccttcagcgagctggtggagcacctgggcaacctgctgcaggccaatgcccagcaggacggcaaggactacatcgtgctgcccatcagcgagaccctgtccatggaggaggacagcggcctgagcctgcccaccagccctgtgtcctgcatggaggaggaggaggtgtgtgaccccaagttccactatgacaacacagctggcatcagccagtacctgcagaacagcaagaggaagagcaggcctgtgtctgtgaagacctttgaggacatccccctggaggagcctgaggtgaaggtgatcccagatgacaaccagacagacagcggcatggtgctggccagcgaggagctgaagaccctggaggacaggaccaagctgagccccagctttggaggcatggtgcccagcaagagccgggagagcgtggccagcgagggcagcaaccagaccagcggctaccagagcggctaccacagtgatgacacagacaccaccgtgtacagcagcgaggaggccgagctgctgaagctgattgaaattggagtgcagacaggcagcacagcccagatcctgcagccagattctggcaccaccctgagcagcccccctgtgtag

SEQ ID NO: 20228 - DNA, 6630 bp, Artificial Sequence
  Description of Artificial Sequence: Synthetic coding sequence
atgtggaatgacatcgagctgctgaccaatgatgacaccggcagcggctacctgtctgtgggcagcaggaaggagcacggcacagccctgtaccaggtggacctgctggtgaagatcagcagcgagaaggccagcctgaaccccaagatccaggcctgcagcctgagtgatggcttcatcatcgtggccgaccagagcgtcatcctgctggacagcatctgccgcagcctgcagctgcacctggtgtttgacacagaggtggatgtggtgggcctgtgccaggagggcaagttcctgctggtgggggagaggagcggcaacctgcacctgatccacgtgaccagcaagcagaccctgctgaccaatgcctttgtgcagaaggccaatgatgaaaatagaaggacctaccagaacctggtgattgagaaggatggcagcaatgaaggcacctactacatgctgctgctgacctacagcggcttcttctgcatcaccaacctgcagctgctgaagatccagcaggccattgaaaatgtggacttcagcacagccaagaagctgcagggccagatcaagagcagcttcatcagcacagagaactaccacaccctgggctgcctgagcctggtggccggggacctggccagcgaggtgcctgtgatcatcggcggcactggaaactgtgccttcagcaagtgggagccagacagcagcaagaagggcatgacagtgaagaacctgattgatgctgagatcatcaagggggccaagaagttccagctgattgacaacctgctgtttgtgctggacacagacaacgtgctgagcctgtgggacatctacaccctgacccctgtgtggaactggcccagcctgcacgtggaggagttcctgctgaccacagaagctgacagccccagctctgtgacctggcagggcatcaccaacctgaagctgattgccctgacagccagcgccaacaagaagatgaagaacctgatggtgtacagcctgcccaccatggagatcctgtacagcctggaggtgtcctctgtgagcagcctggtgcagacaggcatcagcacagacaccatctacctgctggagggcgtgtgcaagaatgaccccaagctgtctgaggacagcgtgtctgtgctggtgctgcgctgcctgacagaggccctgcctgaaaatcggctgagccggctgctgcacaagcacagatttgctgaggccgagagctttgccatccagtttggcctggatgtggagctggtgtacaaggtgaagagcaaccacatcctggagaagctggccctgagctctgtggatgccagcgagcagacagagtggcagcagctggtggatgatgccaaggagaacctgcacaagatccaggatgatgaatttgtggtgaactactgcctgaaggcccagtggatcacctatgagaccacccaggagatgctgaactatgccaagacccggctgctgaagaaggaggacaagacagccctgatctacagtgatggcctgaaggaggtgctgcgggcccacgccaagctgaccaccttctacggggcctttggacctgagaagttcagcggcagctcctggattgagttcctgaacaatgaagatgacctgaaggacatcttcctgcagctgaaggagggcaacctggtgtgtgcccagtacctgtggctgcggcaccgggccaactttgagagcagatttgatgtgaagatgctggagagcctgctgaacagcatgtctgcctctgtgtccctgcagaagctgtgcccctggttcaagaatgatgtgatcccctttgtgagaagaacagtgcctgagggccagatcatcctggccaagtggctggagcaggccgccaggaacctggagctgacagacaaggccaactggccagaaaatggcctgcagctggccgagatcttcttcaccgctgagaagacagatgagctgggcctggccagctcctggcactggatcagcctgaaggactaccagaacacagaggaggtgtgccagctgcggaccctggtgaacaacctgcgggagctgatcaccctgcacaggaagtacaactgcaagctggccctgagtgactttgagaaggagaacaccaccaccatcgtgttcaggatgtttgacaaggtgctggcccctgagctgatccccagcatcctggagaagttcatccgggtgtacatgagggagcatgacctgcaggaggaggagctgctgctgctgtacatcgaggacctgctgaaccgctgcagcagcaagagcaccagcctgtttgaaacagcctgggaggccaaggccatggctgtgattgcctgcctgagtgacacagacctgatctttgatgctgtgctgaagatcatgtatgctgctgtggtgccctggagcgctgctgtggagcagctggtgaagcagcacctggagatggaccaccccaaggtgaagctgctgcaggagagctacaagctgatggagatgaagaagctgctgcggggctacggcatccgggaggtgaacctgctgaacaaggagatcatgagggtggtgcgctacatcctgaagcaggatgtgcccagcagcctggaggatgccctgaaggtggcccaggccttcatgctgagtgatgatgagatctacagcctgcgcatcatcgacctgattgaccgggagcagggcgaggactgcctgctgctgctgaagagcctgcccccagctgaggccgagaagacagctgagagggtcatcatctgggcccggctggccctgcaggaggagccagaccacagcaaggagggcaaggcctggaggatgtctgtggccaagacctctgtggacatcctgaagatcctgtgtgacatccagaaggacaacctgcagaagaaggatgaatgtgaggagatgctgaagctgttcaaggaggtggccagcctgcaggagaactttgaggtgttcctgagctttgaggactacagcaacagcagcctggtggccgacctgcgggagcagcacatcaaggcccacgaggtggcccaggccaagcacaagccaggcagcaccccagagcccatcgctgctgaggtgcgcagccccagcatggagagcaagctgcaccggcaggccctggccctgcagatgagcaagcaggagctggaggccgagctgaccctgcgggccctgaaggatggcaacatcaagacagccctgaagaagtgcagcgacctcttcaagtaccactgcaatgctgacaccgggaagctgctcttcctgacctgccagaagctgtgccagatgctggccgacaacgtgcctgtgacagtgcctgtgggcctgaacctgcccagcatgattcatgacctggccagccaggccgccaccatctgcagcccagacttcctgctggatgccctggagctgtgcaagcacaccctgatggctgtggagctgagccggcagtgccagatggatgactgtggcatcctgatgaaggccagctttggcacccacaaggacccctatgaggagtggagctacagcgacttcttctctgaagatggcatcgtgctggagagccagatggtgctgcctgtgatctatgagctgatcagcagcctggtgcccctggccgagagcaagcgctaccccctggagagcaccagcctgccctactgcagcctgaatgaaggagatggcctggtgctgcccgtcatcaacagcatcagcgccctgctgcagaacctgcaggagagcagccagtgggagctggccctgcgctttgtggtgggcagctttggcacctgcctgcagcacagcgtgagcaacttcatgaatgccaccctgtctgagaagctgtttggagagaccaccctggtgaagagccgccacgtggtgatggagctgaaggagaaggctgtgatcttcatcagagaaaatgccaccaccctgctgcacaaggtgttcaactgccgcctggtggacctggacctggccctgggctactgcaccctgctgccccagaaggatgtgtttgagaacctgtggaagctgattgacaaggcctggcagaactatgacaagatcctggccatcagcctggtgggcagcgagctggccagcctgtaccaggagattgagatgggcctgaagttccgggagctgagcacagatgcccagtggggcatccggctgggcaagctgggcatctccttccagcccgtcttccggcagcacttcctgaccaagaaggacctgatcaaggccctggtggagaacatcgacatggacaccagcctcatcctggagtactgcagcaccttccagctggactgtgatgctgtgctgcagctgttcatcgagaccctgctgcacaacaccaatgccggccagggccagggagatgcctccatggacagcgccaagagaagacaccccaagctgctggccaaggccctggagatggtgcccctgctgaccagcaccaaggacctggtgatcagcctgagcggcatcctgcacaagctggacccctatgactatgagatgattgaggtggtgctgaaggtgattgagcgggcagatgagaagatcaccaacatcaacatcaaccaggccctgagcatcctgaagcacctgaagagctaccgccgcatcagcccccctgtggacctggagtaccagtacatgctggagcacgtgatcaccctgcccagcgctgcccagacccggctgcccttccacctgatcttcttcggcacagcccagaacttctggaagatcctgagcacagagctgtctgaggagagcttccccaccctgctgctgatcagcaagctgatgaagttcagcctggacaccctgtatgtgtccacagccaagcacgtgtttgagaagaagctgaagcccaagctgctgaagctgacccaggccaagagcagcaccctcatcaacaaggagatcaccaagatcacccagaccatcgagagctgcctgctgagcatcgtgaaccctgagtgggccgtggccatcgccatcagcctggcccaggacatccctgagggcagcttcaagatcagcgccctgaagttctgcctgtacctggccgagcgctggctgcagaacatccccagccaggatgagaagcgggagaaggccgaggccctgctgaagaagctgcacatccagtaccgccgcagcggcacagaggccgtgctgattgcccacaagctgaacacagaggagtacctgcgggtcatcggcaagccagcccacctgattgtgtccctgtatgagcaccccagcatcaaccagaggatccagaacagcagcggcacagactacccagacatccatgctgctgccaaggagattgctgaggtgaatgagatcaacctggagaaggtgtgggacatgctgctggagaagtggctgtgccccagcaccaagccaggagagaagcccagcgagctgtttgagctgcaggaggatgaggccctgcggcgggtgcagtacctgctgctgagccggcccatcgactacagcagcaggatgctgtttgtgtttgccaccagcaccaccaccaccctgggcatgcaccagctgacctttgcccacaggacccgggccctgcagtgcctcttctacctggccgacaaggagaccatcgagagcctcttcaagaagcccatcgaggaggtgaagagctacctgcgctgcatcaccttcctggccagctttgagaccctgaacatccccatcacctatgagctgttctgcagcagccccaaggagggcatgatcaagggcctgtggaagaaccacagccatgagagcatggctgtgcggctggtgacagagctgtgcctggagtacaagatctatgacctgcagctgtggaatggcctgctgcagaagctgctgggcttcaacatgatcccctacctgaggaaggtgctgaaggccatcagcagcatccacagcctgtggcaggtgccctacttcagcaaggcctggcagagggtcatccagatccccctgctgagcgccagctgccccctgagcccagaccagctgagtgactgcagcgagagcctgattgctgtgctggagtgccctgtgtctggggacctggacctgattggagtggcccggcagtacatccagctggagctgcctgcctttgccctggcctgcctgatgctgatgccccacagcgagaagaggcaccagcagatcaagaacttcctgggcagctgtgacccccaggtgatcctgaagcagctggaggagcacatgaacacaggccagctggccggcttcagccaccagatccgcagcctcatcctgaacaacatcatcaacaagaaggagtttggcatcctggccaagaccaagtacttccagatgctgaagatgcacgccatgaacaccaacaacatcacagagctggtgaactacctggccaatgacctgagcctggatgaggcctctgtgctgatcacagagtacagcaagcactgcggcaagcctgtgcccccagacacagccccctgtgagatcctgaagatgttcctgagcggcctgtcctag

SEQ ID NO: 20229 - DNA, 1332 bp, Artificial Sequence
  Description of Artificial Sequence: Synthetic coding sequence
atgctggagcacgtgatcaccctgcccagcgctgcccagacccggctgcccttccacctgatcttctttggaacagcccagaacttctggaagatcctgagcacagagctgtctgaggagagcttccccaccctgctgctgatcagcaagctgatgaagttcagcctggacaccctgtatgtgtccacagccaagcacgtgtttgagaagaagctgaagcccaagctgctgaagctgacccaggccaagagcagcaccctcatcaacaaggagatcaccaagatcacccagaccatcgagagctgcctgctgagcatcgtgaaccctgagtgggccgtggccatcgccatcagcctggcccaggacatccctgagggcagcttcaagatcagcgccctgaagttctgcctgtacctggccgagcgctggctgcagaacatccccagccaggatgagaagcgggagaaggccgaggccctgctgaagaagctgcacatccagtacagaagaagtggcacagaagctgtgctgattgcccacaagctgaacacagaggagtacctgcgggtgattggcaagccagcccacctgattgtgtccctgtatgagcaccccagcatcaaccagaggatccagaacagcagcggcacagactacccagacatccacgccgccgccaaggagattgctgaggtgaatgagatcaacctggagaaggtgtgggacatgctgctggagaagtggctgtgccccagcaccaagccaggagagaagcccagcgagctgtttgagctgcaggaggatgaggccctgcggcgggtgcagtacctgctgctgagccggcccatcgactacagcagcaggatgctgtttgtgtttgccaccagcaccaccaccaccctgggcatgcaccagctgacctttgcccacaggacccgggccctgcagtgcctcttctacctggccgacaaggagaccatcgagagcctcttcaagaagcccatcgaggaggtgaagagctacctgcgctgcatcaccttcctggccagctttgagaccctgaacatccccatcacctatgagctgttctgcagcagccccaaggagggcatgatcaagggcctgtggaagaaccacagccatgagagcatggctgtgcggctggtgacagagctgtgcctggagtacaagatctatgacctgcagctgtggaatggcctgctgcagaagctgctgggcttcaacatgatcccctacctgaggaaggtgctgaaggccatcagcagcatccacagcctgtggcagcgctggaggagctgctacgtggcctag

SEQ ID NO: 20230 - DNA, 417 bp, Artificial Sequence
  Description of Artificial Sequence: Synthetic coding sequence
atgaacagcctggtgtcctggcagctgctgctcttcctgtgtgccacccactttggagagcccctggagaaggtggcctctgtgggcaacagccggcccaccggccagcagctggagagcctgggcctgctggcccctggagagcagagcctgccctgcacagagaggaagccagctgccacagcccggctgagccggcggggcaccagcctgagccccccacctgagagcagcggcagcccccagcagcccggcctgagcgccccccacagccggcagatcccagccccccagggcgctgtgctggtgcagcgggagaaggacctgcccaactacaactggaacagctttggcctgcgctttgggaagcgggaggccgcccctggcaaccacggccgctctgctggccggggctag

SEQ ID NO: 20231 - DNA, 771 bp, Artificial Sequence
  Description of Artificial Sequence: Synthetic coding sequence
atggcccacaggcctcccagccctgccctggcctctgtgctgctggccctgctgctgagcggggccgcccgggctgctgagatcgtgggcggccacgaggcccagccccacagccggccctacatggccagcctgcagatgaggggcaaccctggcagccacttctgtggcggcaccctcatccaccccagctttgtgctgacagctgcccactgcctgcgggacatcccccagaggctggtgaatgtggtgctgggcgcccacaacgtgaggacccaggagcccacccagcagcacttctctgtggcccaggtgttcctgaacaactatgatgctgagaacaagctgaatgatgtgctgctgatccagctgagcagccctgccaacctgagcgcctctgtggccaccgtgcagctgccccagcaggaccagcctgtgccccacggcacccagtgcctggccatgggctggggccgggtgggcgcccatgaccccccagcccaggtgctgcaggagctgaatgtgacagtggtgaccttcttctgccggccccacaacatctgcacctttgtgcccaggaggaaggccggcatctgcttcggggacagcggcggccccctcatctgtgatggcatcatccagggcatcgacagctttgtgatctggggctgtgccaccaggctcttcccagacttcttcaccagggtggccctgtatgtggactggatccgcagcaccctgcggcgggtggaggccaagggccggccctag

SEQ ID NO: 20232 - DNA, 2937 bp, Artificial Sequence
  Description of Artificial Sequence: Synthetic coding sequence
atggcccacaccaccaaggtgaatggcagcgccagcggcaaggccggggacatcctgagcggggaccaggacaaggagcagaaggacccctactttgtggagaccccctacggctaccagctggacctggacttcctgaagtatgtggatgacatccagaagggcaacaccatcaagaggctgaacatccagaagaggaggaagcccagcgtgccctgcccagagcccaggaccaccagcggccagcagggcatctggaccagcacagagagcctgagcagcagcaacagtgatgacaacaagcagtgccccaacttcctgattgcccggagccaggtgaccagcacccccatcagcaagcccccaccacccctggagaccagcctgcccttcctgaccatccctgagaaccggcagctgcccccacccagcccccagctgcccaagcacaacctgcacgtgaccaagaccctgatggagacccggcggcggctggagcaggagcgggccaccatgcagatgaccccaggagagttccggcggccccggctggccagctttggaggcatgggcaccaccagcagcctgcccagctttgtgggcagcggcaaccacaacccagccaagcaccagctgcagaatggctaccagggcaatggagactatggcagctatgccccagctgcccccaccaccagctccatgggcagcagcatccgccacagccccctgagcagcggcatcagcacccctgtgaccaacgtgagccccatgcacctgcagcacatccgggagcagatggccatcgccctgaagaggctgaaggagctggaggagcaggtgaggaccatccctgtgctgcaggtgaagatctctgtgctgcaggaggagaagaggcagctggtgtcccagctgaagaaccagagagctgccagccagatcaacgtgtgtggggtgaggaagaggagctacagcgctggaaatgccagccagctggagcagctgagccgggccaggagaagtggaggagagctgtacattgattatgaggaggaggagatggagaccgtggagcagagcacccagaggatcaaggagttccggcagctgacagctgacatgcaggccctggagcagaagatccaggacagcagctgtgaggccagcagcgagctgcgggagaatggagaatgtagatctgtggccgtgggcgctgaggagaacatgaatgacatcgtggtgtaccaccggggcagccgcagctgcaaggatgctgctgtgggcaccctggtggagatgaggaactgtggggtgtctgtgacagaggccatgctgggcgtgatgacagaagctgacaaggagattgagctgcagcagcagaccatcgagagcctgaaggagaagatctaccgcctggaggtgcagctgcgggagaccacccatgaccgggagatgaccaagctgaagcaggagctgcaggccgccggcagcaggaagaaggtggacaaggccaccatggcccagcccctggtgttcagcaaggtggtggaggccgtggtgcagacccgggaccagatggtgggcagccacatggacctggtggacacctgtgtgggcacctctgtggagaccaacagcgtgggcatcagctgccagcctgagtgcaagaacaaggtggtgggccctgagctgcccatgaactggtggatcgtgaaggagcgggtggagatgcatgacagatgtgccggccgctctgtggagatgtgtgacaagtctgtgtctgtggaggtgtctgtgtgtgagaccggcagcaacacagaggagagcgtgaatgacctgaccctgctgaagaccaacctgaacctgaaggaggtgcgcagcatcggctgtggggactgcagcgtggatgtgacagtgtgcagccccaaggaatgtgccagcagaggagtgaacacagaggccgtgtcccaggtggaggccgctgtgatggctgtgcccaggacagctgaccaggacaccagcacagacctggagcaggtgcaccagttcaccaacacagaaacagccaccctcatcgagagctgcaccaacacctgcctgagcaccctggacaagcagaccagcacccagacagtggagaccaggacagtggccgtgggggagggccgggtgaaggacatcaacagcagcaccaagaccaggagcattggagtgggcaccctgctgagcggccacagcggctttgaccggcccagcgctgtgaagaccaaggagagcggcgtgggccagatcaacatcaatgacaactacctggtgggcctgaagatgaggaccatcgcctgtggccccccccagctgactgtgggcctgacagccagccgccgctctgtgggcgtgggagatgatcctgtgggggagagcctggagaacccccagccccaggcccccctgggcatgatgacaggcctggaccactacatcgagcgcatccagaagctgctggccgagcagcagaccctgctggccgagaactacagcgagctggccgaggccttcggggagccccacagccagatgggcagcctgaacagccagctgatcagcaccctgagcagcatcaacagcgtgatgaagagcgccagcacagaggagctgaggaacccagacttccagaagaccagcctgggcaagatcactggaaactacctgggctacacctgcaagtgtggcggcctgcagagcggcagccccctgagcagccagaccagccagcctgagcaggaggtgggcaccagcgagggcaagcccatcagcagcctggatgccttccccacccaggagggcaccctgagccctgtgaacctgacagatgaccagattgctgctggcctgtatggcaacttcagccacagccagagcctggccagcggcttctag

SEQ ID NO: 20233 - DNA, 831 bp, Artificial Sequence
  Description of Artificial Sequence: Synthetic coding sequence
atgctgagcgcctgcaacctgctgaagaacaccatcaatgaccccaaggccctgaccagcaaggacatgaggttctgcctgaacaccctgcagcacgagtggttccgggtgagcagccagaagagcgccatcccagccatggtgggggactacatcgccgcctttgaggccatcagcccagatgtgctgcgctacgtgatcaacctggctgatggaaatggaaacacagccctgcactacagcgtgagccacagcaactttgaaattgtgaagctgctgctggatgctgatgtgtgcaatgtggaccaccagaacaaggccggctacacccccatcatgctggccgccctggccgctgtggaggccgagaaggacatgagaattgtggaggagctgtttggctgtggagatgtgaatgccaaggccagccaggccggccagacagccctgatgctggccgtgagccacggcagaattgacatggtgaagggcctgctggcctgtggggctgatgtgaacatccaggatgatgagggcagcacagccctgatgtgtgccagcgagcacggccacgtggagatcgtgaagctgctgctggcccagcccggctgcaatggccacctggaggacaatgatggcagcacagccctgagcatcgccctggaggccggccacaaggacattgctgtgctgctgtatgcccacgtgaactttgccaaggcccagagccctgtgtctgtggtgcacctggcctttgtgaaccggctgaagagcacccggctggtggaccccctgcccccaggcattgatggccggcagatcctgtgctag

SEQ ID NO: 20234 - DNA, 993 bp, Artificial Sequence
  Description of Artificial Sequence: Synthetic coding sequence
atggccgagggccaccacgctgtgaacatcgagggcctgaagagcgcccgggtggaggatgagatgcaggtgcaggagtgtgagcctgagaaggtggagatccgggagagatatgagctgtctgagaagatgctgagcgcctgcaacctgctgaagaacaccatcaatgaccccaaggccctgaccagcaaggacatgggccaggtgcagtggctgacccccatgatccccaccctgcgggaggctgatgctgggggcagccatgagcgcttctgcctgaacaccctgcagcacgagtggttccgggtgagcagccagaagagcgccatcccagccatggtgggggactacatcgccgcctttgaggccatcagcccagatgtgctgcgctacgtgatcaacctggctgatggaaatggaaacacagccctgcactacagcgtgagccacagcaactttgaaattgtgaagctgctgctggatgctgatgtgtgcaatgtggaccaccagaacaaggccggctacacccccatcatgctggccgccctggccgctgtggaggccgagaaggacatgagaattgtggaggagctgtttggctgtggagatgtgaatgccaaggccagccaggccggccagacagccctgatgctggccgtgagccacggcagaattgacatggtgaagggcctgctggcctgtggggctgatgtgaacatccaggatgatgagggcagcacagccctgatgtgtgccagcgagcacggccacgtggagatcgtgaagctgctgctggcccagcccggctgcaatggccacctggaggacaatgatggcagcacagccctgagcatcgccctggaggccggccacaaggacattgctgtgctgctgtatgcccacgtgaactttgccaaggcccagagccctggcaccccccggctgggcaggaagaccagccctggccccacccaccggggcagctttgattag

SEQ ID NO: 20235 - DNA, 3585 bp, Artificial Sequence
  Description of Artificial Sequence: Synthetic coding sequence
atggagacccggcggcggctggagcaggagcgggccaccatgcagatgaccccaggagagttccggcggccccggctggccagctttggaggcatgggcaccaccagcagcctgcccagctttgtgggcagcggcaaccacaacccagccaagcaccagctgcagaatggctaccagggcaatggagactatggcagctatgccccagctgcccccaccaccagctccatgggcagcagcatccgccacagccccctgagcagcggcatcagcacccctgtgaccaacgtgagccccatgcacctgcagcacatccgggagcagatggccatcgccctgaagaggctgaaggagctggaggagcaggtgaggaccatccctgtgctgcaggtgaagatctctgtgctgcaggaggagaagaggcagctggtgtcccagctgaagaaccagagagctgccagccagatcaacgtgtgtggggtgaggaagaggagctacagcgctggaaatgccagccagctggagcagctgagccgggccaggagaagtggaggagagctgtacattgattatgaggaggaggagatggagaccgtggagcagagcacccagaggatcaaggagttccggcagctgacagctgacatgcaggccctggagcagaagatccaggacagcagctgtgaggccagcagcgagctgcgggagaatggagaatgtagatctgtggccgtgggcgctgaggagaacatgaatgacatcgtggtgtaccaccggggcagccgcagctgcaaggatgctgctgtgggcaccctggtggagatgaggaactgtggggtgtctgtgacagaggccatgctgggcgtgatgacagaagctgacaaggagattgagctgcagcagcagaccatcgagagcctgaaggagaagatctaccgcctggaggtgcagctgcgggagaccacccatgaccgggagatgaccaagctgaagcaggagctgcaggccgccggcagcaggaagaaggtggacaaggccaccatggcccagcccctggtgttcagcaaggtggtggaggccgtggtgcagacccgggaccagatggtgggcagccacatggacctggtggacacctgtgtgggcacctctgtggagaccaacagcgtgggcatcagctgccagcctgagtgcaagaacaaggtggtgggccctgagctgcccatgaactggtggatcgtgaaggagcgggtggagatgcatgacagatgtgccggccgctctgtggagatgtgtgacaagtctgtgtctgtggaggtgtctgtgtgtgagaccggcagcaacacagaggagagcgtgaatgacctgaccctgctgaagaccaacctgaacctgaaggaggtgcgcagcatcggctgtggggactgcagcgtggatgtgacagtgtgcagccccaaggaatgtgccagcagaggagtgaacacagaggccgtgtcccaggtggaggccgctgtgatggctgtgcccaggacagctgaccaggacaccagcacagacctggagcaggtgcaccagttcaccaacacagaaacagccaccctcatcgagagctgcaccaacacctgcctgagcaccctggacaagcagaccagcacccagacagtggagaccaggacagtggccgtgggggagggccgggtgaaggacatcaacagcagcaccaagaccaggagcattggagtgggcaccctgctgagcggccacagcggctttgaccggcccagcgctgtgaagaccaaggagagcggcgtgggccagatcaacatcaatgacaactacctggtgggcctgaagatgaggaccatcgcctgtggccccccccagctgactgtgggcctgacagccagccgccgctctgtgggcgtgggagatgatcctgtgggggagagcctggagaacccccagccccaggcccccctgggcatgatgacaggcctggaccactacatcgagcgcatccagaagctgctggccgagcagcagaccctgctggccgagaactacagcgagctggccgaggccttcggggagccccacagccagatgggcagcctgaacagccagctgatcagcaccctgagcagcatcaacagcgtgatgaagagcgccagcacagaggagctgaggaacccagacttccagaagaccagcctgggcaagatcactggaaactacctgggctacacctgcaagtgtggcggcctgcagagcggcagccccctgagcagccagaccagccagcctgagcaggaggtgggcaccagcgagggcaagcccatcagcagcctggatgccttccccacccaggagggcaccctgagccctgtgaacctgacagatgaccagattgctgctggcctgtatgcctgcaccaacaatgaaagcaccctgaagagcatcatgaagaagaaggatggcaacaaggacagcaatggagccaagaagaacctgcagtttgtgggcatcaatggaggctatgagaccaccagcagtgatgacagcagcagtgatgagagcagcagcagcgagagtgatgatgaatgtgatgtgattgagtaccccctggaggaggaggaggaggaggaggatgaggacacccggggcatggccgagggccaccacgctgtgaacatcgagggcctgaagagcgcccgggtggaggatgagatgcaggtgcaggagtgtgagcctgagaaggtggagatccgggagagatatgagctgtctgagaagatgctgagcgcctgcaacctgctgaagaacaccatcaatgaccccaaggccctgaccagcaaggacatgaggttctgcctgaacaccctgcagcacgagtggttccgggtgagcagccagaagagcgccatcccagccatggtgggggactacatcgccgcctttgaggccatcagcccagatgtgctgcgctacgtgatcaacctggctgatggaaatggaaacacagccctgcactacagcgtgagccacagcaactttgaaattgtgaagctgctgctggatgctgatgtgtgcaatgtggaccaccagaacaaggccggctacacccccatcatgctggccgccctggccgctgtggaggccgagaaggacatgagaattgtggaggagctgtttggctgtggagatgtgaatgccaaggccagccaggccggccagacagccctgatgctggccgtgagccacggcagaattgacatggtgaagggcctgctggcctgtggggctgatgtgaacatccaggatgatgagggcagcacagccctgatgtgtgccagcgagcacggccacgtggagatcgtgaagctgctgctggcccagcccggctgcaatggccacctggaggacaatgatggcagcacagccctgagcatcgccctggaggccggccacaaggacattgctgtgctgctgtatgcccacgtgaactttgccaaggcccagagccctggcaccccccggctgggcaggaagaccagccctggccccacccaccggggcagctttgattag

SEQ ID NO: 20236 - DNA, 4059 bp, Artificial Sequence
  Description of Artificial Sequence: Synthetic coding sequence
atggcccacaccaccaaggtgaatggcagcgccagcggcaaggccggggacatcctgagcggggaccaggacaaggagcagaaggacccctactttgtggagaccccctacggctaccagctggacctggacttcctgaagtatgtggatgacatccagaagggcaacaccatcaagaggctgaacatccagaagaggaggaagcccagcgtgccctgcccagagcccaggaccaccagcggccagcagggcatctggaccagcacagagagcctgagcagcagcaacagtgatgacaacaagcagtgccccaacttcctgattgcccggagccaggtgaccagcacccccatcagcaagcccccaccacccctggagaccagcctgcccttcctgaccatccctgagaaccggcagctgcccccacccagcccccagctgcccaagcacaacctgcacgtgaccaagaccctgatggagacccggcggcggctggagcaggagcgggccaccatgcagatgaccccaggagagttccggcggccccggctggccagctttggaggcatgggcaccaccagcagcctgcccagctttgtgggcagcggcaaccacaacccagccaagcaccagctgcagaatggctaccagggcaatggagactatggcagctatgccccagctgcccccaccaccagctccatgggcagcagcatccgccacagccccctgagcagcggcatcagcacccctgtgaccaacgtgagccccatgcacctgcagcacatccgggagcagatggccatcgccctgaagaggctgaaggagctggaggagcaggtgaggaccatccctgtgctgcaggtgaagatctctgtgctgcaggaggagaagaggcagctggtgtcccagctgaagaaccagagagctgccagccagatcaacgtgtgtggggtgaggaagaggagctacagcgctggaaatgccagccagctggagcagctgagccgggccaggagaagtggaggagagctgtacattgattatgaggaggaggagatggagaccgtggagcagagcacccagaggatcaaggagttccggcagctgacagctgacatgcaggccctggagcagaagatccaggacagcagctgtgaggccagcagcgagctgcgggagaatggagaatgtagatctgtggccgtgggcgctgaggagaacatgaatgacatcgtggtgtaccaccggggcagccgcagctgcaaggatgctgctgtgggcaccctggtggagatgaggaactgtggggtgtctgtgacagaggccatgctgggcgtgatgacagaagctgacaaggagattgagctgcagcagcagaccatcgagagcctgaaggagaagatctaccgcctggaggtgcagctgcgggagaccacccatgaccgggagatgaccaagctgaagcaggagctgcaggccgccggcagcaggaagaaggtggacaaggccaccatggcccagcccctggtgttcagcaaggtggtggaggccgtggtgcagacccgggaccagatggtgggcagccacatggacctggtggacacctgtgtgggcacctctgtggagaccaacagcgtgggcatcagctgccagcctgagtgcaagaacaaggtggtgggccctgagctgcccatgaactggtggatcgtgaaggagcgggtggagatgcatgacagatgtgccggccgctctgtggagatgtgtgacaagtctgtgtctgtggaggtgtctgtgtgtgagaccggcagcaacacagaggagagcgtgaatgacctgaccctgctgaagaccaacctgaacctgaaggaggtgcgcagcatcggctgtggggactgcagcgtggatgtgacagtgtgcagccccaaggaatgtgccagcagaggagtgaacacagaggccgtgtcccaggtggaggccgctgtgatggctgtgcccaggacagctgaccaggacaccagcacagacctggagcaggtgcaccagttcaccaacacagaaacagccaccctcatcgagagctgcaccaacacctgcctgagcaccctggacaagcagaccagcacccagacagtggagaccaggacagtggccgtgggggagggccgggtgaaggacatcaacagcagcaccaagaccaggagcattggagtgggcaccctgctgagcggccacagcggctttgaccggcccagcgctgtgaagaccaaggagagcggcgtgggccagatcaacatcaatgacaactacctggtgggcctgaagatgaggaccatcgcctgtggccccccccagctgactgtgggcctgacagccagccgccgctctgtgggcgtgggagatgatcctgtgggggagagcctggagaacccccagccccaggcccccctgggcatgatgacaggcctggaccactacatcgagcgcatccagaagctgctggccgagcagcagaccctgctggccgagaactacagcgagctggccgaggccttcggggagccccacagccagatgggcagcctgaacagccagctgatcagcaccctgagcagcatcaacagcgtgatgaagagcgccagcacagaggagctgaggaacccagacttccagaagaccagcctgggcaagatcactggaaactacctgggctacacctgcaagtgtggcggcctgcagagcggcagccccctgagcagccagaccagccagcctgagcaggaggtgggcaccagcgagggcaagcccatcagcagcctggatgccttccccacccaggagggcaccctgagccctgtgaacctgacagatgaccagattgctgctggcctgtatgcctgcaccaacaatgaaagcaccctgaagagcatcatgaagaagaaggatggcaacaaggacagcaatggagccaagaagaacctgcagtttgtgggcatcaatggaggctatgagaccaccagcagtgatgacagcagcagtgatgagagcagcagcagcgagagtgatgatgaatgtgatgtgattgagtaccccctggaggaggaggaggaggaggaggatgaggacacccggggcatggccgagggccaccacgctgtgaacatcgagggcctgaagagcgcccgggtggaggatgagatgcaggtgcaggagtgtgagcctgagaaggtggagatccgggagagatatgagctgtctgagaagatgctgagcgcctgcaacctgctgaagaacaccatcaatgaccccaaggccctgaccagcaaggacatgaggttctgcctgaacaccctgcagcacgagtggttccgggtgagcagccagaagagcgccatcccagccatggtgggggactacatcgccgcctttgaggccatcagcccagatgtgctgcgctacgtgatcaacctggctgatggaaatggaaacacagccctgcactacagcgtgagccacagcaactttgaaattgtgaagctgctgctggatgctgatgtgtgcaatgtggaccaccagaacaaggccggctacacccccatcatgctggccgccctggccgctgtggaggccgagaaggacatgagaattgtggaggagctgtttggctgtggagatgtgaatgccaaggccagccaggccggccagacagccctgatgctggccgtgagccacggcagaattgacatggtgaagggcctgctggcctgtggggctgatgtgaacatccaggatgatgagggcagcacagccctgatgtgtgccagcgagcacggccacgtggagatcgtgaagctgctgctggcccagcccggctgcaatggccacctggaggacaatgatggcagcacagccctgagcatcgccctggaggccggccacaaggacattgctgtgctgctgtatgcccacgtgaactttgccaaggcccagagccctggcaccccccggctgggcaggaagaccagccctggccccacccaccggggcagctttgattag

SEQ ID NO: 20237 - DNA, 4059 bp, Artificial Sequence; identical to SEQ ID NO: 20236
  Description of Artificial Sequence: Synthetic coding sequence

SEQ ID NO: 20238 - DNA, 1197 bp, Artificial Sequence
  Description of Artificial Sequence: Synthetic coding sequence
atgaagaagaaggatggcaacaaggacagcaatggagccaagaagaacctgcagtttgtgggcatcaatggaggctatgagaccaccagcagtgatgacagcagcagtgatgagagcagcagcagcgagagtgatgatgaatgtgatgtgattgagtaccccctggaggaggaggaggaggaggaggatgaggacacccggggcatggccgagggccaccacgctgtgaacatcgagggcctgaagagcgcccgggtggaggatgagatgcaggtgcaggagtgtgagcctgagaaggtggagatccgggagagatatgagctgtctgagaagatgctgagcgcctgcaacctgctgaagaacaccatcaatgaccccaaggccctgaccagcaaggacatgggccaggtgcagtggctgacccccatgatccccaccctgcgggaggctgatgctgggggcagccatgagcgcttctgcctgaacaccctgcagcacgagtggttccgggtgagcagccagaagagcgccatcccagccatggtgggggactacatcgccgcctttgaggccatcagcccagatgtgctgcgctacgtgatcaacctggctgatggaaatggaaacacagccctgcactacagcgtgagccacagcaactttgaaattgtgaagctgctgctggatgctgatgtgtgcaatgtggaccaccagaacaaggccggctacacccccatcatgctggccgccctggccgctgtggaggccgagaaggacatgagaattgtggaggagctgtttggctgtggagatgtgaatgccaaggccagccaggccggccagacagccctgatgctggccgtgagccacggcagaattgacatggtgaagggcctgctggcctgtggggctgatgtgaacatccaggatgatgagggcagcacagccctgatgtgtgccagcgagcacggccacgtggagatcgtgaagctgctgctggcccagcccggctgcaatggccacctggaggacaatgatggcagcacagccctgagcatcgccctggaggccggccacaaggacattgctgtgctgctgtatgcccacgtgaactttgccaaggcccagagccctggcaccccccggctgggcaggaagaccagccctggccccacccaccggggcagctttgattag

SEQ ID NO: 20239 - DNA, 2211 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttccccctggatggagagaagatgggccgggaggccagcctcttcatcgtgcccagcgtggtgaaggacaacaccaagtacacctacaccccaggctgccccatcttctactgcctgcaggacatcatgagggtgtgcagcgagagcagcacccactttgccaccctgacagccaggatgctgattgccctggacaagtggctggatgaaagacatgcccagagccacttcatcccagccctcttccggcccagccccctggagcgcatcaagaccaacgtcatcaacccagcctatgccacagaaagtggccagacagagaacagcctgcacatgggctacagcgccctggagatcaagagcaagatgctggccctggagaaggctgacacctgcatctacaaccccctgtttggaagtgacctgcagtacaccaacagagtggacaaggtggtgatcaacccctacttcggcctgggcgccccagactacagcaagatccagatccccaagcaggagaagtggcagaggtccatgagctctgtgacagaggacaaggagcggcagtgggtggatgacttccccctgcacaggtctgcctgtgagggggacagcgagctgctgagccggctgctgtctgagcgcttctctgtgaaccagctggacagcgaccactgggcccccatccactacgcctgctggtacggcaaggtggaggccacccgcatcctgctggagaagggcaagtgcaaccccaacctgctgaatggccagctgagcagccccctgcactttgctgctgggggcggccacgccgagatcgtgcagatcctgctgaaccaccctgagacagacagacacatcacagaccagcagggccgcagccccctgaacatctgtgaggagaacaagcagaacaactgggaggaggccgccaagctgctgaaggaggccatcaacaagccctatgagaaggtgcgcatctacaggatggatggcagctacagatctgtggagctgaagcacggcaacaacaccaccgtgcagcagatcatggagggcatgaggctgagccaggagacccagcagtacttcaccatctggatctgcagcgagaacctgagcctgcagctgaagccctaccacaagcccctgcagcacgtgcgggactggccagagatcctggccgagctgaccaacctggacccccagcgggagaccccccagctgttcctgcggagagatgtgcggctgcccctggaggtggagaagcagatcgaggaccccctggccatcctgatcctgtttgatgaggcccgctacaacctgctgaagggcttctacacagccccagatgccaagctgatcaccctggccagcctgctgctgcagatcgtgtatggcaactatgagagcaagaagcacaagcagggcttcctgaatgaggagaacctgaagagcatcgtgcctgtgaccaagctgaagagcaaggccccccactggaccaaccgcatcctgcacgagtacaagaacctgagcaccagcgagggcgtgtccaaggagatgcaccacctgcagaggatgttcctgcagaactgctgggagatccccacctatggagctgccttcttcaccggccagatcttcaccaaggccagccccagcaaccacaaggtgattcctgtgtatgtgggcgtgaacatcaagggcctgcacctgctgaacatggagaccaaggccctgctgatcagcctgaagtatggctgcttcatgtggcagctgggggacacagacacctgcttccagatccacagcatggagaacaagatgtccttcatcgtgcacaccaagcaggccggcctggtggtgaagctgctgatgaagctgaatggccagctgatgcccacagagaggaacagctag

SEQ ID NO: 20240 - DNA, 2067 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttccccctggatggagagaagatgggccgggaggccagcctcttcatcgtgcccagcgtggtgaaggacaacaccaagtacacctacaccccaggctgccccatcttctactgcctgcaggacatcatgagggtgtgcagcgagagcagcacccactttgccaccctgacagccaggatgctgattgccctggacaagtggctggatgaaagacatgcccagagccacttcatcccagccctcttccggcccagccccctggagcgcatcaagaccaacgtcatcaacccagcctatgccacagaaagtggccagacagagaacagcctgcacatgggctacagcgccctggagatcaagagcaagatgctggccctggagaaggctgacacctgcatctacaaccccctgtttggaagtgacctgcagtacaccaacagagtggacaaggtggtgatcaacccctacttcggcctgggcgccccagactacagcaagatccagatccccaagcaggagaagtggcagaggtccatgagctctgtgacagaggacaagtatggcaaggtggaggccacccgcatcctgctggagaagggcaagtgcaaccccaacctgctgaatggccagctgagcagccccctgcactttgctgctgggggcggccacgccgagatcgtgcagatcctgctgaaccaccctgagacagacagacacatcacagaccagcagggccgcagccccctgaacatctgtgaggagaacaagcagaacaactgggaggaggccgccaagctgctgaaggaggccatcaacaagccctatgagaaggtgcgcatctacaggatggatggcagctacagatctgtggagctgaagcacggcaacaacaccaccgtgcagcagatcatggagggcatgaggctgagccaggagacccagcagtacttcaccatctggatctgcagcgagaacctgagcctgcagctgaagccctaccacaagcccctgcagcacgtgcgggactggccagagatcctggccgagctgaccaacctggacccccagcgggagaccccccagctgttcctgcggagagatgtgcggctgcccctggaggtggagaagcagatcgaggaccccctggccatcctgatcctgtttgatgaggcccgctacaacctgctgaagggcttctacacagccccagatgccaagctgatcaccctggccagcctgctgctgcagatcgtgtatggcaactatgagagcaagaagcacaagcagggcttcctgaatgaggagaacctgaagagcatcgtgcctgtgaccaagctgaagagcaaggccccccactggaccaaccgcatcctgcacgagtacaagaacctgagcaccagcgagggcgtgtccaaggagatgcaccacctgcagaggatgttcctgcagaactgctgggagatccccacctatggagctgccttcttcaccggccagatcttcaccaaggccagccccagcaaccacaaggtgattcctgtgtatgtgggcgtgaacatcaagggcctgcacctgctgaacatggagaccaaggccctgctgatcagcctgaagtatggctgcttcatgtggcagctgggggacacagacacctgcttccagatccacagcatggagaacaagatgtccttcatcgtgcacaccaagcaggccggcctggtggtgaagctgctgatgaagctgaatggccagctgatgcccacagagaggaacagctag

SEQ ID NO: 20241 - DNA, 2211 bp, Artificial Sequence; identical to SEQ ID NO: 20239
  Description of Artificial Sequence: Synthetic coding sequence

SEQ ID NO: 20242 - DNA, 2211 bp, Artificial Sequence; identical to SEQ ID NO: 20239
  Description of Artificial Sequence: Synthetic coding sequence

SEQ ID NO: 20243 - DNA, 2211 bp, Artificial Sequence; identical to SEQ ID NO: 20239
  Description of Artificial Sequence: Synthetic coding sequence

SEQ ID NO: 20244 - DNA, 210 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctgtag

SEQ ID NO: 20245 - DNA, 1698 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttccccctggatggagagaagatgggccgggaggccagcctcttcatcgtgcccagcgtggtgaaggacaacaccaagtacacctacaccccaggctgccccatcttctactgcctgcaggacatcatgagggtgtgcagcgagagcagcacccactttgccaccctgacagccaggatgctgattgccctggacaagtggctggatgaaagacatgcccagagccacttcatcccagccctcttccggcccagccccctggagcgcatcaagaccaacgtcatcaacccagcctatgccacagaaagtggccagacagagaacagcctgcacatgggctacagcgccctggagatcaagagcaagatgctggccctggagaaggctgacacctgcatctacaaccccctgtttggaagtgacctgcagtacaccaacagagtggacaaggtggtgatcaacccctacttcggcctgggcgccccagactacagcaagatccagatccccaagcaggagaagtggcagaggtccatgagctctgtgacagaggacaaggagcggcagtgggtggatgacttccccctgcacaggtctgcctgtgagggggacagcgagctgctgagccggctgctgtctgagcgcttctctgtgaaccagctggacagcgaccactgggcccccatccactacgcctgctggtacggcaaggtggaggccacccgcatcctgctggagaagggcaagtgcaaccccaacctgctgaatggccagctgagcagccccctgcactttgctgctgggggcggccacgccgagatcgtgcagatcctgctgaaccaccctgagacagacagacacatcacagaccagcagggccgcagccccctgaacatctgtgaggagaacaagcagaacaactgggaggaggccgccaagctgctgaaggaggccatcaacaagccctatgagaaggtgcgcatctacaggatggatggcagctacagatctgtggagctgaagcacggcaacaacaccaccgtgcagcagatcatggagggcatgaggctgagccaggagacccagcagtacttcaccatctggatctgcagcgagaacctgagcctgcagctgaagccctaccacaagcccctgcagcacgtgcgggactggccagagatcctggccgagctgaccaacctggacccccagcgggagaccccccagctgttcctgcggagagatgtgcggctgcccctggaggtggagaagcagatcgaggaccccctggccatcctgatcctgtttgatgaggcccgctacaacctgctgaagggcttctacacagccccagatgccaagctgatcaccctggccagcctgctgctgcagagcctgtggaagctgtag

SEQ ID NO: 20246 - DNA, 78 bp, Artificial Sequence
  Description of Artificial Sequence: Synthetic coding sequence
atgggcaacccagaaaatattgaagatgcctacgtggccgtcatccggcccaagaacacagccagcctgaacagctag

SEQ ID NO: 20247 - DNA, 39 bp, Artificial Sequence
  Description of Artificial Sequence: Synthetic coding sequence
atgggcaacccagaaaatattgaagatgcctacgtgtag

SEQ ID NO: 20248 - DNA, 117 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcactag

SEQ ID NO: 20249 - DNA, 297 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttcccctag

SEQ ID NO: 20250 - DNA, 555 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttccccctggatggagagaagatgggccgggaggccagcctcttcatcgtgcccagcgtggtgaaggacaacaccaagtacacctacaccccaggctgccccatcttctactgcctgcaggacatcatgagggtgtgcagcgagagcagcacccactttgccaccctgacagccaggatgctgattgccctggacaagtggctggatgaaagacatgcccagagccacttcatcccagccctcttccggcccagccccctggagtag

SEQ ID NO: 20251 - DNA, 339 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttccccctggatggagagaagatgggccgggaggccagcctcttcatctag

SEQ ID NO: 20252 - DNA, 105 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgaatag

SEQ ID NO: 20253 - DNA, 177 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgtag

SEQ ID NO: 20254 - DNA, 489 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttccccctggatggagagaagatgggccgggaggccagcctcttcatcgtgcccagcgtggtgaaggacaacaccaagtacacctacaccccaggctgccccatcttctactgcctgcaggacatcatgagggtgtgcagcgagagcagcacccactttgccaccctgacagccaggatgctgattgccctggacaagtag

SEQ ID NO: 20255 - DNA, 732 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttccccctggatggagagaagatgggccgggaggccagcctcttcatcgtgcccagcgtggtgaaggacaacaccaagtacacctacaccccaggctgccccatcttctactgcctgcaggacatcatgagggtgtgcagcgagagcagcacccactttgccaccctgacagccaggatgctgattgccctggacaagtggctggatgaaagacatgcccagagccacttcatcccagccctcttccggcccagccccctggagcgcatcaagaccaacgtcatcaacccagcctatgccacagaaagtggccagacagagaacagcctgcacatgggctacagcgccctggagatcaagagcaagatgctggccctggagaaggctgacacctgcatctacaaccccctgtttggaagtgacctgcagtacaccaacagatag

SEQ ID NO: 20256 - DNA, 198 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacctag

SEQ ID NO: 20257 - DNA, 1089 bp, Artificial Sequence
  Description of Artificial Sequence: Synthetic coding sequence
atggccacagctgagacagccctgcccagcatcagcaccctgacagccctgggccccttcccagacacccaggatgacttcctgaagtggtggaggtctgaggaggcccaggacatgggccctggccccccagaccccacagagccccccctgcacgtgaagtctgaggaccagcctggagaggaggaggatgatgaaagaggagcagatgccacctgggacctggacctgctgctgaccaacttcagcggccctgagcctggaggagccccccagacctgtgccctggcccccagcgaggccagcggggcccagtacccacctcctcctgagaccctgggcgcctatgccggcggccctggcctggtggccggcctgctgggcagcgaggaccacagcggctgggtgcggcctgccctgcgggcccgggccccagatgcctttgtgggccctgccctggccccagccccagcccctgagcccaaggccctggccctgcagcctgtgtacccaggccctggagctggcagcagcggcggctacttccccaggacaggcctgtctgtgcctgctgccagcggggccccctacggcctgctgagcggctacccagccatgtacccagccccccagtaccagggccacttccagctgttccggggcctgcagggccctgcccctggccctgccaccagccccagcttcctgagctgcctgggccctggcaccgtgggcaccggcctgggcggcacagcagaagatcctggggtgattgctgagacagcccccagcaagaggggccgccgctcctgggccaggaagaggcaggccgcccacacctgtgcccaccctggctgtgggaagagctacaccaagagcagccacctgaaggcccacctgcggacccacactggagagaagccctatgcctgcacctgggagggctgcggctggaggtttgcccggagtgatgagctgaccaggcactacaggaagcacacaggccagaggcccttccgctgccagctgtgcccccgggccttcagcagaagtgaccacctggccctgcacatgaagaggcacctgtag

SEQ ID NO: 20258 - DNA, 999 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgcggacccccaagatcgtgtctgggaaggactacaacgtgacagccaacagcaagctggtgatcatcacagctggggcccggcagcaggagggggagagccggctgaacctggtgcagagaaatgtgaacatcttcaagttcatcatccccaacgtggtgaagtacagccccaactgcaagctgctgattgtgagcaaccctgtggacatcctgacctacgtggcctggaagatcagcggcttccccaagaacagagtgattggcagcggctgcaacctggacagcgcccgcttccgctacctgatgggagagcggctgggcgtgcaccccctgagctgccacggctgggtgctgggggagcacggggacagctctgtgcctgtgtggagcggcatgaatgtggccggcgtgtccctgaagaccctgcacccagacctgggcacagacaaggacaaggagcagtggaaggaggtgcacaagcaggtggtggagagcgcctatgaagtcatcaagctgaagggctacacctcctgggccatcggcctgtctgtggccgacctggccgagagcatcatgaagaacctgcggcgggtgcaccctgtgtccaccatgatcaagggcctgtatggcatcaaggatgatgtgttcctgtctgtgccctgcatcctgggccagaatggcatcagtgacctggtgaaggtgaccctgaccagcgaggaggaggcccggctgaagaagtctgctgacaccctgtggggcatccagaaggagctgcagttctag

SEQ ID NO: 20259 - DNA, 825 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgcggacccccaagatcgtgtctgggaaggactacaacgtgacagccaacagcaagctggtgatcatcacagctggggcccggcagcaggagggggagagccggctgaacctggtgcagagaaatgtgaacatcttcaagttcatcatccccaacgtggtgaagtacagccccaactgcaagctgctgattgtgagcaaccctgtggacatcctgacctacgtggcctggaagatcagcggcttccccaagaacagagtgattggcagcggctgcaacctggacagcgcccgcttccgctacctgatgggagagcggctgggcgtgcaccccctgagctgccacggctgggtgctgggggagcacggggacagctctgtgcctgtgtggagcggcatgaatgtggccggcgtgtccctgaagaccctgcacccagacctgggcacagacaaggacaaggagcagtggaaggaatgtcgctacaccctgggggaccccaagggggccgccatcctgaagagcagtgatgtgatctccttccactgcctgggctacaaccgcatcctgggcggcggctgtgcctgctgccccttctacctgatctgtgactag

SEQ ID NO: 20260 - DNA, 999 bp, Artificial Sequence; identical to SEQ ID NO: 20258
  Description of Artificial Sequence: Synthetic coding sequence

SEQ ID NO: 20261 - DNA, 825 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgcggacccccaagatcgtgtctgggaaggtggacatcctgacctacgtggcctggaagatcagcggcttccccaagaacagagtgattggcagcggctgcaacctggacagcgcccgcttccgctacctgatgggagagcggctgggcgtgcaccccctgagctgccacggctgggtgctgggggagcacggggacagctctgtgcctgtgtggagcggcatgaatgtggccggcgtgtccctgaagaccctgcacccagacctgggcacagacaaggacaaggagcagtggaaggaggtgcacaagcaggtggtggagagcgcctatgaagtcatcaagctgaagggctacacctcctgggccatcggcctgtctgtggccgacctggccgagagcatcatgaagaacctgcggcgggtgcaccctgtgtccaccatgatcaagggcctgtatggcatcaaggatgatgtgttcctgtctgtgccctgcatcctgggccagaatggcatcagtgacctggtgaaggtgaccctgaccagcgaggaggaggcccggctgaagaagtctgctgacaccctgtggggcatccagaaggagctgcagttctag

SEQ ID NO: 20262 - DNA, 918 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccatcgtgtctgggaaggactacaacgtgacagccaacagcaagctggtgatcatcacagctggggcccggcagcaggagggggagagccggctgaacctggtgcagagaaatgtgaacatcttcaagttcatcatccccaacgtggtgaagtacagccccaactgcaagctgctgattgtgagcaaccctgtggacatcctgacctacgtggcctggaagatcagcggcttccccaagaacagagtcatcggcagcggctgcaacctggacagcgcccgcttccgctacctgatgggagagcggctgggcgtgcaccccctgagctgccacggctgggtgctgggggagcacggggacagctctgtgcctgtgtggagcggcatgaatgtggccggcgtgtccctgaagaccctgcacccagacctgggcacagacaaggacaaggagcagtggaaggaggtgcacaagcaggtggtggagagcgcctatgaggtgatcaagctgaagggctacacctcctgggccatcggcctgtctgtggccgacctggccgagagcatcatgaagaacctgcggcgggtgcaccctgtgtccaccatgatcaagggcctgtatggcatcaaggatgatgtgttcctgtctgtgccctgcatcctgggccagaatggcatcagtgacctggtgaaggtgaccctgaccagcgaggaggaggcccggctgaagaagtctgctgacaccctgtggggcatccagaaggagctgcagttctag

SEQ ID NO: 20263 - DNA, 435 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgcggacccccaagatcgtgtctgggaaggactacaacgtgacagccaacagcaagctggtgatcatcacagctggggcccggcagcaggagggggagagccggctgaacctggtgcagagaaatgtgaacatcttcaagttcatcatccccaacgtggtgaagtacagccccaactgcaagctgctgattgtgagcaaccctggagaggcctttgattag

SEQ ID NO: 20264 - DNA, 345 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgcggacccccaagatcgtgtctgggaaggactacaacgtgacagccaacagcaagctggtgatcatcacagctggggcccggcagcaggagggggagagccggctgaacctggtgcagagaaatgtgtag

SEQ ID NO: 20265 - DNA, 219 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgtag

SEQ ID NO: 20266 - DNA, 1086 bp, Artificial Sequence
  Description of Artificial Sequence: Synthetic coding sequence
atgggagagcccagcggcggctacacctacacccagaccagcatcttcctgttccacgccaagatccccttcggcagcaagagcaacatggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgcggacccccaagatcgtgtctgggaaggactacaacgtgacagccaacagcaagctggtgatcatcacagctggggcccggcagcaggagggggagagccggctgaacctggtgcagagaaatgtgaacatcttcaagttcatcatccccaacgtggtgaagtacagccccaactgcaagctgctgattgtgagcaaccctgtggacatcctgacctacgtggcctggaagatcagcggcttccccaagaacagagtcatcggcagcggctgcaacctggacagcgcccgcttccgctacctgatgggagagcggctgggcgtgcaccccctgagctgccacggctgggtgctgggggagcacggggacagctctgtgcctgtgtggagcggcatgaatgtggccggcgtgtccctgaagaccctgcacccagacctgggcacagacaaggacaaggagcagtggaaggaggtgcacaagcaggtggtggagagcgcctatgaggtgatcaagctgaagggctacacctcctgggccatcggcctgtctgtggccgacctggccgagagcatcatgaagaacctgcggcgggtgcaccctgtgtccaccatgatcaagggcctgtatggcatcaaggatgatgtgttcctgtctgtgccctgcatcctgggccagaatggcatcagtgacctggtgaaggtgaccctgaccagcgaggaggaggcccggctgaagaagtctgctgacaccctgtggggcatccagaaggagctgcagttctag

SEQ ID NO: 20267 - DNA, 999 bp, Artificial Sequence; identical to SEQ ID NO: 20258
  Description of Artificial Sequence: Synthetic coding sequence

SEQ ID NO: 20268 - DNA, 474 bp, Artificial Sequence
  Description of Artificial Sequence: Synthetic coding sequence
atggccaccctgaaggaccagctgatctacaacctgctgaaggaggagcagaccccccagaacaagatcaccgtggtgggcgtgggcgctgtgggcatggcctgtgccatcagcatcctgatgaaggacctggctgatgagctggccctggtggatgtgattgaggacaagctgaagggggagatgatggacctgcagcacggcagcctcttcctgcggacccccaagatcgtgtctgggaaggactacaacgtgacagccaacagcaagctggtgatcatcacagctggggcccggcagcaggagggggagagccggctgaacctggtgcagagaaatgtgaacatcttcaagttcatcatccccaacgtggtgaagtacagccccaactgcaagctgctgattgtgagcaaccctgtggacatcctgacctacgtggcctggaagatcagcggcttccccaagaacagatag

SEQ ID NO: 20269 - DNA, 804 bp, Artificial Sequence
  Description of Artificial Sequence: Synthetic coding sequence
atgggcagcgcctgcatcaaggtgaccaagtacttcctgttcctgttcaacctgatcttcttcatcctgggcgctgtgatcctgggcttcggcgtgtggatcctggccgacaagagcagcttcatctctgtgctgcagaccagcagcagcagcctgaggatgggcgcctacgtgttcatcggcgtgggcgctgtgaccatgctgatgggcttcctgggctgcattggagctgtgaatgaggtgcgctgcctgctgggcctgtactttgccttcctgctgctgatcctgattgcccaggtgacagctggggccctcttctacttcaacatgggcaagctgaagcaggagatgggcggcatcgtgacagagctgatccgggactacaacagcagccgggaggacagcctgcaggatgcctgggactatgtgcaggcccaggtgaagtgctgcggctgggtgtccttctacaactggacagacaatgctgagctgatgaacagacctgaggtgacctacccctgcagctgtgaggtgaagggggaggaggacaacagcctgtctgtgaggaagggcttctgtgaggcccctggcaacagaacccagagcggcaaccaccctgaggactggcctgtgtaccaggagggctgcatggagaaggtgcaggcctggctgcaggagaacctgggcatcatcctgggcgtgggcgtgggcgtggccatcatcgagctgctgggcatggtgctgagcatctgcctgtgcagacatgtgcacagcgaggactacagcaaggtgcccaagtactag

SEQ ID NO: 20270 - DNA, 3393 bp, Artificial Sequence
  Description of Artificial Sequence: Synthetic coding sequence
atgaagaggtctgagaagccagagggctaccggcagatgaggcccaagaccttccctgccagcaactacacagtgagcagccggcagatgctgcaggagatccgggagagcctgaggaacctgagcaagcccagtgatgctgccaaggccgagcacaacatgagcaagatgagcacagaggacccccggcaggtgaggaacccccccaagtttggcacccaccacaaggccctgcaggagatccggaacagcctgctgccctttgccaatgagaccaacagcagccgcagcaccagcgaggtgaacccccagatgctgcaggacctgcaggccgccggctttgatgaggacatggtgatccaggccctgcagaagaccaacaacagaagcattgaagctgccatcgagttcatcagcaagatgagctaccaggacccccggcgggagcagatggctgctgctgctgcccggcccatcaatgcctccatgaagccaggaaatgtgcagcagagcgtgaacaggaagcagagctggaagggcagcaaggagagcctggtgccccagagacatggcccccccctgggggagagcgtggcctaccacagcgagagccccaacagccagacagatgtgggccggcccctgagcggcagcggcatcagcgcctttgtgcaggcccaccccagcaatggccagagggtgaaccccccacctccaccccaggtgcgctctgtgaccccacctcctccaccccggggccagaccccaccaccccggggcaccaccccacctcctccttcctgggagcccaacagccagaccaagcgctacagcggcaacatggagtatgtgatcagccgcatcagccctgtgcccccaggggcctggcaggagggctacccacctccacccctgaacaccagccccatgaacccccccaaccagggccagaggggcatcagctctgtgcctgtgggccggcagcccatcatcatgcagagcagcagcaagttcaacttccccagcggccggcccggcatgcagaatggaacaggccagacagacttcatgatccaccagaatgtggtgcctgctggcaccgtgaaccggcagcccccaccaccctaccccctgacagctgccaacggccagagccccagcgccctgcagacaggaggcagcgctgcccccagcagctacaccaacggcagcatcccccagagcatgatggtgcccaacagaaacagccacaacatggagctgtacaacatctctgtgcccggcctgcagaccaactggccccagagcagcagcgccccagcccagagcagccccagcagcggccacgagatccccacctggcagcccaacatccctgtgcgcagcaacagcttcaacaaccccctgggcaacagagccagccacagcgccaacagccagcccagcgccaccaccgtgacagccatcaccccagcccccatccagcagcctgtgaagtccatgagggtgctgaagccagagctgcagacagccctggcccccacccaccccagctggatcccccagcccatccagacagtgcagcccagccccttccctgagggcacagccagcaatgtgacagtgatgcctcctgtggccgaggcccccaactaccagggccccccaccaccctaccccaagcacctgctgcaccagaaccccagcgtgcccccctatgagagcatcagcaagcccagcaaggaggaccagcccagcctgcccaaggaggatgaaagtgagaagagctatgaaaatgtggacagcggggacaaggagaagaagcagatcaccaccagccccatcaccgtgaggaagaacaagaaggatgaggagcggcgggagagccgcatccagagctacagcccccaggccttcaagttcttcatggagcagcacgtggagaatgtgctgaagagccaccagcagaggctgcacaggaagaagcagctggagaatgagatgatgagggtgggcctgagccaggatgcccaggaccagatgaggaagatgctgtgccagaaggagagcaactacatccggctgaagagggccaagatggacaagtccatgtttgtgaagatcaagaccctgggcattggagccttcggggaggtgtgcctggccaggaaggtggacaccaaggccctgtatgccaccaagaccctgaggaagaaggatgtgctgctgaggaaccaggtggcccacgtgaaggccgagcgggacatcctggccgaggccgacaatgagtgggtggtgcggctgtactacagcttccaggacaaggacaacctgtactttgtgatggactacatccctggaggagacatgatgagcctgctgatccgcatgggcatcttccctgagagcctggcccgcttctacatcgccgagctgacctgtgctgtggagagcgtgcacaagatgggcttcatccaccgggacatcaagccagacaacatcctgattgacagagatggccacatcaagctgacagactttggcctgtgcaccggcttccgctggacccatgacagcaagtactaccagagcggggaccacccccggcaggacagcatggacttcagcaatgagtggggagaccccagcagctgccgctgtggggaccggctgaagcccctggagcggcgggccgcccggcagcaccagcgctgcctggcccacagcctggtgggcacccccaactacatcgcccctgaggtgctgctgaggacaggctacacccagctgtgtgactggtggagcgtgggcgtcatcctgtttgagatgctggtgggccagccccccttcctggcccagacccccctggagacccagatgaaggtgatcaactggcagaccagcctgcacatccccccccaggccaagctgagccctgaggccagtgacctgatcatcaagctgtgccggggcccagaagatcggctgggcaagaatggagcagatgagatcaaggcccaccccttcttcaagaccatcgacttcagcagtgacctgcggcagcagagcgccagctacatccccaagatcacccaccccacagacaccagcaactttgatcctgtggaccctgacaagctgtggagcgatgacaatgaggaggagaatgtgaatgacaccctgaatggctggtacaagaatggcaagcaccctgagcacgccttctatgagttcaccttccgccgcttctttgatgacaatggctacccctacaactaccccaagcccattgaatatgagtacatcaacagccagggcagcgagcagcagagtgatgaagatgaccagaacacaggcagcgagatcaagaacagagacctggtgtatgtgtag

SEQ ID NO: 20271 - DNA, 2073 bp, Artificial Sequence
  Description of Artificial Sequence: Synthetic coding sequence
atgaagaggtctgagaagccagagggctaccggcagatgaggcccaagaccttccctgccagcaactacacagtgagcagccggcagatgctgcaggagatccgggagagcctgaggaacctgagcaagcccagtgatgctgccaaggccgagcacaacatgagcaagatgagcacagaggacccccggcaggtgaggaacccccccaagtttggcacccaccacaaggccctgcaggagatccggaacagcctgctgccctttgccaatgagaccaacagcagccgcagcaccagcgaggtgaacccccagatgctgcaggacctgcaggccgccggctttgatgaggacatggtgatccaggccctgcagaagaccaacaacagaagcattgaagctgccatcgagttcatcagcaagatgagctaccaggacccccggcgggagcagatggctgctgctgctgcccggcccatcaatgcctccatgaagccaggaaatgtgcagcagagcgtgaacaggaagcagagctggaagggcagcaaggagagcctggtgccccagagacatggcccccccctgggggagagcgtggcctaccacagcgagagccccaacagccagacagatgtgggccggcccctgagcggcagcggcatcagcgcctttgtgcaggcccaccccagcaatggccagagggtgaaccccccacctccaccccaggtgcgctctgtgaccccacctcctccaccccggggccagaccccaccaccccggggcaccaccccacctcctccttcctgggagcccaacagccagaccaagcgctacagcggcaacatggagtatgtgatcagccgcatcagccctgtgcccccaggggcctggcaggagggctacccacctccacccctgaacaccagccccatgaacccccccaaccagggccagaggggcatcagctctgtgcctgtgggccggcagcccatcatcatgcagagcagcagcaagttcaacttccccagcggccggcccggcatgcagaatggaacaggccagacagacttcatgatccaccagaatgtggtgcctgctggcaccgtgaaccggcagcccccaccaccctaccccctgacagctgccaacggccagagccccagcgccctgcagacaggaggcagcgctgcccccagcagctacaccaacggcagcatcccccagagcatgatggtgcccaacagaaacagccacaacatggagctgtacaacatctctgtgcccggcctgcagaccaactggccccagagcagcagcgccccagcccagagcagccccagcagcggccacgagatccccacctggcagcccaacatccctgtgcgcagcaacagcttcaacaaccccctgggcaacagagccagccacagcgccaacagccagcccagcgccaccaccgtgacagccatcaccccagcccccatccagcagcctgtgaagtccatgagggtgctgaagccagagctgcagacagccctggcccccacccaccccagctggatcccccagcccatccagacagtgcagcccagccccttccctgagggcacagccagcaatgtgacagtgatgcctcctgtggccgaggcccccaactaccagggccccccaccaccctaccccaagcacctgctgcaccagaaccccagcgtgcccccctatgagagcatcagcaagcccagcaaggaggaccagcccagcctgcccaaggaggatgaaagtgagaagagctatgaaaatgtggacagcggggacaaggagaagaagcagatcaccaccagccccatcaccgtgaggaagaacaagaaggatgaggagcggcgggagagccgcatccagagctacagcccccaggccttcaagttcttcatggagcagcacgtggagaatgtgctgaagagccaccagcagaggctgcacaggaagaagcagctggagaatgagatgatgagggtgaagcccttcaagatgagcatcttcatcctgaaccacctgtttgcctggtgcctcttctag

SEQ ID NO: 20272 - DNA, 3393 bp, Artificial Sequence; identical to SEQ ID NO: 20270
  Description of Artificial Sequence: Synthetic coding sequence

SEQ ID NO: 20273 - DNA, 3267 bp, Artificial Sequence
  Description of Artificial Sequence: Synthetic coding sequence
atgaggcccaagaccttccctgccaccacctacagcggcaacagccggcagaggctgcaggagatccgggagggcctgaagcagcccagcaagagctctgtgcagggcctgcctgctggccccaacagcgacaccagcctggatgccaaggtgctgggcagcaaggatgccacccggcagcagcagcagatgagggccacccccaagtttggcccctaccagaaggccctgcgggagatccgctacagcctgctgccctttgccaatgaaagtggcaccagcgctgctgctgaggtgaaccggcagatgctgcaggagctggtgaatgccggctgtgaccaggagatggccggccgggccctgaagcagacaggcagccgcagcattgaagctgccctggagtacatcagcaagatgggctacctggaccccagaaatgagcagatcgtgcgggtcatcaagcagaccagccctgggaagggcctgatgcccacccctgtgacccggcggcccagctttgagggcaccggggacagctttgccagctaccaccagctgagcggcaccccctatgagggccccagctttggagcagatggccccacagccctggaggagatgccccggccctacgtggactacctgtttcctggggtgggcccccacggccctggccaccagcaccagcacccccccaagggctatggagcctctgtggaggccgccggggcccacttccccctgcagggcgcccactacggccggccccacctgctggtgcctggagagcccctgggctatggagtgcagaggagccccagcttccagagcaagaccccacctgagactggaggctacgccagcctgcccaccaagggccagggcggccccccaggggccggcctggccttccccccacctgctgctggcctgtatgtgccccacccccaccacaagcaggccggccctgctgcccaccagctgcacgtgctgggcagccgcagccaggtgtttgccagtgacagccccccccagagcctgctgacccccagcaggaacagcctgaatgtggacctgtatgagctgggcagcacctctgtgcagcagtggccagctgccaccctggcccggcgggacagcctgcagaagccaggcctggaggccccaccccgggcccacgtggccttccggccagactgccctgtgcccagcaggaccaacagcttcaacagccaccagccccggcccggccccccaggcaaggccgagcccagcctgcctgcccccaacacagtgacagctgtgacagctgcccacatcctgcaccctgtgaagtctgtgcgggtgctgcggcctgagccccagacagctgtgggccccagccacccagcctgggtgcctgccccagccccagccccagccccagccccagccccagctgctgagggcctggatgccaaggaggagcacgccctggccctgggcggggccggggccttccccctggatgtggagtatggaggccctgaccggcgctgccccccaccaccctaccccaagcacctgctgctgcggagcaagtctgagcagtatgacctggacagcctgtgtgccggcatggagcagagcctgcgggccggccccaatgaacctgagggcggggacaagagcaggaagagcgccaagggggacaagggcggcaaggacaagaagcagatccagaccagccctgtgcctgtgaggaagaacagcagagatgaggagaagcgggagagccgcatcaagagctacagcccctatgccttcaagttcttcatggagcagcacgtggagaatgtcatcaagacctaccagcagaaggtgaacagaaggctgcagctggagcaggagatggccaaggccggcctgtgtgaggccgagcaggagcagatgaggaagatcctgtaccagaaggagagcaactacaaccggctgaagagggccaagatggacaagtccatgtttgtgaagatcaagaccctgggcatcggggcctttggagaggtgtgcctggcctgcaaggtggacacccacgccctgtatgccatgaagaccctgaggaagaaggatgtgctgaacagaaaccaggtggcccacgtgaaggccgagcgggacatcctggccgaggccgacaatgagtgggtggtgaagctgtactacagcttccaggacaaggacagcctgtactttgtgatggactacatccctggaggagacatgatgagcctgctgatccgcatggaggtgtttcctgagcacctggcccgcttctacatcgccgagctgaccctggccattgaatctgtgcacaagatgggcttcatccaccgggacatcaagccagacaacatcctgattgacctggatggccacatcaagctgacagactttggcctgtgcaccggcttccgctggacccacaacagcaagtactaccagaagggcagccacgtgcggcaggacagcatggagcccagcgacctgtgggatgatgtgagcaactgccgctgtggggaccggctgaagaccctggagcagagggccaggaagcagcaccagcgctgcctggcccacagcctggtgggcacccccaactacatcgcccctgaggtgctgctgaggaagggctacacccagctgtgtgactggtggagcgtgggcgtcatcctgtttgagatgctggtgggccagccccccttcctggcccccacccccacagagacccagctgaaggtgatcaactgggagaacaccctgcacatcccagcccaggtgaagctgagccctgaggcccgggacctgatcaccaagctgtgctgcagcgctgaccaccggctgggcagaaatggagcagatgacctgaaggcccaccccttcttcagcgccatcgacttcagcagtgacatcaggaagcagcctgccccctacgtgcccaccatcagccaccccatggacaccagcaactttgatcctgtggatgaggagagcccctggaatgatgccagcgagggcagcaccaaggcctgggacaccctgaccagccccaacaacaagcaccctgagcacgccttctatgagttcaccttccgccgcttctttgatgacaatggctaccccttccgctgccccaagcccagcggggctgaggccagccaggccgagagcagtgacctggagagcagtgacctggtggaccagacagagggctgccagcctgtgtatgtgtag

SEQ ID NO: 20274 - DNA, 3267 bp, Artificial Sequence; identical to SEQ ID NO: 20273
  Description of Artificial Sequence: Synthetic coding sequence

SEQ ID NO: 20275 - DNA, 972 bp, Artificial Sequence
  Description of Artificial Sequence: Synthetic coding sequence
atggcctacgtgcctgcccctggctaccagcccacctacaaccccaccctgccctactaccagcccatccctgggggcctgaatgtgggcatgtctgtgtacatccagggcgtggccagcgagcacatgaagcgcttctttgtgaactttgtggtgggccaggaccccggcagtgatgtggccttccacttcaaccccaggtttgatggctgggacaaggtggtgttcaacaccctgcagggcggcaagtggggcagcgaggagaggaagaggtccatgcccttcaagaagggagctgcctttgagctggtgttcatcgtgctggccgagcactacaaggtggtggtgaatggaaaccccttctatgaatatggccaccggctgcccctgcagatggtgacccacctgcaggtggatggagacctgcagctgcagagcatcaacttcatcggcggccagcccctgcggccccagggcccccccatgatgccaccctacccaggccctggccactgccaccagcagctgaacagcctgcccaccatggagggcccccccaccttcaacccccctgtgccctacttcggccgcctgcagggcggcctgacagcccggaggaccatcatcatcaagggctacgtgcccccaacaggcaagagctttgccatcaacttcaaggtgggcagcagcggggacatcgccctgcacatcaaccccaggatgggaaatggaacagtggtgaggaacagcctgctgaatggctcctggggcagcgaggagaagaagatcacccacaaccccttcggccctggccagttctttgacctgagcatccgctgtggcctggaccgcttcaaggtgtatgccaacggccagcacctgtttgattttgcccaccggctgagcgccttccagagggtggacaccctggagatccagggagatgtgaccctgtcctatgtgcagatctag

SEQ ID NO: 20276 - DNA, 1530 bp, Artificial Sequence
  Description of Artificial Sequence: Synthetic coding sequence
atgaacaatgaggaggacctgctgcaggaggacagcaccagagatgagggcaatgaaacagaggccaacagcatgaacaccctgcggaggaccaggaagaaggtgaccaagccctacgtgtgcagcacagaggtgggggagacagacatgagcaacagcaatgactgcatgagggacagcagccagatcctgaccccaccccagctgagcagcaggatgaagcacatccggcaggccatggccaagaaccggctgcagtttgtgcgctttgaggccacagacctgcacggcgtgagccgcagcaagaccatcccagcccacttcttccaggagaaggtgtcccatggagtgtgcatgccccggggctacctggaggtgatccccaaccccaaggacaatgagatgaacaacatccgggccacctgcttcaacagcgacatcgtgctgatgcctgagctgagcaccttccgggtgctgccctgggccgacagaacagcccgggtcatctgtgacaccttcaccgtgactggagagcccctgctgaccagcccccgctacatcgccaagaggcagctgagccacctgcaggccagcggcttcagcctgctgagcgccttcatctatgacttctgcatctttggagtgcctgagatcctgaacagcaagatcatctccttccctgccctgaccttcctgaacaaccacgaccagcccttcatgcaggagctggtggatggcctgtaccacactggagccaacgtggagagcttcagcagcagcaccaggcctggccagatggagatctccttcctgcctgagtttggcatcagcagcgctgacaatgccttcaccctgaggactggagtgaaggaggtggccaggaagtacaactacatcgccagcttcttcatcgagaccggcttctgtgacagcggcatcctgagccacagcctgtgggatgtggacaggaagaagaacatgttctgcagcaccagcggcacagagcagctgaccatcaccgggaagaagtggctggccggcctgctgaagcacagcgctgccctgagctgcctgatggcccccagcgtgtcctgcaggaagcgctacagcaaggacaggaaggacctgaagaagtctgtgcccaccacctggggctacaatgacaacagctgcatcttcaacatcaagtgccacggggagaagggcaccagaattgagaacaagctgggcagcgccacagccaacccctacctggtgctggccgccaccgtggccgccggcctggatggcctgcacagcagcaatgaggtgctggccggcccagatgagagcacagacttctaccaggtggagcccagcgagatccccctgaagctggaggatgccctggtggccctggaggaggaccagtgcctgcggcaggccctgggggagaccttcatccgctactttgtggccatgaagaagtatgagctggagaatgaggagattgctgctgagaggaacaagttcctggagtacttcatctag

SEQ ID NO: 20277 - DNA, 627 bp, Artificial Sequence
  Description of Artificial Sequence: Synthetic coding sequence
atgaacaatgaggaggacctgctgcaggaggacagcaccagagatgagggcaatgaaacagaggccaacagcatgaacaccctgcggaggaccaggaagaaggtgaccaagccctacgtgtgcagcacagaggtgggggagacagacatgagcaacagcaatgactgcatgagggacagcagccagatcctgaccccaccccagctgagcagcaggatgaagcacatccggcaggccatggccaagaaccggctgcagtttgtgcgctttgaggccacagacctgcacggcgtgagccgcagcaagaccatcccagcccacttcttccaggagaaggtgtcccatggagtgtgcatgccccggggctacctggaggtgatccccaaccccaaggacaatgagatgaacaacatccgggccacctgcttcaacagcgacatcgtgctgatgcctgagctgagcaccttccgggtgctgccctgggccgacagaacagcccgggtcatctgtgacaccttcaccgtgacagtgtctggcatgagcatcggcaggaagacctgcagcgctgccctgctggagctgagcagcagccgcagcctgggcaagaatggctggcaggacagctag

SEQ ID NO: 20278 - DNA, 504 bp, Artificial Sequence
  Description of Artificial Sequence: Synthetic coding sequence
atgcactggggcaccctgtgtggcttcctgtggctgtggccctacctgttctacgtgcaggccgtgcccatccagaaggtgcaggatgacaccaagaccctcatcaagaccatcgtgacccgcatcaatgacatcagccacacccagagcgtgagcagcaagcagaaggtgacaggcctggacttcatccctggcctgcaccccatcctgaccctgagcaagatggaccagaccctggccgtgtaccagcagatcctgacctccatgcccagcagaaatgtcatccagatcagcaatgacctggagaacctgcgggacctgctgcacgtgctggccttcagcaagagctgccacctgccctgggccagcggcctggagaccctggacagcctgggcggcgtgctggaggccagcggctacagcacagaggtggtggccctgagccggctgcagggcagcctgcaggacatgctgtggcagctggacctgagccctggctgctag

SEQ ID NO: 20279 - DNA, 1791 bp, Artificial Sequence
  Description of Artificial Sequence: Synthetic coding sequence
atgggctctgtgagcagcctcatcagcggccacagcttccacagcaagcactgccgggccagccagtacaagctgaggaagagcagccacctgaagaagctgaaccgctacagtgatggcctgctgcgcttcggcttcagccaggacagcggccacggcaagagcagcagcaagatgggcaagtctgaggacttcttctacatcaaggtgtcccagaaggcccggggcagccaccacccagactacacagccctgagcagcggggacctgggcggccaggccggcgtggactttgaccccagcaccccacccaagctgatgcccttcagcaaccagctggagatgggcagcgagaagggagctgtgcggcccacagccttcaagcctgtgctgcccaggtctggggccatcctgcacagcagccctgagagcgccagccaccagctgcacccagcccccccagacaagcccaaggagcaggagctgaagccaggcctgtgcagcggggccctgagtgacagcggcaggaacagcatgagcagcctgcccacccacagcaccagcagcagctaccagctggaccccctggtgacccctgtgggccccaccagcagatttggaggcagcgcccacaacatcacccagggcatcgtgctgcaggacagcaacatgatgagcctgaaggccctgtccttcagtgatggcggcagcaagctgggccacagcaacaaggctgacaagggccccagctgtgtgcgcagccccatcagcacagatgagtgcagcatccaggagctggagcagaagctgctggagcgggagggcgccctgcagaagctgcagaggagctttgaggagaaggagctggccagcagcctggcctatgaggagcggccccggcgctgcagagatgagctggagggccctgagcccaagggcggcaacaagctgaagcaggccagccagaagagccagagggcccagcaggtgctgcacctgcaggtgctgcagctgcagcaggagaagaggcagctgcggcaggagctggagagcctgatgaaggagcaggacctgctggagaccaagctgcggagctatgaaagagagaagaccagctttggacctgccctggaggagacccagtgggaggtgtgccagaagagcggggagatcagcctgctgaagcagcagctgaaggagagccagacagaggtgaatgccaaggccagcgagatcctgggcctgaaggcccagctgaaggacacccggggcaagctggagggcctggagctgcggacccaggacctggagggcgccctgcggaccaagggcctggagctggaggtgtgtgaaaatgagctgcagaggaagaagaatgaagctgagctgctgcgggagaaggtgaacctgctggagcaggagctgcaggagctgcgggcccaggccgccctggcccgggacatgggcccccccaccttcccagaagatgtgcctgccctgcagcgggagctggagcggctgcgggcagagctgcgggaggagcggcagggccatgaccagatgagcagcggcttccagcacgagcggctggtgtggaaggaggagaaggagaaggtgatccagtaccagaagcagctgcagcagagctatgtggccatgtaccagaggaaccagaggctggagaaggccctgcagcagctggcccggggggacagcgctggggagcccctggaggtggacctggagggcgctgacatcccctatgaggacatcatcgccacagagatctag

SEQ ID NO: 20280 - DNA, 231 bp, Artificial Sequence
  Description of Artificial Sequence: Synthetic coding sequence
atgggctctgtgagcagcctcatcagcggccacagcttccacagcaagcactgccgggccagccagtacaagctgaggaagagcagccacctgaagaagctgaaccgctacagtgatggcctgctgcgcttcggcttcagccaggacagcggccacggcaaggccatgacccgctgcccccgggccagctccatgagcggcagctgtggcagaagaagaagaagaagatag

SEQ ID NO: 20281 - DNA, 1722 bp, Artificial Sequence
  Description of Artificial Sequence: Synthetic coding sequence
atgggctctgtgagcagcctcatcagcggccacagcttccacagcaagcactgccgggccagccagtacaagctgaggaagagcagccacctgaagaagctgaaccgctacagtgatggcctgctgcgcttcggcttcagccaggacagcggccacggcaagagcagcagcaagatgggcaagtctgaggacttcttctacatcaaggtgtcccagaaggcccggggcagccaccacccagactacacagccctgagcagcggggacctgggcggccaggccggcgtggactttgaccccagcaccccacccaagctgatgcccttcagcaaccagctggagatgggcagcgagaagggagctgtgcggcccacagccttcaagcctgtgctgcccaggtctggggccatcctgcacagcagccctgagagcgccagccaccagctgcacccagcccccccagacaagcccaaggagcaggagctgaagccaggcctgtgcagcggggccctgagtgacagcggcaggaacagcatgagcagcctgcccacccacagcaccagcagcagctaccagctggaccccctggtgacccctgtgggccccaccagcagatttggaggcagcgcccacaacatcacccagggcatcgtgctgcaggacagcaacatgatgagcctgaaggccctgtccttcagtgatggcggcagcaagctgggccacagcaacaaggctgacaagggccccagctgtgtgcgcagccccatcagcacagatgagtgcagcatccaggagctggagcagaagctgctggagcgggagggcgccctgcagaagctgcagaggagctttgaggagaaggagctggccagcagcctggcctatgaggagcggccccggcgctgcagagatgagctggagggccctgagcccaagggcggcaacaagctgaagcaggccagccagaagagccagagggcccagcaggtgctgcacctgcaggtgctgcagctgcagcaggagaagaggcagctgcggcaggagctggagagcctgatgaaggagcaggacctgctggagaccaagctgcggagctatgaaagagagaagaccagctttggacctgccctggaggagacccagtgggaggtgtgccagaagagcggggagatcagcctgctgaagcagcagctgaaggagagccagacagaggtgaatgccaaggccagcgagatcctgggcctgaaggcccagctgaaggacacccggggcaagctggagggcctggagctgcggacccaggacctggagggcgccctgcggaccaagggcctggagctggaggtgtgtgaaaatgagctgcagaggaagaagaatgaagctgagctgctgcgggagaaggtgaacctgctggagcaggagctgcaggagctgcgggcccaggccgccctggcccgggacatgggcccccccaccttcccagaagatgtgcctgccctgcagcgggagctggagcggctggtgtggaaggaggagaaggagaaggtgatccagtaccagaagcagctgcagcagagctatgtggccatgtaccagaggaaccagaggctggagaaggccctgcagcagctggcccggggggacagcgctggggagcccctggaggtggacctggagggcgctgacatcccctatgaggacatcatcgccacagagatctag

SEQ ID NO: 20282 - DNA, 1791 bp, Artificial Sequence; identical to SEQ ID NO: 20279
  Description of Artificial Sequence: Synthetic coding sequence

SEQ ID NO: 20283 - DNA, 1614 bp, Artificial Sequence
  Description of Artificial Sequence: Synthetic coding sequence
atgggctctgtgagcagcctcatcagcggccacagcttccacagcaagcactgccgggccagccagtacaagctgaggaagagcagccacctgaagaagctgaaccgctacagtgatggcctgctgcgcttcggcttcagccaggacagcggccacggcaagagcagcagcaagatgggcaagtctgaggacttcttctacatcaaggtgtcccagaaggcccggggcagccaccacccagactacacagccctgagcagcggggacctgggcggccaggccggcgtggactttgaccccagcaccccacccaagctgatgcccttcagcaaccagctggagatgggcagcgagaagggagctgtgcggcccacagccttcaagcctgtgctgcccaggtctggggccatcctgcacagcagccctgagagcgccagccaccagctgcacccagcccccccagacaagcccaaggagcaggagctgaagccaggcctgtgcagcggggccctgagtgacagcggcaggaacagcatgagcagcctgcccacccacagcaccagcagcagctaccagctggaccccctggtgacccctgtgggccccaccagcagatttggaggcagcgcccacaacatcacccagggcatcgtgctgcaggacagcaacatgatgagcctgaaggccctgtccttcagtgatggcggcagcaagctgggccacagcaacaaggctgacaagggccccagctgtgtgcgcagccccatcagcacagatgagtgcagcatccaggagctggagcagaagctgctggagcgggagggcgccctgcagaagctgcagaggagctttgaggagaaggagctggccagcagcctggcctatgaggagcggccccggcgctgcagagatgagctggagggccctgagcccaagggcggcaacaagctgaagcaggccagccagaagagccagagggcccagcaggtgctgcacctgcaggtgctgcagctgcagcaggagaagaggcagctgcggcaggagctggagagcctgatgaaggagcaggacctgctggagaccaagctgcggagctatgaaagagagaagaccagctttggacctgccctggaggagacccagtgggaggtgtgccagaagagcggggagatcagcctgctgaagcagcagctgaaggagagccagacagaggtgaatgccaaggccagcgagatcctgggcctgaaggcccagctgaaggacacccggggcaagctggagggcctggagctgcggacccaggacctggagggcgccctgcggaccaagggcctggagctggaggtgtgtgaaaatgagctgcagaggaagaagaatgaagctgagctgctgcgggagaagcatgagcggctggtgtggaaggaggagaaggagaaggtgatccagtaccagaagcagctgcagcagagctatgtggccatgtaccagaggaaccagaggctggagaaggccctgcagcagctggcccggggggacagcgctggggagcccctggaggtggacctggagggcgctgacatcccctatgaggacatcatcgccacagagatctag

SEQ ID NO: 20284 - DNA, 1005 bp, Artificial Sequence
  Description of Artificial Sequence: Synthetic coding sequence
atgacagaaaattctgacaaggtgcccatcgccctggtgggcccagatgatgtggagttctgcagccccccagcctatgccaccctgactgtgaagcccagcagccctgcccggctgctgaaggtgggcgctgtggtgctgatctctggagctgtgctgctgctgtttggagccatcggggccttctacttctggaagggcagtgacagccacatctacaacgtgcactacaccatgagcatcaacgggaagctgcaggacggctccatggagattgatgctggcaacaacctggagaccttcaagatgggcagcggggctgaggaggccatcgctgtgaatgacttccagaatggcatcaccggcatccgctttgctggaggagagaagtgctacatcaaggcccaggtgaaggcccgcatccctgaggtgggcgctgtgaccaagcagagcatcagcagcaagctggagggcaagatcatgcctgtgaagtatgaggagaacagcctcatctgggtggccgtggaccagcctgtgaaggacaacagcttcctgagcagcaaggtgctggagctgtgtggggacctgcccatcttctggctgaagcccacctaccccaaggagatccagcgggagcggcgggaggtggtgaggaagatcgtgcccaccaccaccaagaggccccacagcggccccaggagcaaccctggggccggccgcctgaacaatgagacccggcccagcgtgcaggaggacagccaggccttcaacccagacaacccctaccaccagcaggagggggagagcatgacctttgacccccggctggaccacgagggcatctgctgcattgaatgtagaagaagctacacccactgccagaagatctgtgagcccctgggcggctactacccctggccctacaactaccagggctgccgcagcgcctgcagggtcatcatgccctgctcctggtgggtggcccgcatcctgggcatggtgtag

SEQ ID NO: 20285 - DNA, 390 bp, Artificial Sequence
  Description of Artificial Sequence: Synthetic coding sequence
atgagcatcaacgggaagctgcaggacggctccatggagattgatgctggcaacaacctggagaccttcaagatgggcagcggggctgaggaggccatcgctgtgaatgacttccagaatggcatcaccggcatccgctttgctggaggagagaagtgctacatcaaggcccaggtgaaggcccgcatccctgaggtgggcgctgtgaccaagcagagcatcagcagcaagctggagggcaagatcatgcctgtgaagtatgaggagaacagcctcatctgggtggccgtggaccagcctgtgaaggacaacagcttcctgagcagcaaggtgctggagctgtgtggggacctgcccatcttctggctgaagcccacctaccccaagtag

SEQ ID NO: 20286 - DNA, 1002 bp, Artificial Sequence
  Description of Artificial Sequence: Synthetic coding sequence
atgacagaaaattctgacaaggtgcccatcgccctggtgggcccagatgatgtggagttctgcagccccccagcctatgccaccctgactgtgaagcccagcagccctgcccggctgctgaaggtgggcgctgtggtgctgatctctggagctgtgctgctgctgtttggagccatcggggccttctacttctggaagggcagtgacagccacatctacaacgtgcactacaccatgagcatcaacgggaagctgcaggacggctccatggagattgatgctggcaacaacctggagaccttcaagatgggcagcggggctgaggaggccatcgctgtgaatgacttccagaatggcatcaccggcatccgctttgctggaggagagaagtgctacatcaaggcccaggtgaaggcccgcatccctgaggtgggcgctgtgaccaagcagagcatcagcagcaagctggagggcaagatcatgcctgtgaagtatgaggagaacagcctcatctgggtggccgtggaccagcctgtgaaggacaacagcttcctgagcagcaaggtgctggagctgtgtggggacctgcccatcttctggctgaagcccacctaccccaaggagatccagcgggagcggcgggaggtggtgaggaagatcgtgcccaccaccaccaagaggccccacagcggccccaggagcaaccctggggccggccgcctgaacaatgagacccggcccagcgtgcaggaggacagccaggccttcaacccagacaacccctaccaccaggagggggagagcatgacctttgacccccggctggaccacgagggcatctgctgcatcgagtgccgccgcagctacacccactgccagaagatctgtgagcccctgggcggctactacccctggccctacaactaccagggctgccgcagcgcctgcagggtcatcatgccctgctcctggtgggtggcccgcatcctgggcatggtgtag

SEQ ID NO: 20287 - DNA, 408 bp, Artificial Sequence
  Description of Artificial Sequence: Synthetic coding sequence
atgaatgaggtgatcatctacaacgtgctgctgctgcggaccatcagctgcatcagcgagacctacggccactacctgatccactgccccagcaagatcagccctgagctgctgaagaaggagagcatcaccaacagctatgcccacttccagatctacaacgtgcactacaccatgagcatcaacgggaagctgcaggacggctccatggagattgatgctggcaacaacctggagaccttcaagatgggcagcggggctgaggaggccatcgctgtgaatgacttccagaatgtgtccatcttccacgccttccgggagttcaaccaggccagcctgcgggacttcagcaacagccgccgcagctctgtgagccacacccaccccaacggcaactgcagcctgtag

SEQ ID NO: 20288 - DNA, 2760 bp, Artificial Sequence
  Description of Artificial Sequence: Synthetic coding sequence
atgcagaggagcatcatgtccttcttccaccccaagaaggagggcaaggccaagaagccagagaaggaggccagcaacagcagccgggagacagagcccccacccaaggccgccctgaaggagtggaatggagtggtgtctgagagtgacagccctgtgaagaggcctggcaggaaggccgcccgggtgctgggcagcgagggggaggaggaggatgaggccctgagccctgccaagggccagaagccagccctggactgcagccaggtgagcccccccaggcctgccaccagccctgagaacaatgccagcctgagtgacaccagccccatggacagcagccccagcggcatccccaagagaagaacagccaggaagcagctgcccaagaggaccatccaggaggtgctggaggagcagagtgaagatgaggaccgggaggccaagaggaagaaggaggaggaggaggaggagacccccaaggagagcctgacagaagctgaggtggccacagagaaggagggggaggatggagaccagcccaccaccccacccaagcccctgaagaccagcaaggccgagacccccacagaatctgtgtctgagcctgaggtggccaccaagcaggagctgcaggaggaggaggagcagaccaagccaccccggcgggcccccaagaccctgagcagcttcttcacccccaggaagccagctgtgaagaaggaggtgaaggaggaggagcccggggcccctgggaaggagggcgctgctgagggccccctggaccccagcggctacaacccagccaagaacaactaccaccctgtggaggatgcctgctggaagccaggccagaaggtgccctacctggccgtggcccggacctttgagaagattgaggaggtgtctgcccggctgaggatggtggagaccctgagcaacctgctgcggtctgtggtggccctgagccccccagacctgctgcctgtgctgtacctgagcctgaaccacctgggccccccccagcagggcctggagctgggcgtgggagatggagtgctgctgaaggctgtggcccaggccaccggccggcagctggagagcgtgcgggcagaggccgctgagaagggagatgtgggcctggtggccgagaacagccgcagcacccagaggctgatgctgcccccaccacccctgacagccagcggggtcttcagcaagttccgggacatcgcccggctgactggaagtgccagcacagccaagaagattgacatcatcaagggcctgtttgtggcctgccgccacagcgaggcccgcttcatcgcccggagcctgagcggccgcctgcggctgggcctggccgagcagagcgtgctggccgccctgagccaggccgtgtccctgaccccacctggccaggagttccccccagccatggtggatgctgggaagggcaagacagctgaggccaggaagacctggctggaggagcagggcatgatcctgaagcagaccttctgtgaggtgcctgacctggaccgcatcatccctgtgctgctggagcacggcctggagcggctgcctgagcactgcaagctgagccctggcatccccctgaagcccatgctggcccaccccacccggggcatcagcgaggtgctgaagagatttgaggaggccgccttcacctgtgagtacaagtatgatggccagagggcccagatccacgccctggagggcggggaggtgaagatcttcagcaggaaccaggaggacaacacaggcaagtacccagacatcatcagccgcatccccaagatcaagctgcccagcgtgaccagcttcatcctggacacagaggccgtggcctgggaccgggagaagaagcagatccagcccttccaggtgctgaccaccaggaagaggaaggaggtggatgccagcgagatccaggtgcaggtgtgcctgtatgcctttgacctgatctacctgaatggagagagcctggtgcgggagcccctgagcagaagacggcagctgctgcgggagaactttgtggagacagaaggagaatttgtgtttgccaccagcctggacaccaaggacatcgagcagattgctgagttcctggagcagagcgtgaaggacagctgtgagggcctgatggtgaagaccctggatgtggatgccacctatgaaattgccaagaggagccacaactggctgaagctgaagaaggactacctggatggagtgggggacaccctggacctggtggtgattggagcctacctgggccggggcaagagagctggccgctatggaggcttcctgctggccagctatgatgaagattctgaggagctgcaggccatctgcaagctgggcaccggcttcagtgatgaggagctggaggagcaccaccagagcctgaaggccctggtgctgcccagcccccggccctacgtgagaattgatggagctgtgatcccagaccactggctggaccccagcgctgtgtgggaggtgaagtgtgccgacctgagcctgagccccatctacccagctgcccggggcctggtggacagcgacaagggcatcagcctgcgcttcccccgcttcatccgggtgcgggaggacaagcagcctgagcaggccaccaccagcgcccaggtggcctgcctgtacaggaagcagagccagatccagaaccagcagggagaagattctggcagtgaccctgaggacacctactag

SEQ ID NO: 20289 - DNA, 2667 bp, Artificial Sequence
  Description of Artificial Sequence: Synthetic coding sequence
atgcagaggagcatcatggccgccctgaaggagtggaatggagtggtgtctgagagtgacagccctgtgaagaggcctggcaggaaggccgcccgggtgctgggcagcgagggggaggaggaggatgaggccctgagccctgccaagggccagaagccagccctggactgcagccaggtgagcccccccaggcctgccaccagccctgagaacaatgccagcctgagtgacaccagccccatggacagcagccccagcggcatccccaagagaagaacagccaggaagcagctgcccaagaggaccatccaggaggtgctggaggagcagagtgaagatgaggaccgggaggccaagaggaagaaggaggaggaggaggagacccccaaggagagcctgacagaggccgaggtggccacagagaaggagggagaagatggagaccagcccaccaccccacccaagcccctgaagaccagcaaggccgagacccccacagagagcgtgtctgagcctgaggtggccaccaagcaggagctgcaggaggaggaggagcagaccaagcccccaagaagagcccccaagaccctgagcagcttcttcacccccaggaagccagctgtgaagaaggaggtgaaggaggaggagcccggggcccctgggaaggagggcgctgctgagggccccctggaccccagcggctacaacccagccaagaacaactaccaccctgtggaggatgcctgctggaagccaggccagaaggtgccctacctggccgtggcccggacctttgagaagattgaggaggtgtctgcccggctgaggatggtggagaccctgagcaacctgctgcggtctgtggtggccctgagccccccagacctgctgcctgtgctgtacctgagcctgaaccacctgggccccccccagcagggcctggagctgggcgtgggagatggagtgctgctgaaggctgtggcccaggccaccggccggcagctggagagcgtgcgggcagaggccgctgagaagggagatgtgggcctggtggccgagaacagccgcagcacccagaggctgatgctgcccccaccacccctgacagccagcggggtcttcagcaagttccgggacatcgcccggctgaccggcagcgccagcacagccaagaagattgacatcatcaagggcctgtttgtggcctgccgccacagcgaggcccgcttcatcgcccggagcctgagcggccgcctgcggctgggcctggccgagcagagcgtgctggccgccctgagccaggccgtgtccctgaccccacctggccaggagttccccccagccatggtggatgctgggaagggcaagacagctgaggccaggaagacctggctggaggagcagggcatgatcctgaagcagaccttctgtgaggtgcctgacctggaccgcatcatccctgtgctgctggagcacggcctggagcggctgcctgagcactgcaagctgagccctggcatccccctgaagcccatgctggcccaccccacccggggcatcagcgaggtgctgaagagatttgaggaggccgccttcacctgtgagtacaagtatgatggccagagggcccagatccacgccctggagggcggggaggtgaagatcttcagcaggaaccaggaggacaacacaggcaagtacccagacatcatcagccgcatccccaagatcaagctgcccagcgtgaccagcttcatcctggacacagaagctgtggcctgggaccgggagaagaagcagatccagcccttccaggtgctgaccaccaggaagaggaaggaggtggatgccagcgagatccaggtgcaggtgtgcctgtatgcctttgacctgatctacctgaatggagagagcctggtgcgggagcccctgagcagaagacggcagctgctgagagaaaattttgtggagacagaaggagaatttgtgtttgccaccagcctggacaccaaggacatcgagcagattgctgagttcctggagcagagcgtgaaggacagctgtgagggcctgatggtgaagaccctggatgtggatgccacctatgagatcgccaagaggagccacaactggctgaagctgaagaaggactacctggatggagtgggggacaccctggacctggtggtgattggagcctacctgggccggggcaagagagctggccgctatggaggcttcctgctggccagctatgatgaggacagcgaggagctgcaggccatctgcaagctgggcaccggcttcagtgatgaggagctggaggagcaccaccagagcctgaaggccctggtgctgcccagcccccggccctacgtgagaattgatggagctgtgatcccagaccactggctggaccccagcgctgtgtgggaggtgaagtgtgccgacctgagcctgagccccatctacccagctgcccggggcctggtggacagcgacaagggcatcagcctgcgcttcccccgcttcatccgggtgcgggaggacaagcagcctgagcaggccaccaccagcgcccaggtggcctgcctgtacaggaagcagagccagatccagaaccagcagggcgaggacagcggcagtgaccctgaggacacctactag

SEQ ID NO: 20290 - DNA, 2556 bp, Artificial Sequence
  Description of Artificial Sequence: Synthetic coding sequence
atgcagaggagcatcatgtccttcttccaccccaagaaggagggcaaggccaagaagccagagaaggaggccagcaacagcagccgggagacagagcccccacccaaggccgccctgaaggagtggaatggagtggtgtctgagagtgacagccctgtgaagaggcctggcaggaaggccgcccgggtgctgggcagcgagggggaggaggaggatgaggccctgagccctgccaagggccagaagccagccctggactgcagccaggtgagcccccccaggcctgccaccagccctgagaacaatgccagcctgagtgacaccagccccatggacagcagccccagcggcatccccaagagaagaacagaagctgagacccccacagaatctgtgtctgagcctgaggtggccaccaagcaggagctgcaggaggaggaggagcagaccaagccaccccggcgggcccccaagaccctgagcagcttcttcacccccaggaagccagctgtgaagaaggaggtgaaggaggaggagcccggggcccctgggaaggagggcgctgctgagggccccctggaccccagcggctacaacccagccaagaacaactaccaccctgtggaggatgcctgctggaagccaggccagaaggtgccctacctggccgtggcccggacctttgagaagattgaggaggtgtctgcccggctgaggatggtggagaccctgagcaacctgctgcggtctgtggtggccctgagccccccagacctgctgcctgtgctgtacctgagcctgaaccacctgggccccccccagcagggcctggagctgggcgtgggagatggagtgctgctgaaggctgtggcccaggccaccggccggcagctggagagcgtgcgggcagaggccgctgagaagggagatgtgggcctggtggccgagaacagccgcagcacccagaggctgatgctgcccccaccacccctgacagccagcggggtcttcagcaagttccgggacatcgcccggctgactggaagtgccagcacagccaagaagattgacatcatcaagggcctgtttgtggcctgccgccacagcgaggcccgcttcatcgcccggagcctgagcggccgcctgcggctgggcctggccgagcagagcgtgctggccgccctgagccaggccgtgtccctgaccccacctggccaggagttccccccagccatggtggatgctgggaagggcaagacagctgaggccaggaagacctggctggaggagcagggcatgatcctgaagcagaccttctgtgaggtgcctgacctggaccgcatcatccctgtgctgctggagcacggcctggagcggctgcctgagcactgcaagctgagccctggcatccccctgaagcccatgctggcccaccccacccggggcatcagcgaggtgctgaagagatttgaggaggccgccttcacctgtgagtacaagtatgatggccagagggcccagatccacgccctggagggcggggaggtgaagatcttcagcaggaaccaggaggacaacacaggcaagtacccagacatcatcagccgcatccccaagatcaagctgcccagcgtgaccagcttcatcctggacacagaggccgtggcctgggaccgggagaagaagcagatccagcccttccaggtgctgaccaccaggaagaggaaggaggtggatgccagcgagatccaggtgcaggtgtgcctgtatgcctttgacctgatctacctgaatggagagagcctggtgcgggagcccctgagcagaagacggcagctgctgcgggagaactttgtggagacagaaggagaatttgtgtttgccaccagcctggacaccaaggacatcgagcagattgctgagttcctggagcagagcgtgaaggacagctgtgagggcctgatggtgaagaccctggatgtggatgccacctatgaaattgccaagaggagccacaactggctgaagctgaagaaggactacctggatggagtgggggacaccctggacctggtggtgattggagcctacctgggccggggcaagagagctggccgctatggaggcttcctgctggccagctatgatgaagattctgaggagctgcaggccatctgcaagctgggcaccggcttcagtgatgaggagctggaggagcaccaccagagcctgaaggccctggtgctgcccagcccccggccctacgtgagaattgatggagctgtgatcccagaccactggctggaccccagcgctgtgtgggaggtgaagtgtgccgacctgagcctgagccccatctacccagctgcccggggcctggtggacagcgacaagggcatcagcctgcgcttcccccgcttcatccgggtgcgggaggacaagcagcctgagcaggccaccaccagcgcccaggtggcctgcctgtacaggaagcagagccagatccagaaccagcagggagaagattctggcagtgaccctgaggacacctactag

SEQ ID NO: 20291 - DNA, 1248 bp, Artificial Sequence
  Description of Artificial Sequence: Synthetic coding sequence
atgcagaggagcatcatgtccttcttccaccccaagaaggagggcaaggccaagaagccagagaaggaggccagcaacagcagccgggagacagagcccccacccaaggccgccctgaaggagtggaatggagtggtgtctgagagtgacagccctgtgaagaggcctggcaggaaggccgcccgggtgctgggcagcgagggggaggaggaggatgaggccctgagccctgccaagggccagaagccagccctggactgcagccaggtgagcccccccaggcctgccaccagccctgagaacaatgccagcctgagtgacaccagccccatggacagcagccccagcggcatccccaagagaagaacagaggaggagacccccaaggagagcctgacagaagctgaggtggccacagagaaggagggggaggatggagaccagcccaccaccccacccaagcccctgaagaccagcaaggccgagacccccacagaatctgtgtctgagcctgaggtggccaccaagcaggagctgcaggaggaggaggagcagaccaagccaccccggcgggcccccaagaccctgagcagcttcttcacccccaggaagccagctgtgaagaaggaggtgaaggaggaggagcccggggcccctgggaaggagggcgctgctgagggccccctggaccccagcggctacaacccagccaagaacaactaccaccctgtggaggatgcctgctggaagccaggccagaaggtgccctacctggccgtggcccggacctttgagaagattgaggaggtgtctgcccggctgaggatggtggagaccctgagcaacctgctgcggtctgtggtggccctgagccccccagacctgctgcctgtgctgtacctgagcctgaaccacctgggccccccccagcagggcctggagctgggcgtgggagatggagtgctgctgaaggctgtggcccaggccaccggccgggagcggcgggagaccaggagccacaactgccaccccaggcacccccaccccaggagccccctgaaggtgggctcctggagccccagcggcctgcggcagcccaggaaggccacctggggctggtggcccaggacagctgctgccccccggggcagctgctgccaccacctgcggagcctgcccccaggcagcagcgccagcagcgccaccagccctggcagcctggccgtgctgccccagcccaggaggtag

SEQ ID NO: 20292 - DNA, 2499 bp, Artificial Sequence
  Description of Artificial Sequence: Synthetic coding sequence
gtgtgctgccccggcagcggggcccgggaccagaggaaggcccggctgacagatgaggagaagtgctggacaggaagagaaaattctgatgccaacatgcagaggagcatcatgtccttcttccaccccaagaaggagggcaaggccaagaagccagagaaggaggccagcaacagcagccgggagacagagcccccacccaaggccgccctgaaggagtggaatggagtggtgtctgagagtgacagccctgtgaagaggcctggcaggaaggccgcccgggtgctgggcagcgagggggaggaggaggatgaggccctgagccctgccaagggccagaagccagccctggactgcagccaggtgagcccccccaggcctgccaccagccctgagaacaatgccagcctgagtgacaccagccccatggacagcagccccagcggcatccccaagagaagaacagccaggaagcagctgcccaagaggaccatccaggaggtgctggaggagcagagtgaagatgaggaccgggaggccaagaggaagaaggaggaggaggaggagacccccaaggagagcctgacagaggccgaggtggccacagagaaggagggagaagatggagaccagcccaccaccccacccaagcccctgaagaccagcaaggccgagacccccacagagagcgtgtctgagcctgaggtggccaccaagcaggagctgcaggaggaggaggagcagaccaagcccccaagaagagcccccaagaccctgagcagcttcttcacccccaggaagccagctgtgaagaaggaggtgaaggaggaggagcccggggcccctgggaaggagggcgctgctgagggccccctggaccccagcggctacaacccagccaagaacaactaccaccctgtggaggatgcctgctggaagccaggccagaaggtgccctacctggccgtggcccggacctttgagaagattgaggaggtgtctgcccggctgaggatggtggagaccctgagcaacctgctgcggtctgtggtggccctgagccccccagacctgctgcctgtgctgtacctgagcctgaaccacctgggccccccccagcagggcctggagctgggcgtgggagatggagtgctgctgaaggctgtggcccaggccaccggccggcagctggagagcgtgcgggcagaggccgctgagaagggagatgtgggcctggtggccgagaacagccgcagcacccagaggctgatgctgcccccaccacccctgacagccagcggggtcttcagcaagttccgggacatcgcccggctgaccggcagcgccagcacagccaagaagattgacatcatcaagggcctgtttgtggcctgccgccacagcgaggcccgcttcatcgcccggagcctgagcggccgcctgcggctgggcctggccgagcagagcgtgctggccgccctgagccaggccgtgtccctgaccccacctggccaggagttccccccagccatggtggatgctgggaagggcaagacagctgaggccaggaagacctggctggaggagcagggcatgatcctgaagcagaccttctgtgaggtgcctgacctggaccgcatcatccctgtgctgctggagcacggcctggagcggctgcctgagcactgcaagctgagccctggcatccccctgaagcccatgctggcccaccccacccggggcatcagcgaggtgctgaagagatttgaggaggccgccttcacctgtgagtacaagtatgatggccagagggcccagatccacgccctggagggcggggaggtgaagatcttcagcaggaaccaggaggacaacacaggcaagtacccagacatcatcagccgcatccccaagatcaagctgcccagcgtgaccagcttcatcctggacacagaagctgtggcctgggaccgggagaagaagcagatccagcccttccaggtgctgaccaccaggaagaggaaggaggtggatgccagcgagatccaggtgcaggtgtgcctgtatgcctttgacctgatctacctgaatggagagagcctggtgcgggagcccctgagcagaagacggcagctgctgagagaaaattttgtggagacagaaggagaatttgtgtttgccaccagcctggacaccaaggacatcgagcagattgctgagttcctggagcagagcgtgaaggacagctgtgagggcctgatggtgaagaccctggatgtggatgccacctatgagatcgccaagaggagccacaactggctgaagctgaagaaggactacctggatggagtgggggacaccctggacctggtggtgattggagcctacctgggccggggcaagagagctggccgctatggaggcttcctgctggccagctatgatgaggacagcgaggagctgcaggccatctgcaaggtgctgggcaactggggctag

SEQ ID NO: 20293 - DNA, 2850 bp, Artificial Sequence
  Description of Artificial Sequence: Synthetic coding sequence
atgagcctggccttcaagatcttcttcccccagaccctgcgggccctgagcaggaaggagctgtgcctcttcaggaagcaccactggagagatgtgcggcagttcagccagtggagcgagacagacctgctgcacggccaccccctcttcctgcggaggaagcctgtgctgtccttccagggcagccacctgcggagccgggccacctacctggtgttcctgcccggcctgcacgtgggcctgtgcagcggcccctgtgagatggccgagcagcgcttctgtgtggactatgccaagaggggcacagctggctgcaagaagtgcaaggagaagatcgtgaagggcgtgtgcagaattggcaaggtggtgcccaaccccttcagcgagagcggcggggacatgaaggagtggtaccacatcaagtgcatgtttgagaagctggagcgggcccgggccaccaccaagaagattgaggacctgacagagctggagggctgggaggagctggaggacaatgagaaggagcagatcacccagcacatcgctgacctgagcagcaaggctgctggcacccccaagaagaaggctgtggtgcaggccaagctgaccaccaccggccaggtgaccagccctgtgaagggggccagctttgtgaccagcaccaaccccaggaagttcagcggcttcagcgccaagcccaacaacagcggggaggcccccagcagccccacccccaagaggagcctgagcagcagcaaatgtgaccccaggcacaaggactgcctgctgcgggagttcaggaagctgtgtgccatggtggccgacaaccccagctacaacaccaagacccagatcatccaggacttcctgaggaagggcagcgctggagatggcttccatggagatgtgtacctgactgtgaagctgctgctgcccggggtcatcaagacagtgtacaacctgaatgacaagcagatcgtgaagctgttcagccgcatcttcaactgcaacccagatgacatggcccgggacctggagcagggagatgtgtctgagaccatccgggtcttctttgagcagagcaagagcttccccccagctgccaagagcctgctgaccatccaggaggtggatgagttcctgctgcggctgagcaagctgaccaaggaggatgagcagcagcaggccctgcaggacatcgccagccgctgcacagccaatgacctgaagtgcatcatccgcctcatcaagcatgacctgaagatgaacagcggggccaagcacgtgctggatgccctggaccccaatgcctatgaggccttcaaggccagcaggaacctgcaggatgtggtggagcgggtgctgcacaatgcccaggaggtggagaaggagcccggccagaggcgggccctgtctgtgcaggccagcctgatgacccctgtgcagcccatgctggccgaggcctgcaagtctgtggagtatgccatgaagaagtgccccaacggcatgttttctgagatcaagtatgatggagagcgggtgcaggtgcacaagaatggagaccacttctcctacttcagccgcagcctgaagcctgtgctgccccacaaggtggcccacttcaaggactacatcccccaggccttccctgggggccacagcatgatcctggacagcgaggtgctgctgattgacaacaagacaggcaagcccctgcccttcggcaccctgggcgtgcacaagaaggccgccttccaggatgccaacgtgtgcctgtttgtgtttgactgcatctacttcaatgatgtgtccctgatggaccggcccctgtgtgaaagaaggaagttcctgcatgacaacatggtggagatccccaaccgcatcatgttttctgagatgaagagggtgaccaaggccctggacctggccgacatgatcaccagggtcatccaggagggcctggagggcctggtgctgaaggatgtgaagggcacctatgagcccgggaagaggcactggctgaaggtgaagaaggactacctgaatgaaggagccatggctgacacagctgacctggtggtgctgggcgccttctacggccagggcagcaagggcggcatgatgagcatcttcctgatgggctgctatgaccccggcagccagaagtggtgcaccgtgaccaagtgtgccggcggccatgatgatgccaccctggcccggctgcagaatgagctggacatggtgaagatcagcaaggaccccagcaagatccccagctggctgaaggtgaacaagatctactacccagacttcatcgtgcctgaccccaagaaggctgctgtgtgggagatcactggagctgagttcagcaagtctgaggcccacacagcagatggcatcagcatccgcttcccccgctgcacccgcatcagagatgacaaggactggaagagcgccaccaacctgccccagctgaaggagctgtaccagctgagcaaggagaaggctgacttcaccgtggtggccggagatgagggcagcagcaccaccggcggcagcagcgaggagaacaagggccccagcggcagcgctgtgtccaggaaggcccccagcaagcccagcgccagcaccaagaaggccgagggcaagctgagcaacagcaacagcaaggatggcaacatgcagacagccaagcccagcgccatgaaggtgggggagaagctggccaccaagagcagccctgtgaaggtgggggagaagaggaaggccgcagatgagaccctgtgccagaccaagagaagacctgccagcgagcagaggggccgcacagtgcctgctggaagaagatag

SEQ ID NO: 20294 - DNA, 3030 bp, Artificial Sequence
  Description of Artificial Sequence: Synthetic coding sequence
atgagcctggccttcaagatcttcttcccccagaccctgcgggccctgagcaggaaggagctgtgcctcttcaggaagcaccactggagagatgtgcggcagttcagccagtggagcgagacagacctgctgcacggccaccccctcttcctgcggaggaagcctgtgctgtccttccagggcagccacctgcggagccgggccacctacctggtgttcctgcccggcctgcacgtgggcctgtgcagcggcccctgtgagatggccgagcagcgcttctgtgtggactatgccaagaggggcacagctggctgcaagaagtgcaaggagaagatcgtgaagggcgtgtgcagaattggcaaggtggtgcccaaccccttcagcgagagcggcggggacatgaaggagtggtaccacatcaagtgcatgtttgagaagctggagcgggcccgggccaccaccaagaagattgaggacctgacagagctggagggctgggaggagctggaggacaatgagaaggagcagatcacccagcacatcgctgacctgagcagcaaggctgctggcacccccaagaagaaggctgtggtgcaggccaagctgaccaccaccggccaggtgaccagccctgtgaagggggccagctttgtgaccagcaccaaccccaggaagttcagcggcttcagcgccaagcccaacaacagcggggaggcccccagcagccccacccccaagaggagcctgagcagcagcaaatgtgaccccaggcacaaggactgcctgctgcgggagttcaggaagctgtgtgccatggtggccgacaaccccagctacaacaccaagacccagatcatccaggacttcctgaggaagggcagcgctggagatggcttccatggagatgtgtacctgactgtgaagctgctgctgcccggggtcatcaagacagtgtacaacctgaatgacaagcagatcgtgaagctgttcagccgcatcttcaactgcaacccagatgacatggcccgggacctggagcagggagatgtgtctgagaccatccgggtcttctttgagcagagcaagagcttccccccagctgccaagagcctgctgaccatccaggaggtggatgagttcctgctgcggctgagcaagctgaccaaggaggatgagcagcagcaggccctgcaggacatcgccagccgctgcacagccaatgacctgaagtgcatcatccgcctcatcaagcatgacctgaagatgaacagcggggccaagcacgtgctggatgccctggaccccaatgcctatgaggccttcaaggccagcaggaacctgcaggatgtggtggagcgggtgctgcacaatgcccaggaggtggagaaggagcccggccagaggcgggccctgtctgtgcaggccagcctgatgacccctgtgcagcccatgctggccgaggcctgcaagtctgtggagtatgccatgaagaagtgccccaacggcatgttttctgagatcaagtatgatggagagcgggtgcaggtgcacaagaatggagaccacttctcctacttcagccgcagcctgaagcctgtgctgccccacaaggtggcccacttcaaggactacatcccccaggccttccctgggggccacagcatgatcctggacagcgaggtgctgctgattgacaacaagacaggcaagcccctgcccttcggcaccctgggcgtgcacaagaaggccgccttccaggatgccaacgtgtgcctgtttgtgtttgactgcatctacttcaatgatgtgtccctgatggaccggcccctgtgtgaaagaaggaagttcctgcatgacaacatggtggagatccccaaccgcatcatgttttctgagatgaagagggtgaccaaggccctggacctggccgacatgatcaccagggtcatccaggagggcctggagggcctggtgctgaaggatgtgaagggcacctatgagcccgggaagaggcactggctgaaggtgaagaaggactacctgaatgaaggagccatggctgacacagctgacctggtggtgctgggcgccttctacggccagggcagcaagggcggcatgatgagcatcttcctgatgggctgctatgaccccggcagccagaagtggtgcaccgtgaccaagtgtgccggcggccatgatgatgccaccctggcccggctgcagaatgagctggacatggtgaagatcagcaaggaccccagcaagatccccagctggctgaaggtgaacaagatctactacccagacttcatcgtgcctgaccccaagaaggctgctgtgtgggagatcactggagctgagttcagcaagtctgaggcccacacagcagatggcatcagcatccgcttcccccgctgcacccgcatcagagatgacaaggactggaagagcgccaccaacctgccccagctgaaggagctgtaccagctgagcaaggagaaggctgacttcaccgtggtggccggagatgagggcagcagcaccaccggcggcagcagcgaggagaacaagggccccagcggcagcgctgtgtccaggaaggcccccagcaagcccagcgccagcaccaagaaggccgagggcaagctgagcaacagcaacagcaaggatggcaacatgcagacagccaagcccagcgccatgaaggtgggggagaagctggccaccaagagcagccctgtgaaggtgggggagaagaggaaggccgcagatgagaccctgtgccagaccaaggtgctgctggacatcttcaccggggtgcggctgtacctgccccccagcaccccagacttcagccggctgcggcgctactttgtggcctttgatggagacctggtgcaggagtttgacatgaccagcgccacccacgtgctgggcagccgggacaagaacccagctgcccagcaggtgtccccagagtggatctgggcctgcatcaggaagaggcggctggtggccccctgctag

SEQ ID NO: 20295 - DNA, 2736 bp, Artificial Sequence
  Description of Artificial Sequence: Synthetic coding sequence
atggccgccagccagaccagccagacagtggccagccacgtgccctttgctgacctgtgcagcaccctggagcgcatccagaagagcaagggccgggcagagaagatccgccacttccgggagttcctggacagctggaggaagttccatgatgccctgcacaagaaccacaaggatgtgacagacagcttctacccagccatgaggctcatcctgccccagctggagcgggagaggatggcctacggcatcaaggagaccatgctggccaagctgtacatcgagctgctgaacctgcccagagatggcaaggatgccctgaagctgctgaactaccgcacccccaccggcacccatggagatgctggggactttgccatgattgcctactttgtgctgaagccccgctgcctgcagaagggcagcctgaccatccagcaggtgaatgacctgctggacagcatcgccagcaacaacagcgccaagaggaaggacctgatcaagaagagcctgctgcagctgatcacccagagcagcgccctggagcagaagtggctgatccgcatgatcatcaaggacctgaagctgggcgtgtcccagcagaccatcttctctgtgttccacaatgatgctgctgagctgcacaacgtgaccacagacctggagaaggtgtgccggcagctgcatgaccccagcgtgggcctgagtgacatcagcatcaccctcttcagcgccttcaagcccatgctggccgccatcgctgacatcgagcacatcgagaaggacatgaagcaccagagcttctacatcgagaccaagctggatggagagaggatgcagatgcacaaggatggagatgtgtacaagtacttcagcagaaatggctacaactacacagaccagtttggagccagccccacagagggcagcctgacccccttcatccacaatgccttcaaggctgacatccagatctgcatcctggatggagagatgatggcctacaaccccaacacccagaccttcatgcagaagggcaccaagtttgacatcaagaggatggtggaggacagcgacctgcagacctgctactgtgtgtttgatgtgctgatggtgaacaacaagaagctgggccacgagaccctgaggaagagatatgagatcctgagcagcatcttcacccccatccctggccgcatcgagatcgtgcagaagacccaggcccacaccaagaatgaggtgattgatgccctgaatgaggccatcgacaagcgggaggagggcatcatggtgaagcagcccctgagcatctacaagccagacaagagaggagagggctggctgaagatcaagccagaatatgtgtctggcctgatggatgagctggacatcctgattgtgggcggctactggggcaagggcagcagaggaggcatgatgagccacttcctgtgtgctgtggccgagaagcccccacctggagagaagcccagcgtcttccacaccctgagccgggtgggcagcggctgcaccatgaaggagctgtatgacctgggcctgaagctggccaagtactggaagcccttccacaggaaggccccacccagcagcatcctgtgtggcacagagaagccagaggtgtacatcgagccctgcaacagcgtcatcgtgcagatcaaggctgctgagatcgtgcccagcgacatgtacaagacaggctgcaccctgcgcttccccagaattgagaagatcagagatgacaaggagtggcatgagtgcatgaccctggatgacctggagcagctgcggggcaaggccagcggcaagctggccagcaagcacctgtacatcggaggagatgatgagccccaggagaagaagaggaaggccgcccccaagatgaagaaggtgattggcatcatcgagcacctgaaggcccccaacctgaccaacgtgaacaagatcagcaacatctttgaagatgtggagttctgtgtgatgagcggcacagacagccagcccaagccagacctggagaacagaattgctgagtttggaggctacatcgtgcagaaccctggccctgacacctactgtgtgattgctggcagcgagaacatccgggtgaagaacatcatcctgagcaacaagcatgatgtggtgaagccagcctggctgctggagtgcttcaagaccaagagctttgtgccctggcagccccgcttcatgatccacatgtgccccagcaccaaggagcactttgcccgggagtatgactgctatggagacagctacttcatcgacacagacctgaaccagctgaaggaggtgttttctggcatcaagaacagcaatgagcagaccccagaggagatggccagcctgattgctgacctggagtaccgctacagctgggactgcagccccctgtccatgttccgccgccacacagtgtacctggacagctatgctgtgatcaatgacctgagcaccaagaatgaaggcacccggctggccatcaaggccctggagctgcgcttccacggggccaaggtggtgtcctgcctggccgagggcgtgagccacgtgatcattggagaggaccacagccgggtggccgacttcaaggccttccggaggaccttcaagaggaagttcaagatcctgaaggagagctgggtgacagacagcattgacaagtgtgagctgcaggaggagaaccagtacctgatctag

SEQ ID NO: 20296 - DNA, 2736 bp, Artificial Sequence; identical to SEQ ID NO: 20295
  Description of Artificial Sequence: Synthetic coding sequence

SEQ ID NO: 20297 - DNA, 2736 bp, Artificial Sequence; identical to SEQ ID NO: 20295
  Description of Artificial Sequence: Synthetic coding sequence

SEQ ID NO: 20298 - DNA, 1944 bp, Artificial Sequence
  Description of Artificial Sequence: Synthetic coding sequence
atgaggctgaccctgctgtgctgcacctggagggaggagaggatgggagaggagggcagcgagctgcctgtgtgtgccagctgtggccagaggatctatgatggccagtacctgcaggccctgaatgctgactggcatgctgactgcttccgctgctgtgactgcagcgccagcctgagccaccagtactatgagaaggatggccagctgttctgcaagaaggactactgggcccgctacggggagagctgccacggctgcagcgagcagatcaccaagggcctggtgatggtggccggggagctgaagtaccaccctgagtgcttcatctgcctgacctgtggcaccttcatcggagatggagacacctacaccctggtggagcacagcaagctgtactgcggccactgctactaccagacagtggtgacccctgtgattgagcagatcctgcctgacagccctggcagccacctgccccacacagtgaccctggtgtccatcccagccagcagccacggcaagaggggcctgtctgtgtccattgaccccccccacggccccccaggctgcggcacagagcacagccacacagtgcgggtgcagggcgtggaccccggctgcatgagcccagatgtgaagaacagcatccacgtgggggaccgcatcctggagatcaatggcacccccatcagaaatgtgcccctggatgaaattgacctgctgatccaggagaccagccggctgctgcagctgaccctggagcatgacccccatgacaccctgggccacggcctgggccctgagaccagccccctgagcagccctgcctacaccccatctggagaggccggcagcagcgcccggcagaagcctgtgctgcggagctgcagcattgacaggagccctggagctggcagcctgggcagccctgccagccagaggaaggacctgggccgctctgagagcctgcgggtggtgtgccggccccaccgcatcttccggcccagcgacctgattcatggagaggtgctgggcaagggctgcttcggccaggccatcaaggtgacccaccgggagactggagaggtgatggtgatgaaggagctgatccgctttgatgaggagacccagaggaccttcctgaaggaggtgaaggtgatgcgctgcctggagcaccccaacgtgctgaagttcatcggcgtgctgtacaaggacaagaggctgaacttcatcacagagtacatcaagggcggcaccctgcggggcatcatcaagtccatggacagccagtacccctggagccagagggtgtcctttgccaaggacatcgccagcggcatggcctacctgcacagcatgaacatcatccaccgggacctgaacagccacaactgcctggtgcgggagaacaagaatgtggtggtggccgactttggcctggcccggctgatggtggatgagaagacccagcctgagggcctgcggagcctgaagaagccagacaggaagaagcgctacacagtggtgggcaacccctactggatggcccctgagatgatcaatggccgctcctatgatgagaaggtggatgtgttctcctttggaattgtgctgtgtgagatcatcggccgggtgaatgctgaccctgactacctgcccaggaccatggactttggcctgaatgtgcggggcttcctggaccgctactgcccccccaactgcccccccagcttcttccccatcaccgtgcgctgctgtgacctggaccctgagaagaggcccagctttgtgaagctggagcactggctggagaccctgaggatgcacctggccggccacctgcccctgggcccccagctggagcagctggaccggggcttctgggagacctacagaagaggagagagcggcctgcctgcccaccctgaggtgcctgactag

SEQ ID NO: 20299 - DNA, 1944 bp, Artificial Sequence; identical to SEQ ID NO: 20298
  Description of Artificial Sequence: Synthetic coding sequence

SEQ ID NO: 20300 - DNA, 1842 bp, Artificial Sequence
  Description of Artificial Sequence: Synthetic coding sequence
atgctgctggccagcgcccccaggagaagacgcttcctgcagagggccaagtgctgtgactgcagcgccagcctgagccaccagtactatgagaaggatggccagctgttctgcaagaaggactactgggcccgctacggggagagctgccacggctgcagcgagcagatcaccaagggcctggtgatggtggccggggagctgaagtaccaccctgagtgcttcatctgcctgacctgtggcaccttcatcggagatggagacacctacaccctggtggagcacagcaagctgtactgcggccactgctactaccagacagtggtgacccctgtgattgagcagatcctgcctgacagccctggcagccacctgccccacacagtgaccctggtgtccatcccagccagcagccacggcaagaggggcctgtctgtgtccattgaccccccccacggccccccaggctgcggcacagagcacagccacacagtgcgggtgcagggcgtggaccccggctgcatgagcccagatgtgaagaacagcatccacgtgggggaccgcatcctggagatcaatggcacccccatcagaaatgtgcccctggatgaaattgacctgctgatccaggagaccagccggctgctgcagctgaccctggagcatgacccccatgacaccctgggccacggcctgggccctgagaccagccccctgagcagccctgcctacaccccatctggagaggccggcagcagcgcccggcagaagcctgtgctgcggagctgcagcattgacaggagccctggagctggcagcctgggcagccctgccagccagaggaaggacctgggccgctctgagagcctgcgggtggtgtgccggccccaccgcatcttccggcccagcgacctgattcatggagaggtgctgggcaagggctgcttcggccaggccatcaaggtgacccaccgggagactggagaggtgatggtgatgaaggagctgatccgctttgatgaggagacccagaggaccttcctgaaggaggtgaaggtgatgcgctgcctggagcaccccaacgtgctgaagttcatcggcgtgctgtacaaggacaagaggctgaacttcatcacagagtacatcaagggcggcaccctgcggggcatcatcaagtccatggacagccagtacccctggagccagagggtgtcctttgccaaggacatcgccagcggcatggcctacctgcacagcatgaacatcatccaccgggacctgaacagccacaactgcctggtgcgggagaacaagaatgtggtggtggccgactttggcctggcccggctgatggtggatgagaagacccagcctgagggcctgcggagcctgaagaagccagacaggaagaagcgctacacagtggtgggcaacccctactggatggcccctgagatgatcaatggccgctcctatgatgagaaggtggatgtgttctcctttggaattgtgctgtgtgagatcatcggccgggtgaatgctgaccctgactacctgcccaggaccatggactttggcctgaatgtgcggggcttcctggaccgctactgcccccccaactgcccccccagcttcttccccatcaccgtgcgctgctgtgacctggaccctgagaagaggcccagctttgtgaagctggagcactggctggagaccctgaggatgcacctggccggccacctgcccctgggcccccagctggagcagctggaccggggcttctgggagacctacagaagaggagagagcggcctgcctgcccaccctgaggtgcctgactag

SEQ ID NO: 20301 - DNA, 471 bp, Artificial Sequence
  Description of Artificial Sequence: Synthetic coding sequence
atgatggtgctggacaaggaggatggagtgcccatgctgtctgtgcagcccaagggcaagcagaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgcagaagagactacctgcggctgtttggcaccactggaaactgtgccgcctgcagcaagctgatcccagcctttgagatggtgatgagggcccgggacaacgtgtaccacctggactgctttgcctgccagctgtgcaaccagcgcttctgtgtgggggacaagttcttcctgaagaacaacatgatcctgtgccagatggactatgaggagggccagctgaatggcacctttgagagccaggtgcagtag

SEQ ID NO: 20302 - DNA, 468 bp, Artificial Sequence
  Description of Artificial Sequence: Synthetic coding sequence
atggtgctggaccaggaggatggagtgcccatgctgtctgtgcagcccaagggcaagcagaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgccggcgggactacctgcggctgtttggcaccaccggcaactgtgccgcctgcagcaagctgatcccagcctttgagatggtgatgagggcccgggacaacgtgtaccacctggactgctttgcctgccagctgtgcaaccagcgcttctgtgtgggggacaagttcttcctgaagaacaacatgatcctgtgccagatggactatgaggagggccagctgaatggcacctttgagagccaggtgcagtag

SEQ ID NO: 20303 - DNA, 684 bp, Artificial Sequence
  Description of Artificial Sequence: Synthetic coding sequence
atggagggcagcgctgtgacagtgctggagcggggcggggccagcagccctgctgagcggcgcagcaagagaagaagaagaagtggaggagatggcggcggcggcggcggggcccgggcccctgagggcgtgcgggccccagctgctggccagccccgggccaccaagggggcccctcctcctcctggcaccccaccacccagccccatgagcagcgccatcgagaggaagagcctggaccccagcgaggagcctgtggatgaggtgctgcagatcccccccagcctgctgacctgtggcggctgccagcagaacatcggggaccgctacttcctgaaggccatcgaccagtactggcatgaggactgcctgagctgtgacctgtgtggctgccgcctgggggaggtgggccggcggctgtactacaagctgggcaggaagctgtgccggcgggactacctgcggctgtttggccaggacggcctgtgtgccagctgtgacaagaggatccgggcctatgagatgaccatgagggtgaaggacaaggtgtaccacctggagtgcttcaagtgtgccgcctgccagaagcacttctgtgtgggggaccgctacctgctgatcaacagcgacatcgtgtgtgagcaggacatctatgagtggaccaagatcaatggcatgatctag

SEQ ID NO: 20304 - DNA, 477 bp, Artificial Sequence
  Description of Artificial Sequence: Synthetic coding sequence
atgagcagcgccattgaaaggaagagcctggaccccagcgaggagcctgtggatgaggtgctgcagatcccccccagcctgctgacctgtggcggctgccagcagaacattggagaccgctacttcctgaaggccatcgaccagtactggcatgaggactgcctgagctgtgacctgtgtggctgccgcctgggggaggtgggcagaagactctactacaagctgggcaggaagctgtgcagaagagactacctgcggctgtttggccaggacggcctgtgtgccagctgtgacaagaggatccgggcctatgagatgaccatgagggtgaaggacaaggtgtaccacctggagtgcttcaagtgtgccgcctgccagaagcacttctgtgtgggggaccgctacctgctgatcaacagcgacatcgtgtgtgagcaggacatctatgagtggaccaagatcaatggcatgatctag

SEQ ID NO: 20305 - DNA, 1677 bp, Artificial Sequence
  Description of Artificial Sequence: Synthetic coding sequence
atgcaccggggcggccagcccctgaagaagagaagaggcagcttcaagatggccgagctggaccagctgcctgatgagagcagcagcgccaaggccctggtgtccctgaaggagggcagcctgagcaacacctggaatgagaagtacagcagcctgcagaagacccctgtgtggaagggcaggaacaccagcagcgctgtggagatgcccttcaggaacagcaagaggagccgcctcttcagtgatgaagatgaccggcagatcaacaccaggagccccaagaggaaccagagggtggccatggtgccccagaagttcaccgccaccatgagcaccccagacaagaaggccagccagaagattggcttccggctgaggaacctgctgaagctgcccaaggcccacaagtggtgcatctatgagtggttctacagcaacatcgacaagcccctgtttgaaggagacaatgacttctgtgtgtgcctgaaggagagcttccccaacctgaagaccaggaagctgaccagggtggagtggggcaagatccggcggctgatgggcaagccccggcgctgcagcagcgccttctttgaggaggagaggtctgccctgaagcagaagaggcagaagatccggctgctgcagcagaggaaggtggctgatgtgtcccagttcaaggacctgcctgatgagatccccctgcccctggtgattggcaccaaggtgacagcccggctgcggggcgtgcatgatggcctcttcaccggccagattgatgctgtggacaccctgaatgccacctacagagtgacctttgacagaacaggcctgggcacccacaccatcccagactatgaggtgctgagcaatgagccccatgagaccatgcccatcgccgccttcggccagaagcagaggcccagccgcttcttcatgaccccaccccggctgcactacaccccacccctgcagagccccatcatcgacaatgaccccctgctgggccagagcccctggaggagcaagatcagcggcagtgacacagagaccctgggcggcttccctgtggagttcctgatccaggtgacccggctgagcaagatcctgatgatcaagaaggagcacatcaagaagctgcgggagatgaacacagaggccgagaagctgaagagctacagcatgcccatcagcattgagttccagaggagatatgccaccatcgtgctggagctggagcagctgaacaaggacctgaacaaggtgctgcacaaggtgcagcagtactgctatgagctggccccagaccagggcctgcagcctgctgaccagcccacagacatgagaagaagatgtgaggaggaggcccaggagatcgtgagacatgccaacagcagcacaggccagccctgtgtggagaatgaaaacctgacagacctgatcagccggctgacagccatcctgctgcagatcaagtgcctggccgagggcggggacctgaacagctttgagttcaagagcctgacagacagcctgaatgacatcaagagcaccattgatgccagcaacatcagctgcttccagaacaacgtggagatccacgtggcccacatccagagcggcctgagccagatgggcaacctgcacgcctttgctgccaacaacaccaacagagactag

SEQ ID NO: 20306 - DNA, 1524 bp, Artificial Sequence
  Description of Artificial Sequence: Synthetic coding sequence
atggccgagctggaccagctgcctgatgagagcagcagcgccaaggccctggtgtccctgaaggagggcagcctgagcaacacctggaatgagaagtacagcagcctgcagaagacccctgtgtggaagggcaggaacaccagcagcgctgtggagatgaagttcaccgccaccatgagcaccccagacaagaaggccagccagaagattggcttccggctgaggaacctgctgaagctgcccaaggcccacaagtggtgcatctatgagtggttctacagcaacatcgacaagcccctgtttgaaggagacaatgacttctgtgtgtgcctgaaggagagcttccccaacctgaagaccaggaagctgaccagggtggagtggggcaagatccggcggctgatgggcaagccccggcgctgcagcagcgccttctttgaggaggagaggtctgccctgaagcagaagaggcagaagatccggctgctgcagcagaggaaggtggctgatgtgtcccagttcaaggacctgcctgatgagatccccctgcccctggtgattggcaccaaggtgacagcccggctgcggggcgtgcatgatggcctcttcaccggccagattgatgctgtggacaccctgaatgccacctacagagtgacctttgacagaacaggcctgggcacccacaccatcccagactatgaggtgctgagcaatgagccccatgagaccatgcccatcgccgccttcggccagaagcagaggcccagccgcttcttcatgaccccaccccggctgcactacaccccacccctgcagagccccatcatcgacaatgaccccctgctgggccagagcccctggaggagcaagatcagcggcagtgacacagagaccctgggcggcttccctgtggagttcctgatccaggtgacccggctgagcaagatcctgatgatcaagaaggagcacatcaagaagctgcgggagatgaacacagaagctgagaagctgaagagctacagcatgcccatcagcattgagttccagaggagatatgccaccatcgtgctggagctggagcagctgaacaaggacctgaacaaggtgctgcacaaggtgcagcagtactgctatgagctggccccagaccagggcctgcagcctgctgaccagcccacagacatgagaagaagatgtgaggaggaggcccaggagatcgtgagacatgccaacagcagcacaggccagccctgtgtggagaatgaaaacctgacagacctgatcagccggctgacagccatcctgctgcagatcaagtgcctggccgagggcggggacctgaacagctttgagttcaagagcctgacagacagcctgaatgacatcaagagcaccattgatgccagcaacatcagctgcttccagaacaacgtggagatccacgtggcccacatccagagcggcctgagccagatgggcaacctgcacgcctttgctgccaacaacaccaacagagactag

SEQ ID NO: 20307 - DNA, 1572 bp, Artificial Sequence
  Description of Artificial Sequence: Synthetic coding sequence
atgaggcccaggacagagggcttcttccccccagctggggccagcctgcccttcagcaccaggaacaagcagcctgctgtgcctgctgctgctgcccgggctgctgagcacgcccctggagctggccctggccgggacagcggggccggcacagcccccccagccctgcggcggcgggccagcccctgtggcctgctgccccccttcctgcccccaggcagcgctgggggcggcggcggcggggcccggcggggcccccccagcgctgcccccccacccagggctggagctggaggagctggccctgccagcgccagccggggcggcagcagcgctgccaggagaagaggccagagggccccccacagcaacctgcccaggaaggacagcctgcggcccaccatgcaccggggcggccagcccctgaagaagagaagaggcagcttcaagatggccgagctggaccagctgcctgatgagagcagcagcgccaaggccctggtgtccctgaaggagggcagcctgagcaacacctggaatgagaagtacagcagcctgcagaagacccctgtgtggaagggcaggaacaccagcagcgctgtggagatgcccttcaggaacagcaagaggagccgcctcttcagtgatgaagatgaccggcagatcaacaccaggagccccaagaggaaccagagggtggccatggtgccccagaagttcaccgccaccatgagcaccccagacaagaaggccagccagaagattggcttccggctgaggaacctgctgaagctgcccaaggcccacaagtggtgcatctatgagtggttctacagcaacatcgacaagcccctgtttgaaggagacaatgacttctgtgtgtgcctgaaggagagcttccccaacctgaagaccaggaagctgaccagggtggagtggggcaagatccggcggctgatgggcaagccccggcgctgcagcagcgccttctttgaggaggagaggtctgccctgaagcagaagaggcagaagatccggctgctgcagcagaggaaggtggctgatgtgtcccagttcaaggacctgcctgatgagatccccctgcccctggtgattggcaccaaggtgacagcccggctgcggggcgtgcatgatggcctcttcaccggccagattgatgctgtggacaccctgaatgccacctacagagtgacctttgacagaacaggcctgggcacccacaccatcccagactatgaggtgctgagcaatgagccccatgagaccatgcccatcgccgccttcggccagaagcagaggcccagccgcttcttcatgaccccaccccggctgcactacaccccacccctgcagagccccatcatcgacaatgaccccctgctgggccagagcccctggaggagcaagatcagcggcagtgacacagagaccctgggcggcttccctgtggagttcctgatccaggtgacccggctgagcaagatcctgatgatcaagggcacctaccaggagatcaagggaaatgagcacaggagcaggaagattggatag

SEQ ID NO: 20308 - DNA, 1842 bp, Artificial Sequence
  Description of Artificial Sequence: Synthetic coding sequence
gagacagctgagcagaacagcagcctggccgtgggcctgaatgaccagctgcatgacctgagccgcagccgcagccctgctgcccggagcagcgccagcaacatccgggagcggcgggcccgcatcgcccggggccgctgggacagagtgcctgatgtggccacccggcggggcctgctgcggcctgctgtgtctgggaaggtgcggggcagaagaagacccagcaatgtgggctttggaaactgcagcagcgccaaggccctggtgtccctgaaggagggcagcctgagcaacacctggaatgagaagtacagcagcctgcagaagacccctgtgtggaagggcaggaacaccagcagcgctgtggagatgcccttcaggaacagcaagaggagccgcctcttcagtgatgaagatgaccggcagatcaacaccaggagccccaagaggaaccagagggtggccatggtgccccagaagttcaccgccaccatgagcaccccagacaagaaggccagccagaagattggcttccggctgaggaacctgctgaagctgcccaaggcccacaagtggtgcatctatgagtggttctacagcaacatcgacaagcccctgtttgaaggagacaatgacttctgtgtgtgcctgaaggagagcttccccaacctgaagaccaggaagctgaccagggtggagtggggcaagatccggcggctgatgggcaagccccggcgctgcagcagcgccttctttgaggaggagaggtctgccctgaagcagaagaggcagaagatccggctgctgcagcagaggaaggtggctgatgtgtcccagttcaaggacctgcctgatgagatccccctgcccctggtgattggcaccaaggtgacagcccggctgcggggcgtgcatgatggcctcttcaccggccagattgatgctgtggacaccctgaatgccacctacagagtgacctttgacagaacaggcctgggcacccacaccatcccagactatgaggtgctgagcaatgagccccatgagaccatgcccatcgccgccttcggccagaagcagaggcccagccgcttcttcatgaccccaccccggctgcactacaccccacccctgcagagccccatcatcgacaatgaccccctgctgggccagagcccctggaggagcaagatcagcggcagtgacacagagaccctgggcggcttccctgtggagttcctgatccaggtgacccggctgagcaagatcctgatgatcaagaaggagcacatcaagaagctgcgggagatgaacacagaagctgagaagctgaagagctacagcatgcccatcagcattgagttccagaggagatatgccaccatcgtgctggagctggagcagctgaacaaggacctgaacaaggtgctgcacaaggtgcagcagtactgctatgagctggccccagaccagggcctgcagcctgctgaccagcccacagacatgagaagaagatgtgaggaggaggcccaggagatcgtgagacatgccaacagcagcacaggccagccctgtgtggagaatgaaaacctgacagacctgatcagccggctgacagccatcctgctgcagatcaagtgcctggccgagggcggggacctgaacagctttgagttcaagagcctgacagacagcctgaatgacatcaagagcaccattgatgccagcaacatcagctgcttccagaacaacgtggagatccacgtggcccacatccagagcggcctgagccagatgggcaacctgcacgcctttgctgccaacaacaccaacagagactag

SEQ ID NO: 20309 - DNA, 13800 bp, Artificial Sequence
  Description of Artificial Sequence: Synthetic coding sequence
atgtctgagttcctgctggccctgctgaccctgagcggcctgctgcccatcgcccgggtgctgactgtgggcgctgaccgggaccagcagctgtgtgaccccggggagttcctgtgccacgaccacgtgacctgtgtgtcccagagctggctgtgtgatggagaccctgactgcccagatgacagtgatgagagcctggacacctgcccagaggaggtggagatcaagtgccccctgaaccacatcgcctgcctgggcaccaacaagtgtgtgcacctgagccagctgtgcaatggagtgctggactgcccagatggctatgatgagggcgtgcactgccaggagctgctgagcaactgccagcagctgaactgccagtacaagtgcaccatggtgaggaacagcacccgctgctactgtgaagatggctttgagatcacagaagatggccgcagctgcaaggaccaggatgaatgtgctgtgtatggcacctgcagccagacctgcaggaacacccacggcagctacacctgcagctgtgtggagggctacctgatgcagcctgacaacagaagctgcaaggccaagattgagcccacagacaggcctcccatcctgctgattgccaactttgagaccatcgaggtgttctacctgaatggcagcaagatggccaccctgagctctgtgaatggaaatgagatccacaccctggacttcatctacaatgaagacatgatctgctggattgagagccgggagagcagcaaccagctgaagtgcatccagatcaccaaggccggcggcctgacagatgagtggaccatcaacatcctgcagagcttccacaacgtgcagcagatggccatcgactggctgaccaggaacctgtactttgtggaccacgtgggggaccgcatctttgtgtgcaacagcaatggatctgtgtgtgtgaccctgattgacctggagctgcacaaccccaaggccatcgctgtggaccccatcgccggcaagctgttcttcacagattatggaaatgtggccaaggtggagcgctgtgacatggatggcatgaacagaacccgcatcatcgacagcaagacagagcagcctgctgccctggccctggacctggtgaacaagctggtgtactgggtggacctgtacctggactatgtgggcgtggtggactaccagggcaagaacagacacacagtcatccagggccggcaggtgcgccacctgtatggcatcaccgtgtttgaggactacctgtatgccaccaacagcgacaactacaacatcgtgcgcatcaaccgcttcaatggaacagacatccacagcctcatcaagattgaaaatgcctggggcatccgcatctaccagaagaggacccagcccaccgtgcgcagccacgcctgtgaggtggacccctacggcatgcctgggggctgcagccacatctgcctgctgagcagcagctacaagaccaggacctgccgctgcaggacaggcttcaacctgggcagtgatggccgcagctgcaagaggcccaagaatgaactcttcctgttctacggcaagggccggcccggcatcgtgcggggcatggacctgaacaccaagattgctgatgagtacatgatccccatcgagaacctggtgaacccccgggccctggacttccacgccgagaccaactacatctactttgctgacaccaccagcttcctgattggccggcagaagattgatggaacagagcgggagaccatcctgaaggatgacctggacaacgtggagggcattgctgtggactggattggcaacaacctgtactggaccaatgatggccacaggaagaccatcaacgtggcccggctggagaaggccagccagagcaggaagaccctgctggagggggagatgagccacccccggggcatcgtggtggaccctgtgaatggctggatgtactggacagactgggaggaggatgaaattgatgacagcgtgggccgcatcgagaaggcctggatggatggcttcaaccggcagatctttgtgaccagcaagatgctgtggcccaacggcctgaccctggacttccacaccaacaccctgtactggtgtgatgcctactatgaccacatcgagaaggtgttcctgaatggcacccacaggaagatcgtgtacagcggccgggagctgaaccaccccttcggcctgagccaccacggcaactacgtgttctggacagactacatgaatggcagcatcttccagctggacctgatcaccagcgaggtgaccctgctgcggcatgagaggcctcccctgtttggcctgcagatctatgaccccaggaagcagcagggcgacaacatgtgccgggtgaacaacggcggctgcagcaccctgtgcctggccatccctgggggccgggtgtgtgcctgtgccgacaaccagctgctggatgaaaatggcaccacctgcaccttcaaccctggagaggccctgccccacatctgcaaggccggggagttccgctgcaagaacagacactgcatccaggcccgctggaagtgtgatggagatgatgactgcctggatggcagtgatgaggacagcgtgaactgcttcaaccacagctgcccagatgaccagttcaagtgccagaacaaccgctgcatccccaagcgctggctgtgtgatggagccaatgactgtggcagcaatgaagatgagagcaaccagacctgcacagcccggacctgccaggtggaccagttcagctgtggaaatggccgctgcatcccccgggcctggctgtgtgacagagaagatgactgtggggaccagacagatgagatggccagctgtgagttccccacctgtgagcccctgacccagtttgtgtgcaagagcggccgctgcatcagcagcaagtggcactgtgacagtgatgatgactgtggagatggcagtgatgaggtgggctgtgtgcacagctgctttgacaaccagttccgctgcagcagcggccgctgcatccctggccactgggcctgtgatggagacaatgactgtggggacttcagtgatgaggcccagatcaactgcaccaaggaggagatccacagccctgctggctgcaatggaaatgagttccagtgccacccagatggcaactgtgtgcctgacctgtggaggtgtgatggagagaaggactgtgaagatggcagtgatgagaagggctgcaatggcaccatccggctgtgtgaccacaagaccaagttcagctgctggagcacaggccgctgcatcaacaaggcctgggtgtgtgatggagacatcgactgtgaggaccagagtgatgaagatgactgtgacagcttcctgtgtggcccccccaagcacccctgtgccaatgacacctctgtgtgcctgcagcctgagaagctgtgcaatggcaagaaggactgcccagatggcagtgatgagggctacctgtgtgatgaatgttccctgaacaacggcggctgcagcaaccactgcagcgtggtgcccggccggggcatcgtgtgcagctgcccagagggcctgcagctgaacaaggacaacaagacctgtgagatcgtggactactgcagcaaccacctgaagtgcagccaggtgtgtgagcagcacaagcacacagtgaagtgcagctgctatgagggctggaagctggatgtggatggagagagctgcacctctgtggacccctttgaggccttcatcatcttcagcatcagacatgagatcagaagaattgacctgcacaagagggactacagcctgctggtgcccggcctgaggaacaccatcgccctggacttccacttcaaccagagcctgctgtactggacagatgtggtggaggaccgcatctaccggggcaagctgtctgagagcggcggcgtgtctgccatcgaggtggtggtggagcacggcctggccaccccagagggcctgactgtggactggattgctggcaacatctactggattgacagcaacctggaccagatcgaggtggccaagctggatggcagcctgcggaccaccctgattgctggggccatggagcacccccgggccatcgccctggaccccaggtatggcatcctcttctggacagactgggatgccaacttcccccgcatcgagagcgcctccatgtctggggccggcaggaagaccatctacaaggacatgaagacaggagcctggcccaacggcctgactgtggaccactttgagaagagaattgtgtggacagatgcccggagtgatgccatctacagcgccctgtatgatggcaccaacatgattgagatcatccggggccacgagtacctgagccacccctttgctgtgtccctgtatggcagcgaggtgtactggacagactggaggaccaacaccctgagcaaggccaacaagtggacaggccagaatgtgtctgtcatccagaagaccagcgcccagccctttgacctgcagatctaccaccccagccggcagccccaggcccccaacccctgtgccgccaatgatggcaagggcccctgcagccacatgtgcctgatcaaccacaacagatctgctgcctgtgcctgcccccacctgatgaagctgagcagtgacaagaagacctgctatgagatgaagaagttcctgctgtatgcccggcgctctgagatccggggcgtggacatcgacaacccctacttcaacttcatcacagccttcaccgtgcctgacattgatgatgtgacagtgattgactttgatgccagcgaggagcggctgtactggacagacatcaagacccagaccatcaagagggccttcatcaatggcaccggcctggagaccgtcatcagccgggacatccagagcatccggggcctggccgtggactgggtgtccaggaacctgtactggatcagcagcgagtttgatgagacccagatcaacgtggcccggctggatggcagcctgaagaccagcatcatccacggcatcgacaagccccagtgcctggccgcccaccctgtgcggggcaagctgtactggacagatggcaacaccatcaacatggccaacatggatggcagcaacagcaagatcctcttccagaaccagaaggagcctgtgggcctgagcattgattatgtggagaacaagctgtactggatcagcagtggaaatggcaccatcaaccgctgcaacctggatggcggcaacctggaggtgattgagagcatgaaggaggagctgaccaaggccacagccctgaccatcatggacaagaagctgtggtgggccgaccagaacctggcccagctgggcacctgcagcaagagagatggaagaaaccccaccatcctgaggaacaagaccagcggcgtggtgcacatgaaggtgtatgacaaggaggcccagcagggcagcaacagctgccagctgaacaacggcggctgcagccagctgtgcctgcccaccagcgagaccaccaggacctgcatgtgcaccgtgggctactacctgcagaagaacaggatgagctgccagggcatcgagagcttcctgatgtacagcgtgcatgagggcatccggggcatccccctggagcccagcgacaagatggatgccctgatgcccatcagcggcaccagctttgctgtgggcatcgacttccacgccgagaatgacaccatctactggacagacatgggcttcaacaagatcagccgggccaagagggaccagacctggaaggaggacatcatcaccaacggcctgggccgggtggagggcattgctgtggactggattgctggcaacatctactggacagaccacggcttcaacctgattgaggtggcccggctgaatggcagcttccgctacgtgatcatcagccagggcctggaccagcccaggagcattgctgtgcaccctgagaagggcctgctcttctggacagagtggggccagatgccctgcatcggcaaggcccggctggatggcagcgagaaggtggtgctggtgtccatgggcatcgcctggcccaacggcatcagcattgattatgaggagaacaagctgtactggtgtgatgccaggacagacaagattgaaagaattgacctggagactggaggcaaccgggagatggtgctgagcggcagcaatgtggacatgttttctgtggccgtgtttggagcctacatctactggagcgaccgggcccacgccaatggatctgtgagaagaggccacaagaatgatgccacagagaccatcaccatgaggacaggcctgggcgtgaacctgaaggaggtgaagatcttcaacagagtgcgggagaagggcaccaacgtgtgtgcccgggacaatggaggctgcaagcagctgtgcctgtaccggggcaacagcaggaggacctgtgcctgtgcccacggctacctggctgaagatggagtgacctgcctgcggcatgagggctacctgctgtacagcggccgcaccatcctgaagagcatccacctgagtgatgagaccaacctgaacagccccatccggccctatgagaacccccgctacttcaagaatgtgattgccctggcctttgactacaaccagaggaggaagggcaccaaccgcatcttctacagtgatgcccacttcggcaacatccagctgatcaaggacaactgggaggaccggcaggtgattgtggagaatgtgggctctgtggagggcctggcctaccaccgggcctgggacaccctgtactggaccagcagcaccaccagcagcatcaccaggcacacagtggaccagaccaggcctggggcctttgaccgggaggccgtcatcaccatgtctgaagatgaccacccccacgtgctggccctggatgagtgccagaacctgatgttctggaccaactggaatgagcagcaccccagcatcatgaggagcaccctgaccgggaagaatgcccaggtggtggtgtccacagacatcctgacccccaacggcctgaccatcgactacagagctgagaagctgtacttcagtgatggcagcctgggcaagattgagcgctgtgaatatgatggcagccagagacatgtgattgtgaagagcggccctggcaccttcctgagcctggccgtgtatgacaactacatcttctggagcgactggggcagaagagccatcctgcggagcaacaagtacacaggaggagacaccaagatcctgcggagtgacatcccccaccagcccatgggcatcatcgctgtggccaatgacaccaacagctgtgagctgagcccctgtgccctgctgaatggaggctgccacgacctgtgcctgctgacccccaacggccgggtgaactgcagctgccgcggggaccgcatcctgctggaggacaacagatgtgtgaccaagaacagcagctgcaatgcctacagcgagtttgaatgtggaaatggagagtgcatcgactaccagctgacctgtgatggcatcccccactgcaaggacaagagtgatgagaagctgctgtactgtgagaacagaagctgcagaagaggcttcaagccctgctacaacagacgctgcatcccccacggcaagctgtgtgatggagaaaatgactgtggggacaacagtgatgagctggactgcaaggtgtccacctgtgccaccgtggagttccgctgtgctgatggcacctgcatccccaggtctgcccgctgcaaccagaacatcgactgtgctgatgccagtgatgagaagaactgcaacaacacagactgcacccacttctacaagctgggcgtgaagaccaccggcttcatccgctgcaacagcaccagcctgtgtgtgctgcccacctggatctgtgatggcagcaatgactgtggggactacagtgatgagctgaagtgccctgtgcagaacaagcacaagtgtgaggagaactacttcagctgccccagcggccgctgcatcctgaacacctggatctgtgatggccagaaggactgtgaagatggaagagatgagttccactgtgacagcagctgctcctggaaccagtttgcctgcagcgcccagaagtgcatcagcaagcactggatctgtgatggagaagatgactgtggagatggcctggatgaaagtgacagcatctgtggggccatcacctgtgccgctgacatgttcagctgccagggcagccgggcctgtgtgcccaggcactggctgtgtgatggagagcgggactgcccagatggcagtgatgagctgagcacagctggctgtgcccccaacaacacctgtgatgaaaatgccttcatgtgccacaacaaggtgtgcatccccaagcagtttgtgtgtgaccatgatgatgactgtggagatggcagtgatgagagcccccagtgtggctaccggcagtgtggcacagaggagttcagctgtgctgatggccgctgcctgctgaacacccagtggcagtgtgatggagactttgactgcccagaccacagtgatgaggcccccctgaaccccaagtgcaagtctgctgagcagagctgcaacagcagcttcttcatgtgcaagaatggccgctgcatccccagcggcggcctgtgtgacaacaaggatgactgtggagatggcagtgatgaaagaaactgccacatcaatgaatgtctgagcaagaaggtgtctggctgcagccaggactgccaggacctgcctgtgtcctacaagtgcaagtgctggccaggcttccagctgaaggatgatggcaagacctgtgtggacattgatgaatgtagcagcggcttcccctgcagccagcagtgcatcaacacctacggcacctacaagtgcctgtgcacagatggctatgagatccagcctgacaaccccaacggctgcaagagcctgagtgatgaggagcccttcctgatcctggccgaccaccacgagatcaggaagatcagcacagatggcagcaactacaccctgctgaagcagggcctgaacaacgtcatcgccatcgactttgactaccgggaggagttcatctactggattgacagcagccggcccaacggcagccgcatcaacaggatgtgcctgaatggaagtgacatcaaggtggtgcacaacacagctgtgcccaatgccctggccgtggactggattggcaagaacctgtactggagcgacacagagaagaggatcatcgaggtgtccaagctgaatggcctgtaccccaccatcctggtgtccaagaggctgaagttcccccgggacctgagcctggacccccaggccggctacctgtactggattgactgctgtgagtacccccacatcggccgggtgggcatggatggcaccaaccagagcgtggtgattgagaccaagatcagccggcccatggccctgaccattgattatgtgaacagaaggctgtactgggcagatgagaaccacatcgagttcagcaacatggatggcagccaccgccacaaggtgcccaaccaggacatccctggggtcatcgccctgaccctgtttgaggactacatctactggacagatggcaagaccaagagcctgagccgggcccacaagaccagcggggctgaccggctgagcctcatctacagctggcacgccatcacagacatccaggtgtaccacagctaccggcagccagatgtgtccaagcacctgtgcatgatcaacaatggaggctgcagccacctgtgcctgctggcccctgggaagacccacacctgtgcctgccccaccaacttctacctggccgctgacaacagaacctgcctgagcaactgcacagccagccagttccgctgcaagacagacaagtgcatccccttctggtggaagtgtgacacagtggatgactgtggagatggcagtgatgagccagatgactgcccagagttccgctgccagcccggccgcttccagtgtggcaccggcctgtgtgccctgcctgccttcatctgtgatggagaaaatgactgtggggacaacagtgatgagctgaactgtgacacccacgtgtgcctgagcggccagttcaagtgcaccaagaaccagaagtgcatccctgtgaacctgcgctgcaatggccaggatgactgtggagatgaggaggatgagcgggactgcccagagaacagctgcagcccagactacttccagtgcaagaccaccaagcactgcatcagcaagctgtgggtgtgtgatgaggaccctgactgtgctgatgccagtgatgaggccaactgtgacaagaagacctgtggcccccatgagttccagtgcaagaacaacaactgcatcccagaccactggaggtgtgacagccagaatgactgcagcgacaacagtgatgaggagaactgcaagccccagacctgcaccctgaaggacttcctgtgtgccaacggggactgtgtgagcagccgcttctggtgtgatggagactttgactgtgctgatggcagtgatgaaagaaactgtgagaccagctgcagcaaggaccagttccgctgcagcaatggccagtgcatcccagccaagtggaagtgtgatggccacgaggactgcaagtacggggaggatgagaagagctgtgagcccgccagccccacctgcagcagccgggagtacatctgtgccagtgatggctgcatcagcgccagcctgaagtgcaatggagaatatgactgtgctgatggcagtgatgagatggactgtgtgacagagtgcaaggaggaccagttccgctgcaagaacaaggcccactgcatccccatccgctggctgtgtgatggcatccatgactgtgtggatggcagtgatgaggagaactgtgagcggggcggcaacatctgcagagcagatgagttcctgtgcaacaacagcctgtgcaagctgcacttctgggtgtgtgatggagaagatgactgtggggacaacagtgatgaggccccagacatgtgtgtgaagttcctgtgccccagcacccggccccaccgctgcaggaacaaccgcatctgcctgcagagcgagcagatgtgcaatggaattgatgaatgtggggacaacagtgatgaggaccactgcggcggcaagctgacctacaaggcccggccctgcaagaaggatgaatttgcctgcagcaacaagaagtgcatccccatggacctgcagtgtgaccggctggatgactgtggagatggcagtgatgagcagggctgccgcatcgcccccacagagtacacctgtgaggacaacgtgaacccctgtggagatgatgcctactgcaaccagatcaagaccagcgtcttctgccgctgcaagccaggcttccagaggaacatgaagaaccggcagtgtgaggacctgaatgaatgtctggtgtttggcacctgcagccaccagtgcatcaacgtggagggcagctacaagtgtgtgtgtgaccagaacttccaggagaggaacaacacctgcatcgccgagggcagcgaggaccaggtgctgtacatcgccaatgacacagacatcctgggcttcatctaccccttcaactacagcggggaccaccagcagatcagccacatcgagcacaacagccgcatcaccggcatggatgtgtactaccagagggacatgatcatctggagcacccagttcaaccctgggggcatcttctacaagaggatccacggccgggagaagaggcaggccaacagcggcctcatctgcccagagttcaagaggccccgggacattgctgtggactgggtggccggcaacatctactggacagaccacagcaggatgcactggttctcctactacaccacccactggaccagcctgcgctacagcatcaacgtgggccagctgaatggccccaactgcacccggctgctgaccaacatggccggggagccctatgccatcgctgtgaaccccaagaggggcatgatgtactggacagtggtgggggaccacagccacatcgaggaggccgccatggatggcaccctgcggcgcatcctggtgcagaagaacctgcagaggcccaccggcctggccgtggactacttcagcgagcgcatctactgggccgactttgagctgagcatcatcggctctgtgctgtatgatggcagcaacagcgtggtgtctgtgagcagcaagcagggcctgctgcacccccacagaattgacatctttgaggactacatctatggagctggccccaagaatggagtcttccgggtgcagaagtttggacatggctctgtggagtacctggccctgaacatcgacaagaccaagggcgtgctgatcagccaccgctacaagcagctggacctgcccaacccctgcctggacctggcctgtgagttcctgtgcctgctgaaccccagcggggccacctgtgtgtgcccagagggcaagtacctgatcaatggcacctgcaatgatgacagcctgctggatgacagctgcaagctgacctgtgaaaatggaggccgctgcatcctgaatgagaagggggacctgcgctgccactgctggcccagctacagcggggagcgctgtgaggtgaaccactgcagcaactactgccagaatggaggcacctgtgtgcccagcgtgctgggccggcccacctgcagctgtgccctgggcttcaccggccccaactgtgggaagacagtgtgtgaggacttctgccagaatggaggcacctgcatcgtgacagctggcaaccagccctactgccactgccagcctgagtacaccggggaccgctgccagtactacgtgtgccaccactactgtgtgaacagcgagagctgcaccatcggagatgatggctctgtggagtgtgtgtgccccaccaggtatgagggccccaagtgtgaggtggacaagtgtgtgcgctgccacggcggccactgcatcatcaacaaggacagcgaggacatcttctgcaactgcaccaacgggaagatcgccagcagctgccagctgtgtgatggctactgctacaacggcggcacctgccagctggaccctgagaccaacgtgcctgtgtgcctgtgcagcaccaactggagcggcacccagtgtgagaggcctgcccccaagagcagcaagagtgaccacatcagcaccaggagcatcgccatcatcgtgcccctggtgctgctggtgaccctcatcaccaccctggtgattggcctggtgctgtgcaagaggaagaggaggaccaagaccatccggcggcagcccatcatcaatggaggcatcaacgtggagatcggcaaccccagctacaacatgtatgaggtggaccatgaccacaatgatggcggcctgctggaccccggcttcatgattgaccccaccaaggcccgctacatcggcggcggccccagcgccttcaagctgccccacacagccccacccatctacctgaacagcgacctgaagggccccctgacagctggccccaccaactacagcaaccctgtgtatgccaagctgtacatggatggccagaactgcaggaacagcctgggctctgtggatgagaggaaggagctgctgcccaagaagattgagatcggcatccgggagaccgtggcctag

SEQ ID NO: 20310 - DNA, 2349 bp, Artificial Sequence
  Description of Artificial Sequence: Synthetic coding sequence
atgtctgagttcctgctggccctgctgaccctgagcggcctgctgcccatcgcccgggtgctgactgtgggcgctgaccgggaccagcagctgtgtgaccccggggagttcctgtgccacgaccacgtgacctgtgtgtcccagagctggctgtgtgatggagaccctgactgcccagatgacagtgatgagagcctggacaccagcaggacctgccaggtggaccagttcagctgtggaaatggccgctgcatcccccgggcctggctgtgtgaccgggaggatgactgtggggaccagacagatgagatggccagctgtgagttccccacctgtgagcccctgacccagtttgtgtgcaagagcggccgctgcatcagcagcaagtggcactgtgacagtgatgatgactgtggagatggcagtgatgaggtgggctgtgtgcacagctgctttgacaaccagttccgctgcagcagcggccgctgcatccctggccactgggcctgtgatggagacaatgactgtggggacttcagtgatgaggcccagatcaactgcaccaaggaggagatccacagccctgctggctgcaatggaaatgagttccagtgccacccagatggcaactgtgtgcctgacctgtggaggtgtgatggagagaaggactgtgaagatggcagtgatgagaagggctgcaatggcaccatccggctgtgtgaccacaagaccaagttcagctgctggagcacaggccgctgcatcaacaaggcctgggtgtgtgatggagacatcgactgtgaggaccagagtgatgaagatgactgtgacagcttcctgtgtggcccccccaagcacccctgtgccaatgacacctctgtgtgcctgcagcctgagaagctgtgcaatggcaagaaggactgcccagatggcagtgatgagggctacctgtgtgatgagtgcagcctgaacaatggaggctgcagcaaccactgcagcgtggtgcccggccggggcatcgtgtgcagctgcccagagggcctgcagctgaacaaggacaacaagacctgtgaaattgtggactactgcagcaaccacctgaagtgcagccaggtgtgtgagcagcacaagcacacagtgaagtgcagctgctatgagggctggaagctggatgtggatggagagagctgcacctctgtggacccctttgaggccttcatcatcttcagcatcagacatgagatcagaagaattgacctgcacaagagggactacagcctgctggtgcccggcctgaggaacaccatcgccctggacttccacttcaaccagagcctgctgtactggacagatgtggtggaggaccgcatctaccggggcaagctgtctgagagcggaggagtgtctgccatcgaggtggtggtggagcacggcctggccaccccagagggcctgactgtggactggattgctggcaacatctactggattgacagcaacctggaccagatcgaggtggccaagctggatggcagcctgcggaccaccctgattgctggggccatggagcacccccgggccatcgccctggaccccaggtatggcatcctcttctggacagactgggatgccaacttccccagaattgaaagtgcctccatgtctggagctggcaggaagaccatctacaaggacatgaagacaggagcctggcccaacggcctgactgtggaccactttgagaagagaattgtgtggacagatgcccggagtgatgccatctacagcgccctgtatgatggcaccaacatgattgagatcatccggggccacgagtacctgagccacccctttgctgtgtccctgtatggcagcgaggtgtactggacagactggaggaccaacaccctgagcaaggccaacaagtggacaggccagaatgtgtctgtcatccagaagaccagcgcccagccctttgacctgcagatctaccaccccagccggcagccccaggcccccaacccctgtgccgccaatgatggcaagggcccctgcagccacatgtgcctgatcaaccacaacagatctgctgcctgtgcctgcccccacctgatgaagctgagcagtgacaagaagacctgctatgagatgaagaagttcctgctgtatgccaggagaagtgagatccggggcgtggacatcgacaacccctacttcaacttcatcacagccttcaccgtgcctgacattgatgatgtgaccgtcatcgactttgatgccagcgaggagcggctgtactggacagacatcaagacccagaccatcaagagggccttcatcaatggatag

SEQ ID NO: 20311 - DNA, 13614 bp, Artificial Sequence
  Description of Artificial Sequence: Synthetic coding sequence
ttcctgcacagcggccctgaggaggtggagatcaagtgccccctgaaccacatcgcctgcctgggcaccaacaagtgtgtgcacctgagccagctgtgcaatggagtgctggactgcccagatggctatgatgagggcgtgcactgccagggcgagagcatctgccagcagctgaactgcaccatgtacaagtacaagtgcaccatggtgaggaacagcacccgctgctactgtgaagatggctttgagatcacagaagatggccgcagctgcaaggaccaggatgaatgtgctgtgtatggcacctgcagccagacctgcaggaacacccacggcagctacacctgcagctgtgtggagggctacctgatgcagcctgacaacagaagctgcaaggccaagattgagcccacagacaggcctcccatcctgctgattgccaactttgagaccatcgaggtgttctacctgaatggcagcaagatggccaccctgagctctgtgaatggaaatgagatccacaccctggacttcatctacaatgaagacatgatctgctggattgagagccgggagagcagcaaccagctgaagtgcatccagatcaccaaggccggcggcctgacagatgagtggaccatcaacatcctgcagagcttccacaacgtgcagcagatggccatcgactggctgaccaggaacctgtactttgtggaccacgtgggggaccgcatctttgtgtgcaacagcaatggatctgtgtgtgtgaccctgattgacctggagctgcacaaccccaaggccatcgctgtggaccccatcgccggcaagctgttcttcacagattatggaaatgtggccaaggtggagcgctgtgacatggatggcatgaacagaacccgcatcatcgacagcaagacagagcagcctgctgccctggccctggacctggtgaacaagctggtgtactgggtggacctgtacctggactatgtgggcgtggtggactaccagggcaagaacagacacacagtcatccagggccggcaggtgcgccacctgtatggcatcaccgtgtttgaggactacctgtatgccaccaacagcgacaactacaacatcgtgcgcatcaaccgcttcaatggaacagacatccacagcctcatcaagattgaaaatgcctggggcatccgcatctaccagaagaggacccagcccaccgtgcgcagccacgcctgtgaggtggacccctacggcatgcctgggggctgcagccacatctgcctgctgagcagcagctacaagaccaggacctgccgctgcaggacaggcttcaacctgggcagtgatggccgcagctgcaagaggcccaagaatgaactcttcctgttctacggcaagggccggcccggcatcgtgcggggcatggacctgaacaccaagattgctgatgagtacatgatccccatcgagaacctggtgaacccccgggccctggacttccacgccgagaccaactacatctactttgctgacaccaccagcttcctgattggccggcagaagattgatggaacagagcgggagaccatcctgaaggatgacctggacaacgtggagggcattgctgtggactggattggcaacaacctgtactggaccaatgatggccacaggaagaccatcaacgtggcccggctggagaaggccagccagagcaggaagaccctgctggagggggagatgagccacccccggggcatcgtggtggaccctgtgaatggctggatgtactggacagactgggaggaggatgaaattgatgacagcgtgggccgcatcgagaaggcctggatggatggcttcaaccggcagatctttgtgaccagcaagatgctgtggcccaacggcctgaccctggacttccacaccaacaccctgtactggtgtgatgcctactatgaccacatcgagaaggtgttcctgaatggcacccacaggaagatcgtgtacagcggccgggagctgaaccaccccttcggcctgagccaccacggcaactacgtgttctggacagactacatgaatggcagcatcttccagctggacctgatcaccagcgaggtgaccctgctgcggcatgagaggcctcccctgtttggcctgcagatctatgaccccaggaagcagcagggcgacaacatgtgccgggtgaacaacggcggctgcagcaccctgtgcctggccatccctgggggccgggtgtgtgcctgtgccgacaaccagctgctggatgaaaatggcaccacctgcaccttcaaccctggagaggccctgccccacatctgcaaggccggggagttccgctgcaagaacagacactgcatccaggcccgctggaagtgtgatggagatgatgactgcctggatggcagtgatgaggacagcgtgaactgcttcaaccacagctgcccagatgaccagttcaagtgccagaacaaccgctgcatccccaagcgctggctgtgtgatggagccaatgactgtggcagcaatgaagatgagagcaaccagacctgcacagcccggacctgccaggtggaccagttcagctgtggaaatggccgctgcatcccccgggcctggctgtgtgacagagaagatgactgtggggaccagacagatgagatggccagctgtgagttccccacctgtgagcccctgacccagtttgtgtgcaagagcggccgctgcatcagcagcaagtggcactgtgacagtgatgatgactgtggagatggcagtgatgaggtgggctgtgtgcacagctgctttgacaaccagttccgctgcagcagcggccgctgcatccctggccactgggcctgtgatggagacaatgactgtggggacttcagtgatgaggcccagatcaactgcaccaaggaggagatccacagccctgctggctgcaatggaaatgagttccagtgccacccagatggcaactgtgtgcctgacctgtggaggtgtgatggagagaaggactgtgaagatggcagtgatgagaagggctgcaatggcaccatccggctgtgtgaccacaagaccaagttcagctgctggagcacaggccgctgcatcaacaaggcctgggtgtgtgatggagacatcgactgtgaggaccagagtgatgaagatgactgtgacagcttcctgtgtggcccccccaagcacccctgtgccaatgacacctctgtgtgcctgcagcctgagaagctgtgcaatggcaagaaggactgcccagatggcagtgatgagggctacctgtgtgatgaatgttccctgaacaacggcggctgcagcaaccactgcagcgtggtgcccggccggggcatcgtgtgcagctgcccagagggcctgcagctgaacaaggacaacaagacctgtgagatcgtggactactgcagcaaccacctgaagtgcagccaggtgtgtgagcagcacaagcacacagtgaagtgcagctgctatgagggctggaagctggatgtggatggagagagctgcacctctgtggacccctttgaggccttcatcatcttcagcatcagacatgagatcagaagaattgacctgcacaagagggactacagcctgctggtgcccggcctgaggaacaccatcgccctggacttccacttcaaccagagcctgctgtactggacagatgtggtggaggaccgcatctaccggggcaagctgtctgagagcggcggcgtgtctgccatcgaggtggtggtggagcacggcctggccaccccagagggcctgactgtggactggattgctggcaacatctactggattgacagcaacctggaccagatcgaggtggccaagctggatggcagcctgcggaccaccctgattgctggggccatggagcacccccgggccatcgccctggaccccaggtatggcatcctcttctggacagactgggatgccaacttcccccgcatcgagagcgcctccatgtctggggccggcaggaagaccatctacaaggacatgaagacaggagcctggcccaacggcctgactgtggaccactttgagaagagaattgtgtggacagatgcccggagtgatgccatctacagcgccctgtatgatggcaccaacatgattgagatcatccggggccacgagtacctgagccacccctttgctgtgtccctgtatggcagcgaggtgtactggacagactggaggaccaacaccctgagcaaggccaacaagtggacaggccagaatgtgtctgtcatccagaagaccagcgcccagccctttgacctgcagatctaccaccccagccggcagccccaggcccccaacccctgtgccgccaatgatggcaagggcccctgcagccacatgtgcctgatcaaccacaacagatctgctgcctgtgcctgcccccacctgatgaagctgagcagtgacaagaagacctgctatgagatgaagaagttcctgctgtatgcccggcgctctgagatccggggcgtggacatcgacaacccctacttcaacttcatcacagccttcaccgtgcctgacattgatgatgtgacagtgattgactttgatgccagcgaggagcggctgtactggacagacatcaagacccagaccatcaagagggccttcatcaatggcaccggcctggagaccgtcatcagccgggacatccagagcatccggggcctggccgtggactgggtgtccaggaacctgtactggatcagcagcgagtttgatgagacccagatcaacgtggcccggctggatggcagcctgaagaccagcatcatccacggcatcgacaagccccagtgcctggccgcccaccctgtgcggggcaagctgtactggacagatggcaacaccatcaacatggccaacatggatggcagcaacagcaagatcctcttccagaaccagaaggagcctgtgggcctgagcattgattatgtggagaacaagctgtactggatcagcagtggaaatggcaccatcaaccgctgcaacctggatggcggcaacctggaggtgattgagagcatgaaggaggagctgaccaaggccacagccctgaccatcatggacaagaagctgtggtgggccgaccagaacctggcccagctgggcacctgcagcaagagagatggaagaaaccccaccatcctgaggaacaagaccagcggcgtggtgcacatgaaggtgtatgacaaggaggcccagcagggcagcaacagctgccagctgaacaacggcggctgcagccagctgtgcctgcccaccagcgagaccaccaggacctgcatgtgcaccgtgggctactacctgcagaagaacaggatgagctgccagggcatcgagagcttcctgatgtacagcgtgcatgagggcatccggggcatccccctggagcccagcgacaagatggatgccctgatgcccatcagcggcaccagctttgctgtgggcatcgacttccacgccgagaatgacaccatctactggacagacatgggcttcaacaagatcagccgggccaagagggaccagacctggaaggaggacatcatcaccaacggcctgggccgggtggagggcattgctgtggactggattgctggcaacatctactggacagaccacggcttcaacctgattgaggtggcccggctgaatggcagcttccgctacgtgatcatcagccagggcctggaccagcccaggagcattgctgtgcaccctgagaagggcctgctcttctggacagagtggggccagatgccctgcatcggcaaggcccggctggatggcagcgagaaggtggtgctggtgtccatgggcatcgcctggcccaacggcatcagcattgattatgaggagaacaagctgtactggtgtgatgccaggacagacaagattgaaagaattgacctggagactggaggcaaccgggagatggtgctgagcggcagcaatgtggacatgttttctgtggccgtgtttggagcctacatctactggagcgaccgggcccacgccaatggatctgtgagaagaggccacaagaatgatgccacagagaccatcaccatgaggacaggcctgggcgtgaacctgaaggaggtgaagatcttcaacagagtgcgggagaagggcaccaacgtgtgtgcccgggacaatggaggctgcaagcagctgtgcctgtaccggggcaacagcaggaggacctgtgcctgtgcccacggctacctggctgaagatggagtgacctgcctgcggcatgagggctacctgctgtacagcggccgcaccatcctgaagagcatccacctgagtgatgagaccaacctgaacagccccatccggccctatgagaacccccgctacttcaagaatgtgattgccctggcctttgactacaaccagaggaggaagggcaccaaccgcatcttctacagtgatgcccacttcggcaacatccagctgatcaaggacaactgggaggaccggcaggtgattgtggagaatgtgggctctgtggagggcctggcctaccaccgggcctgggacaccctgtactggaccagcagcaccaccagcagcatcaccaggcacacagtggaccagaccaggcctggggcctttgaccgggaggccgtcatcaccatgtctgaagatgaccacccccacgtgctggccctggatgagtgccagaacctgatgttctggaccaactggaatgagcagcaccccagcatcatgaggagcaccctgaccgggaagaatgcccaggtggtggtgtccacagacatcctgacccccaacggcctgaccatcgactacagagctgagaagctgtacttcagtgatggcagcctgggcaagattgagcgctgtgaatatgatggcagccagagacatgtgattgtgaagagcggccctggcaccttcctgagcctggccgtgtatgacaactacatcttctggagcgactggggcagaagagccatcctgcggagcaacaagtacacaggaggagacaccaagatcctgcggagtgacatcccccaccagcccatgggcatcatcgctgtggccaatgacaccaacagctgtgagctgagcccctgtgccctgctgaatggaggctgccacgacctgtgcctgctgacccccaacggccgggtgaactgcagctgccgcggggaccgcatcctgctggaggacaacagatgtgtgaccaagaacagcagctgcaatgcctacagcgagtttgaatgtggaaatggagagtgcatcgactaccagctgacctgtgatggcatcccccactgcaaggacaagagtgatgagaagctgctgtactgtgagaacagaagctgcagaagaggcttcaagccctgctacaacagacgctgcatcccccacggcaagctgtgtgatggagaaaatgactgtggggacaacagtgatgagctggactgcaaggtgtccacctgtgccaccgtggagttccgctgtgctgatggcacctgcatccccaggtctgcccgctgcaaccagaacatcgactgtgctgatgccagtgatgagaagaactgcaacaacacagactgcacccacttctacaagctgggcgtgaagaccaccggcttcatccgctgcaacagcaccagcctgtgtgtgctgcccacctggatctgtgatggcagcaatgactgtggggactacagtgatgagctgaagtgccctgtgcagaacaagcacaagtgtgaggagaactacttcagctgccccagcggccgctgcatcctgaacacctggatctgtgatggccagaaggactgtgaagatggaagagatgagttccactgtgacagcagctgctcctggaaccagtttgcctgcagcgcccagaagtgcatcagcaagcactggatctgtgatggagaagatgactgtggagatggcctggatgaaagtgacagcatctgtggggccatcacctgtgccgctgacatgttcagctgccagggcagccgggcctgtgtgcccaggcactggctgtgtgatggagagcgggactgcccagatggcagtgatgagctgagcacagctggctgtgcccccaacaacacctgtgatgaaaatgccttcatgtgccacaacaaggtgtgcatccccaagcagtttgtgtgtgaccatgatgatgactgtggagatggcagtgatgagagcccccagtgtggctaccggcagtgtggcacagaggagttcagctgtgctgatggccgctgcctgctgaacacccagtggcagtgtgatggagactttgactgcccagaccacagtgatgaggcccccctgaaccccaagtgcaagtctgctgagcagagctgcaacagcagcttcttcatgtgcaagaatggccgctgcatccccagcggcggcctgtgtgacaacaaggatgactgtggagatggcagtgatgaaagaaactgccacatcaatgaatgtctgagcaagaaggtgtctggctgcagccaggactgccaggacctgcctgtgtcctacaagtgcaagtgctggccaggcttccagctgaaggatgatggcaagacctgtgtggacattgatgaatgtagcagcggcttcccctgcagccagcagtgcatcaacacctacggcacctacaagtgcctgtgcacagatggctatgagatccagcctgacaaccccaacggctgcaagagcctgagtgatgaggagcccttcctgatcctggccgaccaccacgagatcaggaagatcagcacagatggcagcaactacaccctgctgaagcagggcctgaacaacgtcatcgccatcgactttgactaccgggaggagttcatctactggattgacagcagccggcccaacggcagccgcatcaacaggatgtgcctgaatggaagtgacatcaaggtggtgcacaacacagctgtgcccaatgccctggccgtggactggattggcaagaacctgtactggagcgacacagagaagaggatcatcgaggtgtccaagctgaatggcctgtaccccaccatcctggtgtccaagaggctgaagttcccccgggacctgagcctggacccccaggccggctacctgtactggattgactgctgtgagtacccccacatcggccgggtgggcatggatggcaccaaccagagcgtggtgattgagaccaagatcagccggcccatggccctgaccattgattatgtgaacagaaggctgtactgggcagatgagaaccacatcgagttcagcaacatggatggcagccaccgccacaaggtgcccaaccaggacatccctggggtcatcgccctgaccctgtttgaggactacatctactggacagatggcaagaccaagagcctgagccgggcccacaagaccagcggggctgaccggctgagcctcatctacagctggcacgccatcacagacatccaggtgtaccacagctaccggcagccagatgtgtccaagcacctgtgcatgatcaacaatggaggctgcagccacctgtgcctgctggcccctgggaagacccacacctgtgcctgccccaccaacttctacctggccgctgacaacagaacctgcctgagcaactgcacagccagccagttccgctgcaagacagacaagtgcatccccttctggtggaagtgtgacacagtggatgactgtggagatggcagtgatgagccagatgactgcccagagttccgctgccagcccggccgcttccagtgtggcaccggcctgtgtgccctgcctgccttcatctgtgatggagaaaatgactgtggggacaacagtgatgagctgaactgtgacacccacgtgtgcctgagcggccagttcaagtgcaccaagaaccagaagtgcatccctgtgaacctgcgctgcaatggccaggatgactgtggagatgaggaggatgagcgggactgcccagagaacagctgcagcccagactacttccagtgcaagaccaccaagcactgcatcagcaagctgtgggtgtgtgatgaggaccctgactgtgctgatgccagtgatgaggccaactgtgacaagaagacctgtggcccccatgagttccagtgcaagaacaacaactgcatcccagaccactggaggtgtgacagccagaatgactgcagcgacaacagtgatgaggagaactgcaagccccagacctgcaccctgaaggacttcctgtgtgccaacggggactgtgtgagcagccgcttctggtgtgatggagactttgactgtgctgatggcagtgatgaaagaaactgtgagaccagctgcagcaaggaccagttccgctgcagcaatggccagtgcatcccagccaagtggaagtgtgatggccacgaggactgcaagtacggggaggatgagaagagctgtgagcccgccagccccacctgcagcagccgggagtacatctgtgccagtgatggctgcatcagcgccagcctgaagtgcaatggagaatatgactgtgctgatggcagtgatgagatggactgtgtgacagagtgcaaggaggaccagttccgctgcaagaacaaggcccactgcatccccatccgctggctgtgtgatggcatccatgactgtgtggatggcagtgatgaggagaactgtgagcggggcggcaacatctgcagagcagatgagttcctgtgcaacaacagcctgtgcaagctgcacttctgggtgtgtgatggagaagatgactgtggggacaacagtgatgaggccccagacatgtgtgtgaagttcctgtgccccagcacccggccccaccgctgcaggaacaaccgcatctgcctgcagagcgagcagatgtgcaatggaattgatgaatgtggggacaacagtgatgaggaccactgcggcggcaagctgacctacaaggcccggccctgcaagaaggatgaatttgcctgcagcaacaagaagtgcatccccatggacctgcagtgtgaccggctggatgactgtggagatggcagtgatgagcagggctgccgcatcgcccccacagagtacacctgtgaggacaacgtgaacccctgtggagatgatgcctactgcaaccagatcaagaccagcgtcttctgccgctgcaagccaggcttccagaggaacatgaagaaccggcagtgtgaggacctgaatgaatgtctggtgtttggcacctgcagccaccagtgcatcaacgtggagggcagctacaagtgtgtgtgtgaccagaacttccaggagaggaacaacacctgcatcgccgagggcagcgaggaccaggtgctgtacatcgccaatgacacagacatcctgggcttcatctaccccttcaactacagcggggaccaccagcagatcagccacatcgagcacaacagccgcatcaccggcatggatgtgtactaccagagggacatgatcatctggagcacccagttcaaccctgggggcatcttctacaagaggatccacggccgggagaagaggcaggccaacagcggcctcatctgcccagagttcaagaggccccgggacattgctgtggactgggtggccggcaacatctactggacagaccacagcaggatgcactggttctcctactacaccacccactggaccagcctgcgctacagcatcaacgtgggccagctgaatggccccaactgcacccggctgctgaccaacatggccggggagccctatgccatcgctgtgaaccccaagaggggcatgatgtactggacagtggtgggggaccacagccacatcgaggaggccgccatggatggcaccctgcggcgcatcctggtgcagaagaacctgcagaggcccaccggcctggccgtggactacttcagcgagcgcatctactgggccgactttgagctgagcatcatcggctctgtgctgtatgatggcagcaacagcgtggtgtctgtgagcagcaagcagggcctgctgcacccccacagaattgacatctttgaggactacatctatggagctggccccaagaatggagtcttccgggtgcagaagtttggacatggctctgtggagtacctggccctgaacatcgacaagaccaagggcgtgctgatcagccaccgctacaagcagctggacctgcccaacccctgcctggacctggcctgtgagttcctgtgcctgctgaaccccagcggggccacctgtgtgtgcccagagggcaagtacctgatcaatggcacctgcaatgatgacagcctgctggatgacagctgcaagctgacctgtgaaaatggaggccgctgcatcctgaatgagaagggggacctgcgctgccactgctggcccagctacagcggggagcgctgtgaggtgaaccactgcagcaactactgccagaatggaggcacctgtgtgcccagcgtgctgggccggcccacctgcagctgtgccctgggcttcaccggccccaactgtgggaagacagtgtgtgaggacttctgccagaatggaggcacctgcatcgtgacagctggcaaccagccctactgccactgccagcctgagtacaccggggaccgctgccagtactacgtgtgccaccactactgtgtgaacagcgagagctgcaccatcggagatgatggctctgtggagtgtgtgtgccccaccaggtatgagggccccaagtgtgaggtggacaagtgtgtgcgctgccacggcggccactgcatcatcaacaaggacagcgaggacatcttctgcaactgcaccaacgggaagatcgccagcagctgccagctgtgtgatggctactgctacaacggcggcacctgccagctggaccctgagaccaacgtgcctgtgtgcctgtgcagcaccaactggagcggcacccagtgtgagaggcctgcccccaagagcagcaagagtgaccacatcagcaccaggagcatcgccatcatcgtgcccctggtgctgctggtgaccctcatcaccaccctggtgattggcctggtgctgtgcaagaggaagaggaggaccaagaccatccggcggcagcccatcatcaatggaggcatcaacgtggagatcggcaaccccagctacaacatgtatgaggtggaccatgaccacaatgatggcggcctgctggaccccggcttcatgattgaccccaccaaggcccgctacatcggcggcggccccagcgccttcaagctgccccacacagccccacccatctacctgaacagcgacctgaagggccccctgacagctggccccaccaactacagcaaccctgtgtatgccaagctgtacatggatggccagaactgcaggaacagcctgggctctgtggatgagaggaaggagctgctgcccaagaagattgagatcggcatccgggagaccgtggcctag

SEQ ID NO: 20312 - DNA, 843 bp, Artificial Sequence
  Description of Artificial Sequence: Synthetic coding sequence
atgtgccccccccaggcccaggccgaggtgggccccaccatgacagagaaggccgagatggtgtgtgcccccagccctgccccagcccccccacccaagccagccagccctggccccccccaggtggaggaggtgggccacagaggaggcagcagccccccccggctgcccccaggagtgcctgtgatcagcctgggccacagccggcccccaggagtggccatgcccaccacagagctgggcaccctgcggccccccctgctgcagctgagcaccctgggcacagccccacccaccctggccctgcactaccacccccaccccttcctgaacagcgtgtacatcggccctgctggccccttcagcatcttccccagcagccggctgaagagaagacccagccactgtgagctggacctggccgagggccaccagccccagaaggtggcccggcgggtcttcaccaacagccgggagcgctggaggcagcagaatgtgaatggagcctttgctgagctgaggaagctgctgcccacccaccccccagacaggaagctgagcaagaatgaggtgctgcggctggccatgaagtacatcggcttcctggtgcggctgctgcgggaccaggccgccgccctggccgccggccccaccccacctggccccaggaagaggcctgtgcaccgggtgcctgatgatggagcccggcggggcagcggcagaagagctgaggccgccgcccggagccagcctgcccctcctgctgaccctgatggcagccctggaggagctgcccggcccatcaagatggagcagacagccctgagccctgaggtgaggtag

SEQ ID NO: 20313 - DNA, 1620 bp, Artificial Sequence
  Description of Artificial Sequence: Synthetic coding sequence
atgggctgcggctgcagcagccacccagaagatgactggatggagaacattgatgtgtgtgagaactgccactaccccatcgtgcccctggatggcaagggcaccctgctgatcagaaatggcagcgaggtgcgggaccccctggtgacctatgagggcagcaaccccccagccagccccctgcaggacaacctggtgattgccctgcacagctatgagcccagccatgatggagacctgggctttgagaagggggagcagctgcgcatcctggagcagagcggggagtggtggaaggcccagagcctgaccaccggccaggagggcttcatccccttcaactttgtggccaaggccaacagcctggagcctgagccctggttcttcaagaacctgagcaggaaggatgctgagcggcagctgctggcccctggcaacacccacggcagcttcctgatccgggagagcgagagcacagctggcagcttcagcctgtctgtgcgggactttgaccagaaccagggcgaggtggtgaagcactacaagatccggaacctggacaatggaggcttctacatcagcccccgcatcaccttccctggcctgcacgagctggtgcgccactacaccaatgccagtgatggcctgtgcacccggctgagccggccctgccagacccagaagccccagaagccctggtgggaggatgagtgggaggtgccccgggagaccctgaagctggtggagcggctgggcgccggccagtttggagaggtgtggatgggctactacaacggccacaccaaggtggccgtgaagagcctgaagcagggctccatgagcccagatgccttcctggccgaggccaacctgatgaagcagctgcagcaccagaggctggtgcggctgtatgctgtggtgacccaggagcccatctacatcatcacagagtacatggagaatgacaccctgctggacagccagctggaggagaagggcctgggcgccagcccctggggcaacctgggccagcagctgctgctgctgcccaccggcagcctggtggacttcctgaagacccccagcggcatcaagctgaccatcaacaagctgctggacatggccgcccagattgctgagggcatggccttcatcgaggagaggaactacatccaccgggacctgcgggccgccaacatcctggtgtctgacaccctgagctgcaagattgctgactttggcctggcccggctgattgaggacaatgagtacacagcccgggagggcgccaagttccccatcaagtggacagcccctgaggccatcaactacggcaccttcaccatcaagagtgatgtgtggagctttggcatcctgctgacagaaattgtgacccacggccgcatcccctacccaggcatgaccaaccctgaggtgatccagaacctggagcggggctacaggatggtgcggccagacaactgcccagaggagctgtaccagctgatgaggctgtgctggaaggagaggcctgaggaccggcccacctttgactacctgcggtctgtgctggaggacttcttcaccgccacagagggccagtaccagccccagccctag

SEQ ID NO: 20314 - DNA, 1530 bp, Artificial Sequence
  Description of Artificial Sequence: Synthetic coding sequence
atgggctgcggctgcagcagccacccagaagatgactggatggagaacattgatgtgtgtgagaactgccactaccccatcgtgcccctggatggcaagggcaccctgctgatcagaaatggcagcgaggtgcgggaccccctggtgacctatgagggcagcaaccccccagccagccccctgcaggacaacctggtgattgccctgcacagctatgagcccagccatgatggagacctgggctttgagaagggggagcagctgcgcatcctggagcagagcggggagtggtggaaggcccagagcctgaccaccggccaggagggcttcatccccttcaactttgtggccaaggccaacagcctggagcctgagccctggttcttcaagaacctgagcaggaaggatgctgagcggcagctgctggcccctggcaacacccacggcagcttcctgatccgggagagcgagagcacagctggcagcttcagcctgtctgtgcgggactttgaccagaaccagggcgaggtggtgaagcactacaagatccggaacctggacaatggaggcttctacatcagcccccgcatcaccttccctggcctgcacgagctggtgcgccactacaccaatgccagtgatggcctgtgcacccggctgagccggccctgccagacccagaagccccagaagccctggtgggaggatgagtgggaggtgccccgggagaccctgaagctggtggagcggctgggcgccggccagtttggagaggtgtggatgggctactacaacggccacaccaaggtggccgtgaagagcctgaagcagggctccatgagcccagatgccttcctggccgaggccaacctgatgaagcagctgcagcaccagaggctggtgcggctgtatgctgtggtgacccaggagcccatctacatcatcacagagtacatggagaatggcagcctggtggacttcctgaagacccccagcggcatcaagctgaccatcaacaagctgctggacatggccgcccagattgctgagggcatggccttcatcgaggagaggaactacatccaccgggacctgcgggccgccaacatcctggtgtctgacaccctgagctgcaagattgctgactttggcctggcccggctgattgaggacaatgagtacacagcccgggagggcgccaagttccccatcaagtggacagcccctgaggccatcaactacggcaccttcaccatcaagagtgatgtgtggagctttggcatcctgctgacagaaattgtgacccacggccgcatcccctacccaggcatgaccaaccctgaggtgatccagaacctggagcggggctacaggatggtgcggccagacaactgcccagaggagctgtaccagctgatgaggctgtgctggaaggagaggcctgaggaccggcccacctttgactacctgcggtctgtgctggaggacttcttcaccgccacagagggccagtaccagccccagccctag

SEQ ID NO: 20315 - DNA, 1551 bp, Artificial Sequence
  Description of Artificial Sequence: Synthetic coding sequence
atgggctgcggctgcagcagccacccagaagatgactggatggagaacattgatgtgtgtgagaactgccactaccccatcgtgcccctggatggcaagggcaccctgctgatcagaaatggcagcgaggtgcgggaccccctggtgacctatgagggcagcaaccccccagccagccccctgcagggcgacccccggcagcagggcctgaaggacaaggcctgtggcagcctggccgtgggcttccacctgagccccacctacttcctgcccggcctggccttcctggtgccccaccctgtgaccccaggcttcctgcccatcccagcccgcttcagcctgatgcccctggtgttcacagacaacctggtgattgccctgcacagctatgagcccagccatgatggagacctgggctttgagaagggggagcagctgcgcatcctggagcagagcggggagtggtggaaggcccagagcctgaccaccggccaggagggcttcatccccttcaactttgtggccaaggccaacagcctggagcctgagccctggttcttcaagaacctgagcaggaaggatgctgagcggcagctgctggcccctggcaacacccacggcagcttcctgatccgggagagcgagagcacagctggcagcttcagcctgtctgtgcgggactttgaccagaaccagggcgaggtggtgaagcactacaagatccggaacctggacaatggaggcttctacatcagcccccgcatcaccttccctggcctgcacgagctggtgcgccactacacccgctactacaacggccacaccaaggtggccgtgaagagcctgaagcagggctccatgagcccagatgccttcctggccgaggccaacctgatgaagcagctgcagcaccagaggctggtgcggctgtatgctgtggtgacccaggagcccatctacatcatcacagagtacatggagaatggcagcctggtggacttcctgaagaccccatctggcatcaagctgaccatcaacaagctgctggacatggccgcccagattgctgagggcatggccttcatcgaggagaggaactacatccaccgggacctgcgggccgccaacatcctggtgtctgacaccctgagctgcaagattgctgactttggcctggcccggctgattgaagataatgagtacacagcccgggagggcgccaagttccccatcaagtggacagcccctgaggccatcaactacggcaccttcaccatcaagagtgatgtgtggagctttggcatcctgctgacagagatcgtgacccacggccgcatcccctacccaggcatgaccaaccctgaggtgatccagaacctggagcggggctacaggatggtgcggccagacaactgcccagaggagctgtaccagctgatgaggctgtgctggaaggagaggccagaagatcggcccacctttgactacctgcggtctgtgctggaggacttcttcaccgccacagagggccagtaccagccccagccctag

SEQ ID NO: 20316 - DNA, 750 bp, Artificial Sequence
  Description of Artificial Sequence: Synthetic coding sequence
atgggctactacaacggccacaccaaggtggccgtgaagagcctgaagcagggctccatgagcccagatgccttcctggccgaggccaacctgatgaagcagctgcagcaccagaggctggtgcggctgtatgctgtggtgacccaggagcccatctacatcatcacagagtacatggagaatggcagcctggtggacttcctgaagacccccagcggcatcaagctgaccatcaacaagctgctggacatggccgcccagattgctgagggcatggccttcatcgaggagaggaactacatccaccgggacctgcgggccgccaacatcctggtgtctgacaccctgagctgcaagattgctgactttggcctggcccggctgattgaggacaatgagtacacagcccgggagggcgccaagttccccatcaagtggacagcccctgaggccatcaactacggcaccttcaccatcaagagtgatgtgtggagctttggcatcctgctgacagaaattgtgacccacggccgcatcccctacccaggcatgaccaaccctgaggtgatccagaacctggagcggggctacaggatggtgcggccagacaactgcccagaggagctgtaccagctgatgaggctgtgctggaaggagaggcctgaggaccggcccacctttgactacctgcggtctgtgctggaggacttcttcaccgccacagagggccagtaccagccccagccctag

SEQ ID NO: 20317 - DNA, 1611 bp, Artificial Sequence
  Description of Artificial Sequence: Synthetic coding sequence
atgggcatccctggcagccacaacctgcgctacttctggaacttccctggccagggccccatcatcagtgatgtgggcggcgctgacctgggcggggcccccagcgcccccagcagcatccccagcggcaccatgggctgcggctgcagcagccacccagaagatgactggatggagaacattgatgtgtgtgagaactgccactaccccatcgtgcccctggatggcaagggcaccctgctgatcagaaatggcagcgaggtgcgggaccccctggtgacctatgagggcagcaaccccccagccagccccctgcaggacaacctggtgattgccctgcacagctatgagcccagccatgatggagacctgggctttgagaagggggagcagctgcgcatcctggagcagagcggggagtggtggaaggcccagagcctgaccaccggccaggagggcttcatccccttcaactttgtggccaaggccaacagcctggagcctgagccctggttcttcaagaacctgagcaggaaggatgctgagcggcagctgctggcccctggcaacacccacggcagcttcctgatccgggagagcgagagcacagctggcagcttcagcctgtctgtgcgggactttgaccagaaccagggcgaggtggtgaagcactacaagatccggaacctggacaatggaggcttctacatcagcccccgcatcaccttccctggcctgcacgagctggtgcgccactacaccaatgccagtgatggcctgtgcacccggctgagccggccctgccagacccagaagccccagaagccctggtgggaggatgagtgggaggtgccccgggagaccctgaagctggtggagcggctgggcgccggccagtttggagaggtgtggatgggctactacaacggccacaccaaggtggccgtgaagagcctgaagcagggctccatgagcccagatgccttcctggccgaggccaacctgatgaagcagctgcagcaccagaggctggtgcggctgtatgctgtggtgacccaggagcccatctacatcatcacagagtacatggagaatggcagcctggtggacttcctgaagacccccagcggcatcaagctgaccatcaacaagctgctggacatggccgcccagattgctgagggcatggccttcatcgaggagaggaactacatccaccgggacctgcgggccgccaacatcctggtgtctgacaccctgagctgcaagattgctgactttggcctggcccggctgattgaggacaatgagtacacagcccgggagggcgccaagttccccatcaagtggacagcccctgaggccatcaactacggcaccttcacccacggccgcatcccctacccaggcatgaccaaccctgaggtgatccagaacctggagcggggctacaggatggtgcggccagacaactgcccagaggagctgtaccagctgatgaggctgtgctggaaggagaggccagaagatcggcccacctttgactacctgcggtctgtgctggaggacttcttcaccgccacagagggccagtaccagccccagccctag

SEQ ID NO: 20318 - DNA, 1200 bp, Artificial Sequence
  Description of Artificial Sequence: Synthetic coding sequence
atgccccagctgagcggcggcggcggcggcggcggcggggaccctgagctgtgtgccacagatgagatgatccccttcaaggatgaaggagacccccagaaggagaagatctttgctgagatcagccaccctgaggaggagggggacctggccgacatcaagagcagcctggtgaatgaaagtgagatcatcccagccagcaatggccacgaggtggcccggcaggcccagaccagccaggagccctaccatgacaaggcccgggagcacccagatgatggcaagcacccagatggcggcctgtacaacaagggccccagctacagcagctacagcggctacatcatgatgcccaacatgaacaatgacccctacatgagcaatggcagcctgagcccccccatccccaggaccagcaacaaggtgcctgtggtgcagcccagccatgctgtgcaccccctgacccccctcatcacctacagtgatgagcacttcagccctggcagccaccccagccacatccccagtgatgtgaacagcaagcagggcatgagccgccaccccccagccccagacatccccaccttctaccccctgagccctggaggagtgggccagatcaccccacccctgggctggcagggccagcctgtgtaccccatcaccggcggcttccggcagccctaccccagcagcctgtctgtggacacctccatgagccgcttcagccaccacatgatccctggccccccaggcccccacaccaccggcatcccccacccagccatcgtgaccccccaggtgaagcaggagcacccccacacagacagcgacctgatgcacgtgaagccccagcacgagcagaggaaggagcaggagcccaagaggccccacatcaagaagcccctgaatgccttcatgctgtacatgaaggagatgagggccaacgtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagcgggagaagctgcaggagagcgccagcggcaccggccccaggatgacagctgcctacatctag

SEQ ID NO: 20319 - DNA, 1161 bp, Artificial Sequence
  Description of Artificial Sequence: Synthetic coding sequence
atgccccagctgagcggcggcggcggcggcggcggcggggaccctgagctgtgtgccacagatgagatgatccccttcaaggatgaaggagacccccagaaggagaagatctttgctgagatcagccaccctgaggaggagggggacctggccgacatcaagagcagcctggtgaatgaaagtgagatcatcccagccagcaatggccacgaggtggcccggcaggcccagaccagccaggagccctaccatgacaaggcccgggagcacccagatgatggcaagcacccagatggcggcctgtacaacaagggccccagctacagcagctacagcggctacatcatgatgcccaacatgaacaatgacccctacatgagcaatggcagcctgagcccccccatccccaggaccagcaacaaggtgcctgtggtgcagcccagccatgctgtgcaccccctgacccccctcatcacctacagtgatgagcacttcagccctggcagccaccccagccacatccccagtgatgtgaacagcaagcagggcatgagccgccaccccccagccccagacatccccaccttctaccccctgagccctggaggagtgggccagatcaccccacccctgggctggttcagccaccacatgatccctggccccccaggcccccacaccaccggcatcccccacccagccatcgtgaccccccaggtgaagcaggagcacccccacacagacagcgacctgatgcacgtgaagccccagcacgagcagaggaaggagcaggagcccaagaggccccacatcaagaagcccctgaatgccttcatgctgtacatgaaggagatgagggccaacgtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagcgggagaagctgcaggagagcgccagcggcggcaagaggagcagcttccccacctgcaaggccaaggccgccaccccaggccccctgctggagatggaggcctgctag

SEQ ID NO: 20320 - DNA, 1116 bp, Artificial Sequence
  Description of Artificial Sequence: Synthetic coding sequence
atgccccagctgagcggcggcggcggcggcggcggcggggaccctgagctgtgtgccacagatgagatgatccccttcaaggatgaaggagacccccagaaggagaagatctttgctgagatcagccaccctgaggaggagggggacctggccgacatcaagagcagcctggtgaatgaaagtgagatcatcccagccagcaatggccacgaggtggcccggcaggcccagaccagccaggagccctaccatgacaaggcccgggagcacccagatgatggcaagcacccagatggcggcctgtacaacaagggccccagctacagcagctacagcggctacatcatgatgcccaacatgaacaatgacccctacatgagcaatggcagcctgagcccccccatccccaggaccagcaacaaggtgcctgtggtgcagcccagccatgctgtgcaccccctgacccccctcatcacctacagtgatgagcacttcagccctggcagccaccccagccacatccccagtgatgtgaacagcaagcagggcatgagccgccaccccccagccccagacatccccaccttctaccccctgagccctggaggagtgggccagatcaccccacccctgggctggttcagccaccacatgatccctggccccccaggcccccacaccaccggcatcccccacccagccatcgtgaccccccaggtgaagcaggagcacccccacacagacagcgacctgatgcacgtgaagccccagcacgagcagaggaaggagcaggagcccaagaggccccacatcaagaagcccctgaatgccttcatgctgtacatgaaggagatgagggccaacgtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagcgggagaagctgcaggagagcgccagcggcaccggccccaggatgacagctgcctacatctag

SEQ ID NO: 20321 - DNA, 912 bp, Artificial Sequence
  Description of Artificial Sequence: Synthetic coding sequence
atggccgaggtggcccggcaggcccagaccagccaggagccctaccatgacaaggcccgggagcacccagatgatggcaagcacccagatggcggcctgtacaacaagggccccagctacagcagctacagcggctacatcatgatgcccaacatgaacaatgacccctacatgagcaatggcagcctgagcccccccatccccaggaccagcaacaaggtgcctgtggtgcagcccagccatgctgtgcaccccctgacccccctcatcacctacagtgatgagcacttcagccctggcagccaccccagccacatccccagtgatgtgaacagcaagcagggcatgagccgccaccccccagccccagacatccccaccttctaccccctgagccctggaggagtgggccagatcaccccacccctgggctggttcagccaccacatgatccctggccccccaggcccccacaccaccggcatcccccacccagccatcgtgaccccccaggtgaagcaggagcacccccacacagacagcgacctgatgcacgtgaagccccagcacgagcagaggaaggagcaggagcccaagaggccccacatcaagaagcccctgaatgccttcatgctgtacatgaaggagatgagggccaacgtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagcgggagaagctgcaggagagcgccagcggcaccggccccaggatgacagctgcctacatctag

SEQ ID NO: 20322 - DNA, 1500 bp, Artificial Sequence
  Description of Artificial Sequence: Synthetic coding sequence
atgaatgatgaccccagcatggaggagaatggagtggagcgggtgtgcccagagagcctgctgcagagccgggagtacagcagcctgcccctgcccaggcacaccagcagcacagatggcaccatcaccagcagtgaccccggcctggagatcctgaacatggccagctgtgacctggacaggaacagcctgtgcaagaaggaggaggacaccaggtctgccagccccaccatcgaggcccagggcaccagccctgcccatgacaacatcgccttccaggacagcaccagcaaggacaagaccatcctgaacctggaggccaaggaggagcctgagaccatcgaggagcacaagaaggagcacgccagcggggacagcgtggtgagccccctgcctgtgaccaccgtgaagtctgtgaacctgcggcagagcgagaacaccagcgccaatgagaaggaggtggaggccgagttcctgcggctgagcctgggcttcaagtgtgactggttcaccctggagaagagggtgaagctggaggagaggagccgggacctggccgaggagaacctgaagaaggagatcaccaactgcctgaagctgctggagagcctgacccccctgtgtgaagatgacaaccaggcccaggagatcatcaagaagctggagaagagcatcaagttcctgagccagtgtgccgcccgggtggccagcagagctgagatgctgggcgccatcaaccaggagagccgggtgtccaaggctgtggaggtgatgatccagcacgtggagaacctgaagaggatgtatgccaaggagcacgccgagctggaggagctgaagcaggtgctgctgcagaatgaaagaagcttcaaccccctggaggatgatgatgactgccagatcaagaagaggtctgccagcctgaacagcaagcccagcagcctgcggcgggtgaccatcgccagcctgcccagaaatattggaaatgccggcatggtggccggcatggagaacaatgaccgcttcagccgccgcagcagctcctggaggatcctgggcagcaagcagagcgagcaccggcccagcctgccccgcttcatcagcacctacagctgggcagatgctgaggaggagaagtgtgagctgaagaccaaggatgacagcgagcccagcggggaggagaccgtggagaggaccaggaagcccagcctgtctgagaagaagaacaaccccagcaagtgggatgtgtcctctgtgtatgacaccatcgcctcctgggccaccaacctgaagagcagcatcaggaaggccaacaaggccctgtggctgagcatcgccttcatcgtgctgtttgctgccctgatgtccttcctgaccggccagctgttccagaagtctgtggatgctgcccccacccagcaggaggacagctggaccagcctggagcacatcctgtggcccttcacccggctgcggcacaacggccccccacctgtgtag

SEQ ID NO: 20323 - DNA, 1500 bp, Artificial Sequence; identical to SEQ ID NO: 20322
  Description of Artificial Sequence: Synthetic coding sequence

SEQ ID NO: 20324 - DNA, 1500 bp, Artificial Sequence; identical to SEQ ID NO: 20322
  Description of Artificial Sequence: Synthetic coding sequence

SEQ ID NO: 20325 - DNA, 234 bp, Artificial Sequence
  Description of Artificial Sequence: Synthetic coding sequence
atgaatgatgaccccagcatggaggagaatggagtggagcgggtgtgcccagagagcctgctgcagagccgggagtacagcagcctgcccctgcccaggcacaccagcagcacagatggcaccatcaccagcagtgaccccggcctggagatcctgaacatggccagctgtgacctggacaggaacagcctgtgcaagaaggaggaggacaccaggtctgccagccccacctag

SEQ ID NO: 20326 - DNA, 27 bp, Artificial Sequence
  Description of Artificial Sequence: Synthetic coding sequence
atgaatgatgaccccagcatggagtag

SEQ ID NO: 20327 - DNA, 618 bp, Artificial Sequence
  Description of Artificial Sequence: Synthetic coding sequence
atgaccccacctgagcggctcttcctgccccgggtgcggggcaccaccctgcacctgctgctgctgggcctgctgctggtgctgctgcccggggcccagggcctgcccggggtgggcctgaccccatctgctgcccagacagcccggcagcaccccaagatgcacctggcccacagcaccctgaagccagctgcccacctgattggagaccccagcaagcagaacagcctgctgtggagggccaacacagaccgggccttcctgcaggacggcttcagcctgagcaacaacagcctgctggtgcccaccagcggcatctactttgtgtacagccaggtggtgttcagcggcaaggcctacagccccaaggccaccagcagccccctgtacctggcccacgaggtgcagctgttcagcagccagtaccccttccacgtgcccctgctgagcagccagaagatggtgtacccaggcctgcaggagccctggctgcacagcatgtaccatggagctgccttccagctgacccagggcgaccagctgagcacccacacagatggcatcccccacctggtgctgagccccagcacagtgttcttcggggcctttgccctgtag

SEQ ID NO: 20328 - DNA, 618 bp, Artificial Sequence; identical to SEQ ID NO: 20327
  Description of Artificial Sequence: Synthetic coding sequence

SEQ ID NO: 20329 - DNA, 417 bp, Artificial Sequence
  Description of Artificial Sequence: Synthetic coding sequence
atgaccccacctgagcggctcttcctgccccgggtgcggggcaccaccctgcacctgctgctgctgggcctgctgctggtgctgctgcccggggcccagggcctgcccggggtgggcctgaccccatctgctgcccagacagcccggcagcaccccaagatgcacctggcccacagcaccctgaagccagctgcccacctgattggagaccccagcaagcagaacagcctgctgtggagggccaacacagaccgggccttcctgcaggacggcttcagcctgagcaacaacagcctgctggtgcccaccagcggcatctactttgtgtacagccagggcagcagcccccccctgctgtggcccttccagcagctgaagagcagcctcatcaagagccctgagctgagcaagaagtag

SEQ ID NO: 20330 - DNA, 2010 bp, Artificial Sequence
  Description of Artificial Sequence: Synthetic coding sequence
atggagggcaacaagctggaggagcaggacagcagccccccccagagcaccccaggcctgatgaagggcaacaagcgggaggagcagggcctgggccctgagcctgctgccccccagcagcccacagctgaggaggaggccctgattgagttccacaggagctaccgggagctgtttgagttcttctgcaacaacaccaccatccatggagccatccggctggtgtgcagccagcacaacaggatgaagacagccttctgggccgtgctgtggctgtgcaccttcggcatgatgtactggcagtttggcctgctgtttggagagtacttctcctaccctgtgtccctgaacatcaacctgaacagcgacaagctggtgtttcctgctgtgaccatctgcaccctgaacccctaccgctacccagagatcaaggaggagctggaggagctggaccgcatcacagagcagaccctgtttgacctgtacaagtacagcagcttcaccaccctggtggccggcagccgcagcagaagagacctgcggggcaccctgccccaccccctgcagaggctgcgggtgcccccaccaccccacggggcccggcgggcccggtctgtggccagcagcctgcgggacaacaacccccaggtggactggaaggactggaagattggcttccagctgtgcaaccagaacaagagtgactgcttctaccagacctacagcagtggagtggatgctgtgcgggagtggtaccgcttccactacatcaacatcctgagccggctgcctgagaccctgcccagcctggaggaggacaccctgggcaacttcatctttgcctgccgcttcaaccaggtgtcctgcaaccaggccaactacagccacttccaccaccccatgtatggcaactgctacaccttcaatgacaagaacaacagcaacctgtggatgagctccatgcctggcatcaacaacggcctgagcctgatgctgcgggcagagcagaatgacttcatccccctgctgagcacagtgactggagcccgggtgatggtgcacggccaggatgagcccgccttcatggatgatggcggcttcaacctgcggcctggggtggagaccagcatctccatgaggaaggagaccctggaccggctgggcggggactatggagactgcaccaagaatggaagtgatgtgcctgtggagaacctgtaccccagcaagtacacccagcaggtgtgcatccacagctgcttccaggagagcatgatcaaggaatgtggctgtgcctacatcttctacccccggccccagaatgtggagtactgtgactacaggaagcacagctcctggggctactgctactacaagctgcaggtggacttcagcagtgaccacctgggctgcttcaccaagtgcaggaagccctgcagcgtgaccagctaccagctgtctgctggctacagccgctggcccagcgtgaccagccaggagtgggtgttccagatgctgagccggcagaacaactacacagtgaacaacaagagaaatggagtggccaaggtgaacatcttcttcaaggagctgaactacaagaccaacagcgagagccccagcgtgaccatggtgaccctgctgagcaacctgggcagccagtggagcctgtggtttggcagctctgtgctgtctgtggtggagatggccgagctggtgtttgacctgctggtgatcatgttcctgatgctgctgcggcgcttccgcagccgctactggagccctggccggggcggccgcggggcccaggaggtggccagcaccctggccagcagcccccccagccacttctgcccccaccccatgagcctgagcctgagccagcccggccctgcccccagccctgccctgacagcccctcctccagcctatgccaccctgggcccccggcccagccctgggggcagcgctggggccagcagcagcacctgccccctgggcggcccctag

SEQ ID NO: 20331 - DNA, 987 bp, Artificial Sequence
  Description of Artificial Sequence: Synthetic coding sequence
atgggcctggaggagatcgccccctgcaccagcaagaggaagacccagtgccgctgccagcccggcatgttctgtgccgcctgggccctggagtgcacccactgtgagctgctgagtgactgccccccaggcacagaagctgagctgaaggatgaggtgggcaaaggaaacaaccactgtgtgccctgcaaggccggccacttccagaacaccagcagccccagcgcccgctgccagccccacacccgctgtgagaaccagggcctggtggaggccgcccctggaacagcccagagcgacaccacctgcaagaaccccctggagcccctgcccccagagatgagcggcaccatgctgatgctggccgtgctgctgcccctggccttcttcctgctgctggccaccgtcttcagctgcatctggaagagccaccccagcctgtgcaggaagctgggcagcctgctgaagagaagaccccagggcgagggccccaaccctgtggccggctcctgggagccccccaaggcccacccctacttcccagacctggtgcagcccctgctgcccatctctggagatgtgtcccctgtgtccacaggcctgcctgctgcccctgtgctggaggccggcgtgccccagcagcagagccccctggacctgacccgggagccccagctggagcccggggagcagagccaggtggcccacggcaccaacggcatccacgtgactggaggctccatgaccatcactggaaacatctacatctacaacggccctgtgctgggcggccccccaggccctggggacctgcctgccaccccagagcccccctaccccatccctgaggagggggaccccggccccccaggcctgagcaccccccaccaggaggatggcaaggcctggcacctggccgagacagagcactgtggggccacccccagcaacagaggccccaggaaccagttcatcacccatgactag

SEQ ID NO: 20332 - DNA, 1725 bp, Artificial Sequence
  Description of Artificial Sequence: Synthetic coding sequence
atggccctggcccggggcagccggcagctgggcgccctggtgtggggcgcctgcctgtgtgtgctggtgcacggccagcaggcccagcccggccagggcagtgaccctgcccgctggaggcagctgatccagtgggagaacaacggccaggtgtacagcctgctgaacagcggctctgaatatgtgcctgctggcccccagaggtctgagagcagcagccgggtgctgctggccggggccccccaggcccagcagaggaggagccacggcagcccccggcggcggcaggcccccagcctgcccctgcccggccgggtgggcagtgacacagtgcggggccaggcccggcacccctttggatttggccaggtgcctgacaactggagggaggtggccgtgggggacagcacaggcatggcccgggcccggacctctgtgtcccagcagagacatggaggcagcgccagctctgtgtctgccagcgcctttgccagcacctaccggcagcagcccagctacccccagcagttcccctacccccaggccccctttgtgtcccagtatgaaaattatgaccctgccagcaggacctatgaccagggctttgtgtactacagacctgctgggggcggcgtgggcgctggagctgctgctgtggccagcgctggggtcatctacccctaccagccccgggcccgctatgaggagtatggaggaggagaggagctgcctgagtacccaccccagggcttctacccagcccctgagcggccctacgtgcccccacctcctcctcctccagatggcctggaccggcgctacagccacagcctgtacagcgagggcaccccaggctttgagcaggcctacccagaccccggccctgaggccgcccaggcccatggaggagacccccggctgggctggtacccaccctatgccaaccccccacctgaggcctacggccccccccgggccctggagcccccctacctgcctgtgcgcagcagtgacaccccacctcctggaggagagagaaatggagcccagcagggccgcctgtctgtgggctctgtgtaccggcccaaccagaatggccggggcctgcctgacctggtgcctgaccccaactacgtgcaggccagcacctacgtgcagagggcccacctgtacagcctgcgctgtgccgctgaggagaagtgcctggccagcacagcctatgcccctgaggccacagattatgatgtgcgggtgctgctgcgcttcccccagagggtgaagaaccagggcacagctgacttcctgcccaaccggcccaggcacacctgggagtggcacagctgccaccagcactaccacagcatggatgagttcagccactatgacctgctggatgctgccaccgggaagaaggtggccgagggccacaaggccagcttctgcctggaggacagcacctgtgactttggaaacctgaagagatatgcctgcaccagccacacccagggcctgagccctggctgctatgacacctacaatgctgacatcgactgccagtggattgacatcacagatgtgcagcccggcaactacatcctgaaggtgcacgtgaaccccaagtacatcgtgctggagagtgacttcaccaacaacgtggtgcgctgcaacatccactacacaggccgctacgtgtctgccaccaactgcaagatcgtgcagagctag

SEQ ID NO: 20333 - DNA, 1311 bp, Artificial Sequence
  Description of Artificial Sequence: Synthetic coding sequence
atggcccgggcccggacctctgtgtcccagcagagacatggaggcagcgccagctctgtgtctgccagcgcctttgccagcacctaccggcagcagcccagctacccccagcagttcccctacccccaggccccctttgtgtcccagtatgaaaattatgaccctgccagcaggacctatgaccagggctttgtgtactacagacctgctgggggcggcgtgggcgctggagctgctgctgtggccagcgctggggtcatctacccctaccagccccgggcccgctatgaggagtatggaggaggagaggagctgcctgagtacccaccccagggcttctacccagcccctgagcggccctacgtgcccccacctcctcctcctccagatggcctggaccggcgctacagccacagcctgtacagcgagggcaccccaggctttgagcaggcctacccagaccccggccctgaggccgcccaggcccatggaggagacccccggctgggctggtacccaccctatgccaaccccccacctgaggcctacggccccccccgggccctggagcccccctacctgcctgtgcgcagcagtgacaccccacctcctggaggagagagaaatggagcccagcagggccgcctgtctgtgggctctgtgtaccggcccaaccagaatggccggggcctgcctgacctggtgcctgaccccaactacgtgcaggccagcacctacgtgcagagggcccacctgtacagcctgcgctgtgccgctgaggagaagtgcctggccagcacagcctatgcccctgaggccacagattatgatgtgcgggtgctgctgcgcttcccccagagggtgaagaaccagggcacagctgacttcctgcccaaccggcccaggcacacctgggagtggcacagctgccaccagcactaccacagcatggatgagttcagccactatgacctgctggatgctgccaccgggaagaaggtggccgagggccacaaggccagcttctgcctggaggacagcacctgtgactttggaaacctgaagagatatgcctgcaccagccacacccagggcctgagccctggctgctatgacacctacaatgctgacatcgactgccagtggattgacatcacagatgtgcagcccggcaactacatcctgaaggtgcacgtgaaccccaagtacatcgtgctggagagtgacttcaccaacaacgtggtgcgctgcaacatccactacacaggccgctacgtgtctgccaccaactgcaagatcgtgcagagctag

SEQ ID NO: 20334 - DNA, 636 bp, Artificial Sequence
  Description of Artificial Sequence: Synthetic coding sequence
atgaccaccctgacccggcaggacctgaactttggccaggtggtggctgatgtgctgtgtgagttcctggaggtggccgtgcacctgatcctgtatgtgcgggaggtgtaccctgtgggcatcttccagaagaggaagaagtacaacgtgcctgtgcagatgagctgccaccctgagctgaaccagtacatccaggacaccctgcactgtgtgaagcccctgctggagaagaatgatgtggagaaggtggtggtggtgatcctggacaaggagcacaggcctgtggagaagtttgtgtttgagatcacccagccccccctgctgagcatcagcagtgacagcctgctgagccacgtggagcagctgctgcgggccttcatcctgaagatctctgtgtgtgatgctgtgctggaccacaaccccccaggctgcaccttcaccgtgctggtgcacacccgggaggccgccaccaggaacatggagaagatccaggtgatcaaggacttcccctggatcctggctgatgagcaggatgtgcacatgcatgaccccaggctcatccccctgaagaccatgaccagtgacatcctgaagatgcagctgtatgtggaggagcgggcccacaagggcagctag

SEQ ID NO: 20335 - DNA, 318 bp, Artificial Sequence
  Description of Artificial Sequence: Synthetic coding sequence
atgaccaccctgacccggcaggacctgaactttggccaggtggtggctgatgtgctgtgtgagttcctggaggtggccgtgcacctgatcctgtatgtgcgggaggtgtaccctgtgggcatcttccagaagaggaagaagtacaacgtgcctgtgcagatgagctgccaccctgagctgaaccagtacatccaggacaccctgcactgtgtgaagcccctgctggagaaggtgcgggtgcactgggccccccagcccagccaccccatgctgacccctgtgcctgtgtgcagccagagcaacagcggcatgggctag

SEQ ID NO: 20336 - DNA, 531 bp, Artificial Sequence
  Description of Artificial Sequence: Synthetic coding sequence
atgaccaccctgacccggcaggacctgaactttggccaggtggtggctgatgtgctgtgtgagttcctggaggtggccgtgcacctgatcctgtatgtgcgggaggtgtaccctgtgggcatcttccagaagaggaagaagtacaacgtgcctgtgcagaatgatgtggagaaggtggtggtggtgatcctggacaaggagcacaggcctgtggagaagtttgtgtttgagatcacccagccccccctgctgagcatcagcagtgacagcctgctgagccacgtggagcagctgctgcgggccttcatcctgaagatctctgtgtgtgatgctgtgctggaccacaaccccccaggagtgtccaccccccaccccctcttcccctggcacttccacggctacctgggcctggtgtgtgtgcccaggtccatgtttggctgcagcgagacccacctgttcctgaccctgcgggtgcacctgctgtgggaggccagcctgattgacagcacctggctgcccagcccctactag

SEQ ID NO: 20337 - DNA, 636 bp, Artificial Sequence; identical to SEQ ID NO: 20334
  Description of Artificial Sequence: Synthetic coding sequence

SEQ ID NO: 20338 - DNA, 675 bp, Artificial Sequence
  Description of Artificial Sequence: Synthetic coding sequence
atgaccaccctgacccggcaggacctgaactttggccaggtggtggctgatgtgctgtgtgagttcctggaggtggccgtgcacctgatcctgtatgtgcgggaggtgtaccctgtgggcatcttccagaagaggaagaagtacaacgtgcctgtgcagatgagctgccaccctgagctgaaccagtacatccaggacaccctgcactgtgtgaagcccctgctggagaagaatgatgtggagaaggtggtggtggtgatcctggacaaggagcacaggcctgtggagaagtttgtgtttgagatcacccagccccccctgctgagcatccgctgggccgccccagccccccggcccctggccggcatcagcagtgacagcctgctgagccacgtggagcagctgctgcgggccttcatcctgaagatctctgtgtgtgatgctgtgctggaccacaaccccccaggctgcaccttcaccgtgctggtgcacacccgggaggccgccaccaggaacatggagaagatccaggtgatcaaggacttcccctggatcctggctgatgagcaggatgtgcacatgcatgaccccaggctcatccccctgaagaccatgaccagtgacatcctgaagatgcagctgtatgtggaggagcgggcccacaagggcagctag

SEQ ID NO: 20339 - DNA, 675 bp, Artificial Sequence; identical to SEQ ID NO: 20338
  Description of Artificial Sequence: Synthetic coding sequence

SEQ ID NO: 20340 - DNA, 636 bp, Artificial Sequence; identical to SEQ ID NO: 20334
  Description of Artificial Sequence: Synthetic coding sequence

SEQ ID NO: 20341 - DNA, 597 bp, Artificial Sequence
  Description of Artificial Sequence: Synthetic coding sequence
atgaccaccctgacccggcaggacctgaactttggccagggccgggaggccggccctgctggccctggggccggggccagcggccctgctggcttcctggagcgggccaccggcctgtgccccccagctgtggtggctgatgtgctgtgtgagttcctggaggtggccgtgcacctgatcctgtatgtgcgggaggtgtaccctgtgggcatcttccagaagaggaagaagtacaacgtgcctgtgcagatgagctgccaccctgagctgaaccagtacatccaggacaccctgcactgtgtgaagcccctgctggagaagaatgatgtggagaaggtggtggtggtgatcctggacaaggagcacaggcctgtggagaagtttgtgtttgagatcacccagccccccctgctgagcatcagcagtgacagcctgctgagccacgtggagcagctgctgcgggccttcatcctgaagatctctgtgtgtgatgctgtgctggaccacaaccccccaggctgcaccttcaccgtgctggtgcacacccgggaggccgccaccaggaacatggagaagatccaggtgatcaaggtgtag

SEQ ID NO: 20342 - DNA, 504 bp, Artificial Sequence
  Description of Artificial Sequence: Synthetic coding sequence
atgaccaccctgacccggcaggacctgaactttggccaggtggtggctgatgtgctgtgtgagttcctggaggtggccgtgcacctgatcctgtatgtgcgggaggtgtaccctgtgggcatcttccagaagaggaagaagtacaacgtgcctgtgcagatgagctgccaccctgagctgaaccagtacatccaggacaccctgcactgtgtgaagcccctgctggagaagaatgatgtggagaaggtggtggtggtgatcctggacaaggagcacaggcctgtggagaagtttgtgtttgagatcacccagccccccctgctgagcatcagcagtgacagcctgctgagccacgtggagcagctgctgcgggccttcatcctgaagatctctgtgtgtgatgctgtgctggaccacaaccccccaggctgcaccttcaccgtgctggtgcacacccgggaggccgccaccaggaacatggagaagatccaggtgatcaagtag

SEQ ID NO: 20343 - DNA, 3159 bp, Artificial Sequence
  Description of Artificial Sequence: Synthetic coding sequence
atggccggcatggacagcggcaacctgaagacagcccggctgtggagagatgctgccctgcgggccaggaagctgcggagcaacctgcggcagctgaccctgacagctgctggggcctgccctggagctggagcagatgccctggagagccctgccagcccccagctggtgctgcctgccaacctgggggacatcgaggccctgaacctgggcaacaacggcctggaggaggtgcctgagggcctgggcagcgccctgggcagcctgcgggtgctggtgctgcggaggaacagatttgcccggctgcccccagctgtggccgagctgggccaccacctgacagagctggatgtgagccacaaccggctgacagccctgggcgctgaggtggtgtctgccctgcgggagctgaggaagctgaacctgagccacaaccagctgcctgccctgcctgcccagctgggcgccctggcccacctggaggagctggatgtgtccttcaaccggctggcccacctgcctgacagcctgagctgcctgagccggctgcggaccctggatgtggaccacaaccagctgacagccttcccccggcagctgctgcagctggtggccctggaggagctggatgtgagcagcaaccggctgcggggcctgcctgaggacatcagcgccctgcgggccctgaagatcctgtggctgtctggagctgagctgggcaccctgcctgctggcttctgtgagctggccagcctggagagcctgatgctggacaacaacggcctgcaggccctgcctgcccagttcagctgcctgcagaggctgaagatgctgaacctgagcagcaacctgtttgaggagttccctgctgccctgctgcccctggccggcctggaggagctgtacctgagcaggaaccagctgacctctgtgcccagcctcatcagcggcctgggccgcctgctgaccctgtggctggacaacaaccgcatccgctacctgcctgacagcatcgtggagctgaccggcctggaggagctggtgctgcagggcaaccagattgctgtgctgcctgaccacttcggccagctgagccgggtgggcctgtggaagatcaaggacaaccccctcatccagcccccctatgaggtgtgcatgaagggcatcccctacatcgccgcctaccagaaggagctggcccacagccagcctgctgtgcagccccggctgaagctgctgctgatgggccacaaggccgccggcaagaccctgctgcggcactgcctgacagaggagcgggtggagggctgccctgggggcggggacaaggagaagtgctacccacccagccccccacctgtgtccaagggcatcgaggtgacctcctggacagcagatgccagccggggcctgcgcttcatcgtgtatgacctggccggagatgagagctatgaggtgatccagcccttcttcctgagccctggggccctgtatgtgctggtggtgaacctggccacctatgagcccaggcacttccccaccaccgtgggcagcttcctgcaccgggtgggcgcccgggtgccccatgctgtggtgtgcatcgtgggcacccatgctgacctgtgtggggagcgggagctggaggagaagtgcctggacatccaccggcagatcgccctgcaggagaagcatgatgctgagggcctgagccggctggccaaggtggtggatgaggccctggcccgggactttgagctgcggagcgccagcccccatgctgcctactacggcgtgtctgacaagaacctgcggcggaggaaggcccacttccagtacctgctgaaccaccggctgcagatcctgagccctgtgctgcctgtgtcctgccgggaccccaggcacctgcggcggctgcgggacaagctgctgtctgtggccgagcaccgggagatcttccccaacctgcaccgggtgctgcccaggtcctggcaggtgctggaggagctgcacttccagcccccccaggcccagaggctgtggctgtcctggtgggacagcgcccggctgggcctgcaggccggcctgacagaagatcggctgcagagcgccctgagctacctgcacgagagcggcaagctgctgtactttgaggacagccctgccctgaaggagcacgtgttccacaacctgacccggctgattgacatcctgaatgtgttcttccagagggaccccagcctgctgctgcacaagctgctgctgggcaccagcggggagggcaaggccgagggggagagcagcccccccatggcccggagcacccccagccaggagctgctgcgggccacccagctgcaccagtatgtggagggcttcctgctgcacggcctgctgcctgcccacgtgatccggctgctgctgaagccccacgtgcaggcccagcaggacctgcagctgctgctggagctgctggagaagatgggcctgtgctactgcctgaacaagcccaagggcaagcccctgaatggcagcacagcctggtacaagttcccctgctacgtgcagaatgaggtgccccatgctgaggcctggatcaatggcaccaacctggccggccagagctttgtggccgagcagctgcagatcgagtacagcttccccttcaccttccccctgggcctgtttgcccgctacagcgtgcagatcaacagccacgtggtgcacagaagtgatggcaagttccagatctttgcctaccggggcaaggtgcctgtggtggtgtcctacagacctgcccggggcgtgctgcagcctgacaccctgagcatcgccagccacgccagcctgcccaacatctggacagcctggcaggccatcacccccctggtggaggagctgaatgtgctgctgcaggagtggccaggcctgcactacacagtgcacatcctgtgcagcaagtgcctgaagaggggcagccccaacccccacgccttccctggagagctgctgagccagcccaggcctgagggcgtggccgagatcatctgccccaagaatggaagtgagcgggtgaatgtggccctggtgtacccacccacccccaccgtcatcagcccctgcagcaagaagaatgtgggggagaagcacaggaaccagtag

SEQ ID NO: 20344 - DNA, 549 bp, Artificial Sequence
  Description of Artificial Sequence: Synthetic coding sequence
atgggcaagggccgctttgatgagaaggaaaatgtgagcaactgcatccagctgaagaccagcgtcatcaagggcatcaagaaccagctgattgagcagtttcctggcatcgagccctggctgaaccagatcatgcccaagaaggaccctgtgaagatcgtgcgctgccacgagcacatcgagatcctgactgtgaatggagagctgctcttcttccggcagcgggagggccccttctaccccaccctgcggctgctgcacaagtaccccttcatcctgccccaccagcaggtggacaagggggccatcaagtttgtgctgagcggggccaacatcatgtgccccggcctgaccagccctggggccaagctgtacccagctgctgtggacaccatcgtggccatcatggccgagggcaagcagcacgccctgtgtgtgggcgtgatgaagatgtctgctgaggacatcgagaaggtgaacaagggcattggaattgagaacatccactacctgaatgatggcctgtggcacatgaagacctacaagtag

SEQ ID NO: 20345 - DNA, 546 bp, Artificial Sequence
  Description of Artificial Sequence: Synthetic coding sequence
atgttcaagaagtttgatgagaaggaaaatgtgagcaactgcatccagctgaagaccagcgtcatcaagggcatcaagaaccagctgattgagcagtttcctggcatcgagccctggctgaaccagatcatgcccaagaaggaccctgtgaagatcgtgcgctgccacgagcacatcgagatcctgactgtgaatggagagctgctcttcttccggcagcgggagggccccttctaccccaccctgcggctgctgcacaagtaccccttcatcctgccccaccagcaggtggacaagggggccatcaagtttgtgctgagcggggccaacatcatgtgccccggcctgaccagccctggggccaagctgtacccagctgctgtggacaccatcgtggccatcatggccgagggcaagcagcacgccctgtgtgtgggcgtgatgaagatgtctgcagaagatattgagaaggtgaacaagggcatcggcatcgagaacatccactacctgaatgatggcctgtggcacatgaagacctacaagtag

SEQ ID NO: 20346 - DNA, 2226 bp, Artificial Sequence
  Description of Artificial Sequence: Synthetic coding sequence
atggccctcttcaccccctggaagctgagcagccagaagctgggcttcttcctggtgaccttcggcttcatctggggcatgatgctgctgcacttcaccatccagcagaggacccagcctgagagcagctccatgctgcgggagcagatcctggacctgagcaagcgctacatcaaggccctggccgaggagaacagaaatgtggtggatggcccctatgctggggtgatgacagcctatgacctgaagaagaccctggccgtgctgctggacaacatcctgcagagaattggcaagctggagagcaaggtggacaacctggtggtgaatggcaccggcaccaacagcaccaacagcaccacagctgtgcccagcctggtggccctggagaagatcaacgtggccgacatcatcaatggagcccaggagaagtgtgtgctgccccccatggatggctacccccactgtgagggcaagatcaagtggatgaaggacatgtggaggagtgacccctgctacgccgactatggagtggatggcagcacctgcagcttcttcatctacctgtctgaggtggagaactggtgcccccacctgccctggagggccaagaacccctatgaggaggccgaccacaacagcctggccgagatcagaacagacttcaacatcctgtacagcatgatgaagaagcatgaggagttccgctggatgaggctgcgcatccggaggatggctgatgcctggatccaggccatcaagagcctggccgagaagcagaacctggagaagaggaagaggaagaaggtgctggtgcacctgggcctgctgaccaaggagagcggcttcaagattgctgagacagccttcagcggcggccccctgggggagctggtgcagtggagcgacctgatcaccagcctgtacctgctgggccatgacatccgcatcagcgccagcctggccgagctgaaggagatcatgaagaaggtggtgggcaacagaagtggctgccccaccgtgggggacagaattgtggagctgatctacattgatattgtgggcctggcccagttcaagaagaccctgggccccagctgggtgcactaccagtgcatgctgcgggtgctggacagctttggaacagagcctgagttcaaccacgccaactatgcccagagcaagggccacaagaccccctggggcaagtggaacctgaacccccagcagttctacaccatgttcccccacaccccagacaacagcttcctgggctttgtggtggagcagcacctgaacagcagtgacatccaccacatcaatgagatcaagaggcagaaccagagcctggtgtatggcaaggtggacagcttctggaagaacaagaagatctacctggacatcatccacacctacatggaggtgcacgccaccgtgtatggcagcagcaccaagaacatccccagctatgtgaagaaccacggcatcctgagcggccgggacctgcagttcctgctgcgggagaccaagctgtttgtgggcctgggcttcccctatgagggccctgcccccctggaggccatcgccaacggctgtgccttcctgaaccccaagttcaacccccccaagagcagcaagaacacagacttcttcatcggcaagcccaccctgcgggagctgaccagccagcacccctatgcagaggtgttcatcggccggccccacgtgtggacagtggacctgaacaaccaggaggaggtggaggatgctgtgaaggccatcctgaaccagaagattgagccctacatgccctatgagttcacctgtgagggcatgctgcagaggatcaatgccttcatcgagaagcaggacttctgccacggccaggtgatgtggccacccctgagcgccctgcaggtgaagctggccgagcccggccagagctgcaagcaggtgtgccaggagagccagctgatctgtgagcccagcttcttccagcacctgaacaaggacaaggacatgctgaagtacaaggtgacctgccagagcagcgagctggccaaggacatcctggtgcccagctttgaccccaagaacaagcactgtgtgttccagggcgacctgctgctcttcagctgtgccggggcccaccccaggcaccagagggtgtgcccctgccgggacttcatcaagggccaggtggccctgtgcaaggactgcctgtag

SEQ ID NO: 20347 - DNA, 2226 bp, Artificial Sequence; identical to SEQ ID NO: 20346
  Description of Artificial Sequence: Synthetic coding sequence

SEQ ID NO: 20348 - DNA, 1410 bp, Artificial Sequence
  Description of Artificial Sequence: Synthetic coding sequence
atgcacagcttcccccccctgctgctgctgctcttctggggcgtggtgagccacagcttccctgccaccctggagacccaggagcaggatgtggacctggtgcagaagtacctggagaagtactacaacctgaagaatgatggccggcaggtggagaagagaagaaattctggccctgtggtggagaagctgaagcagatgcaggagttcttcggcctgaaggtgacaggcaagccagatgctgagaccctgaaggtgatgaagcagccccgctgtggggtgcctgatgtggcccagtttgtgctgacagagggcaacccccgctgggagcagacccacctgacctacagaattgagaactacaccccagacctgcccagggcagatgtggaccacgccatcgagaaggccttccagctgtggagcaatgtgacccccctgaccttcaccaaggtgtctgagggccaggccgacatcatgatcagctttgtgcggggggaccaccgggacaacagcccctttgatggccctgggggcaacctggcccacgccttccagcccggccctggcattggaggagatgcccactttgatgaagatgagcgctggaccaacaacttccgggagtacaacctgcaccgggtggccgcccacgagctgggccacagcctgggcctgagccacagcacagacatcggggccctgatgtaccccagctacaccttctctggagatgtgcagctggcccaggatgacattgatggcatccaggccatctacggccgcagccagaaccctgtgcagcccatcggcccccagacccccaaggcctgtgacagcaagctgacctttgatgccatcaccaccatccggggggaggtgatgttcttcaaggaccgcttctacatgaggaccaaccccttctacccagaggtggagctgaacttcatcagcgtcttctggccccagctgcccaacggcctggaggccgcctatgaatttgctgacagagatgaggtgcgcttcttcaagggcaacaagtactgggccgtgcagggccagaatgtgctgcacggctaccccaaggacatctacagcagctttggcttccccaggacagtgaagcacattgatgctgccctgtctgaggagaacacaggcaagacctacttctttgtggccaacaagtactggaggtatgatgagtacaagaggtccatggaccccggctaccccaagatgattgcccatgacttccctggcatcggccacaaggtggatgctgtgttcatgaaggatggcttcttctacttcttccacggcacccggcagtacaagtttgaccccaagaccaagaggatcctgaccctgcagaaggccaacagctggttcaactgcaggaagaactag

SEQ ID NO: 20349 - DNA, 1431 bp, Artificial Sequence
  Description of Artificial Sequence: Synthetic coding sequence
atgatgcacctggccttcctggtgctgctgtgcctgcctgtgtgcagcgcctaccccctgtctggagctgccaaggaggaggacagcaacaaggacctggcccagcagtacctggagaagtactacaacctggagaaggatgtgaagcagttccggaggaaggacagcaacctgattgtgaagaagatccagggcatgcagaagttcctgggcctggaggtgacaggcaagctggacacagacaccctggaggtgatgaggaagccccgctgtggggtgcctgatgtgggccacttcagcagcttccctggcatgcccaagtggaggaagacccacctgacctacagaattgtgaactacaccccagacctgcccagagatgctgtggacagcgccatcgagaaggccctgaaggtgtgggaggaggtgacccccctgaccttcagccggctgtatgaaggagaggccgacatcatgatcagctttgctgtgaaggagcacggggacttctacagctttgatggccctggccacagcctggcccacgcctacccacctggccctggcctgtatggagacatccactttgatgatgatgagaagtggacagaagatgccagcggcaccaacctcttcctggtggccgcccacgagctgggccacagcctgggcctcttccacagcgccaacacagaggccctgatgtaccccctgtacaacagcttcacagagctggcccagttccggctgagccaggatgatgtgaatggcatccagagcctgtatggccccccaccagccagcacagaggagcccctggtgcccaccaagtctgtgcccagcggcagcgagatgcctgccaagtgtgaccctgccctgagctttgatgccatcagcaccctgcggggggagtacctgttcttcaaggaccgctacttctggaggaggagccactggaaccctgagcctgagttccacctgatcagcgccttctggcccagcctgcccagctacctggatgctgcctatgaggtgaacagccgggacaccgtcttcatcttcaagggaaatgagttctgggccatcagaggaaatgaggtgcaggccggctacccccggggcatccacaccctgggcttcccccccaccatcaggaagattgatgctgctgtgtctgacaaggagaagaagaagacctacttctttgctgctgacaagtactggaggtttgatgagaacagccagagcatggagcagggcttcccccggctgattgctgatgacttccctggggtggagcccaaggtggatgctgtgctgcaggccttcggcttcttctacttcttcagcggcagcagccagtttgaatttgaccccaatgccaggatggtgacccacatcctgaagagcaacagctggctgcactgctag

SEQ ID NO: 20350 - DNA, 930 bp, Artificial Sequence
  Description of Artificial Sequence: Synthetic coding sequence
atgcccaggcactgcagcgctgctggctgctgcacccgggacacccgggagaccaggaacagaggcatctccttccaccggctgcccaagaaggacaacccccggcggggcctgtggctggccaactgccagaggctggaccccagcggccagggcctgtgggaccctgccagcgagtacatctacttctgcagcaagcactttgaggaggactgctttgagctggtgggcatcagcggctaccaccggctgaaggagggcgctgtgcccaccatctttgagagcttcagcaagctgcggaggaccaccaagaccaagggccacagctacccacctggccctgctgaggtgtcccggctgcggcgctgcaggaagcgctgcagcgagggccggggccccaccacccccttcagccccccacctccagcagatgtgacctgcttccctgtggaggaggccagcgccccagccaccctgcctgccagccctgctggccgcctggagcccggcctgagcagccccttcagtgacctgctgggccccctgggcgcccaggctgatgaagctggctgcagcgcccagcccagccctgagcggcagcccagccccctggagcccaggcctgtgagccccagcgcctacatgctgcggctgcccccacctgctggggcctacatccagaatgagcacagctaccaggtgggcagcgccctgctgtggaagagaagagctgaggccgccctggatgccctggacaaggcccagaggcagctgcaggcctgcaagagaagagagcagaggctgcggctgcggctgaccaagctgcagcaggagcgggcccgggagaagagggcccaggctgatgcccggcagaccctgaaggagcacgtgcaggactttgccatgcagctgagcagctccatggcctag

SEQ ID NO: 20351 - DNA, 1416 bp, Artificial Sequence
  Description of Artificial Sequence: Synthetic coding sequence
atgcaccctggggtgctggccgccttcctgttcctgtcctggacccactgccgggccctgcccctgcccagcggaggagatgaagatgacctgtctgaggaggacctgcagtttgctgagcgctacctgcggagctactaccaccccaccaacctggccggcatcctgaaggaaaatgctgccagctccatgacagagcggctgcgggagatgcagagcttcttcggcctggaggtgacaggcaagctggatgacaacaccctggatgtgatgaagaagccccgctgtggggtgcctgatgtgggggagtacaacgtgttccccaggaccctgaagtggagcaagatgaacctgacctaccgcatcgtgaactacaccccagacatgacccacagcgaggtggagaaggccttcaagaaggccttcaaggtgtggagcgatgtgacccccctgaacttcacccggctgcatgatggcattgctgacatcatgatcagctttggcatcaaggagcacggggacttctacccctttgatggccccagcggcctgctggcccacgccttccccccaggccccaactatggaggagatgcccactttgatgatgatgagacctggaccagcagcagcaagggctacaacctcttcctggtggccgcccacgagtttggccacagcctgggcctggaccacagcaaggaccccggggccctgatgttccccatctacacctacacaggcaagagccacttcatgctgcctgatgatgatgtgcagggcatccagagcctgtatggccctggagatgaggaccccaaccccaagcaccccaagaccccagacaagtgtgaccccagcctgagcctggatgccatcaccagcctgcggggggagaccatgatcttcaaggaccgcttcttctggaggctgcacccccagcaggtggatgctgagctgttcctgaccaagagcttctggccagagctgcccaacagaattgatgctgcctatgagcaccccagccatgacctgatcttcatcttccggggcaggaagttctgggccctgaatggctatgacatcctggagggctaccccaagaagatcagcgagctgggcctgcccaaggaggtgaagaagatctctgctgctgtgcactttgaagatactgggaagaccctgctcttcagcggcaaccaggtgtggaggtatgatgacaccaaccacatcatggacaaggactaccccaggctcatcgaggaggacttccctggcattggagacaaggtggatgctgtgtatgagaagaatggctacatctacttcttcaacggccccatccagtttgagtacagcatctggagcaacagaattgtgcgggtgatgcctgccaacagcatcctgtggtgctag

SEQ ID NO: 20352 - DNA, 1470 bp, Artificial Sequence
  Description of Artificial Sequence: Synthetic coding sequence
atgcaccctggggtgctggccgccttcctgttcctgtcctggacccactgccgggccctgcccctgcccagcggaggagatgaagatgacctgtctgaggaggacctgcagtttgctgagcgctacctgcggagctactaccaccccaccaacctggccggcatcctgaaggaaaatgctgccagctccatgacagagcggctgcgggagatgcagagcttcttcggcctggaggtgacaggcaagctggatgacaacaccctggatgtgatgaagaagccccgctgtggggtgcctgatgtgggggagtacaacgtgttccccaggaccctgaagtggagcaagatgaacctgacctaccgcatcgtgaactacaccccagacatgacccacagcgaggtggagaaggccttcaagaaggccttcaaggtgtggagcgatgtgacccccctgaacttcacccggctgcatgatggcattgctgacatcatgatcagctttggcatcaaggagcacggggacttctacccctttgatggccccagcggcctgctggcccacgccttccccccaggccccaactatggaggagatgcccactttgatgatgatgagacctggaccagcagcagcaagggctacaacctcttcctggtggccgcccacgagtttggccacagcctgggcctggaccacagcaaggaccccggggccctgatgttccccatctacacctacacaggcaagagccacttcatgctgcctgatgatgatgtgcagggcatccagagcctgtatggccctggagatgaggaccccaaccccaagcaccccaagaccccagacaagtgtgaccccagcctgagcctggatgccatcaccagcctgcggggggagaccatgatcttcaaggaccgcttcttctggaggctgcacccccagcaggtggatgctgagctgttcctgaccaagagcttctggccagagctgcccaacagaattgatgctgcctatgagcaccccagccatgacctgatcttcatcttccggggcaggaagttctgggccctgaatggctatgacatcctggagggctaccccaagaagatcagcgagctgggcctgcccaaggaggtgaagaagatctctgctgctgtgcactttgaagatactgggaagaccctgctcttcagcggcaaccaggtgtggaggtatgatgacaccaaccacatcatggacaaggactaccccaggctcatcgaggaggacttccctggcattggagacaaggtggatgctgtgtatgagaagaatgaaagccacagcgtgacccaggccggcgtgcactgcaggaacctgagcagcctgcagcccccacctcctggcttcaagcgcttcagctgcctgagcctgtggagctcctgggactaccgcctgtacctgttcttccagaggacccacacagtgtag

SEQ ID NO: 20353 - DNA, 1152 bp, Artificial Sequence
  Description of Artificial Sequence: Synthetic coding sequence
atgcaccctggggtgctggccgccttcctgttcctgtcctggacccactgccgggccctgcccctgcccagcggaggagatgaagatgacctgtctgaggaggacctgcagtttgctgagcgctacctgcggagctactaccaccccaccaacctggccggcatcctgaaggaaaatgctgccagctccatgacagagcggctgcgggagatgcagagcttcttcggcctggaggtgacaggcaagctggatgacaacaccctggatgtgatgaagaagccccgctgtggggtgcctgatgtgggggagtacaacgtgttccccaggaccctgaagtggagcaagatgaacctgacctaccgcatcgtgaactacaccccagacatgacccacagcgaggtggagaaggccttcaagaaggccttcaaggtgtggagcgatgtgacccccctgaacttcacccggctgcatgatggcattgctgacatcatgatcagctttggcatcaaggagcacggggacttctacccctttgatggccccagcggcctgctggcccacgccttccccccaggccccaactatggaggagatgcccactttgatgatgatgagacctggaccagcagcagcaagggctacaacctcttcctggtggccgcccacgagtttggccacagcctgggcctggaccacagcaaggaccccggggccctgatgttccccatctacacctacacaggcaagagccacttcatgctgcctgatgatgatgtgcagggcatccagagcctgtatggccctggagatgaggaccccaaccccaagcaccccaagaccccagacaagtgtgaccccagcctgagcctggatgccatcaccagcctgcggggggagaccatgatcttcaaggaccgcttcttctggaggctgcacccccagcaggtggatgctgagctgttcctgaccaagagcttctggccagagctgcccaacagaattgatgctgcctatgagcaccccagccatgacctgatcttcatcttccggggcaggaagttctgggccctgaatggctatgacatcctggagggctaccccaagaagatcagcgagctgggcctgcccaaggaggtgaacaagctgcagtag

SEQ ID NO: 20354 - DNA, 1749 bp, Artificial Sequence
  Description of Artificial Sequence: Synthetic coding sequence
atgagccctgcccccaggcctccccgctgcctgctgctgcccctgctgaccctgggcacagccctggccagcctgggcagcgcccagagcagcagcttcagccctgaggcctggctgcagcagtatggctacctgcccccaggggacctgcggacccacacccagaggagcccccagagcctgtctgctgccatcgccgccatgcagaagttctacggcctgcaggtgacaggcaaggcagatgctgacaccatgaaggccatgagaagaccccgctgtggggtgcctgacaagtttggagctgagatcaaggccaacgtgcggaggaagagatatgccatccagggcctgaagtggcagcacaatgagatcaccttctgcatccagaactacacccccaaggtgggggagtatgccacctatgaggccatcaggaaggccttccgggtgtgggagagcgccacccccctgcgcttccgggaggtgccctatgcctacatccgggagggccacgagaagcaggccgacatcatgatcttctttgctgagggcttccacggggacagcaccccatttgatggagagggcggcttcctggcccacgcctacttccctggccccaacattggaggagacacccactttgattctgctgagccctggacagtgagaaatgaagacctgaatggaaatgacatcttcctggtggccgtgcatgagctgggccacgccctgggcctggagcacagcagtgaccccagcgccatcatggcccccttctaccagtggatggacacagaaaattttgtgctgcctgatgatgaccggcggggcatccagcagctgtatggaggagagagcggcttccccaccaagatgccaccccagcccaggaccaccagccggcccagcgtgcctgacaagcccaagaaccccacctacggccccaacatctgtgatggcaactttgacacagtggccatgctgcggggggagatgtttgtgttcaaggagcgctggttctggagggtgaggaacaaccaggtgatggatggctaccccatgcccatcggccagttctggaggggcctgcctgccagcatcaacacagcctatgaaaggaaggatggcaagtttgtgttcttcaagggggacaagcactgggtgtttgatgaggccagcctggagcccggctaccccaagcacatcaaggagctgggccggggcctgcccacagacaagattgatgctgccctcttctggatgcccaacgggaagacctacttcttccggggcaacaagtactaccgcttcaatgaggagctgcgggctgtggacagcgagtaccccaagaacatcaaggtgtgggagggcatccctgagagcccccggggcagcttcatgggcagtgatgaggtgttcacctacttctacaagggcaacaagtactggaagttcaacaaccagaagctgaaggtggagcccggctaccccaagagcgccctgcgggactggatgggctgccccagcggcggccgcccagatgagggcacagaggaggagacagaggtgatcatcatcgaggtggatgaggagggcggcggcgctgtgtctgctgctgctgtggtgctgcctgtgctgctgctgctgctggtgctggccgtgggcctggccgtgttcttcttcagaagacatggcaccccccggcggctgctgtactgccagaggagcctgctggacaaggtgtag

SEQ ID NO: 20355 - DNA, 2052 bp, Artificial Sequence
  Description of Artificial Sequence: Synthetic coding sequence
atggccagcggccctggcagccaggagcgggagggcctgctgattgtgaagctggaggaggactgtgcctggagccaggagctgcccccaccagaccccggccccagccctgaggccagccacctgcgcttccgccgcttccgcttccaggaggccgccggcccccgggaggccctgagccggctgcaggagctgtgccacggctggctgcggcctgagatgaggaccaaggagcagatcctggagctgctggtgctggagcagttcctgaccatcctgccccaggagatccagagccgggtgcaggagctgcaccctgagagcggggaggaggccgtgaccctggtggaggacatgcagcgggagctgggccgcctgcggcagcaggtgaccaaccacggccggggcacagaggtgctgctggaggagcccctgcccctggagacagcccgggagagccccagcttcaagctggagcccatggagacagagaggagccctggcccccggctgcaggagctgctgggccccagcccccagagggacccccaggccgtgaaggagcgggccctgagcgccccctggctgagcctcttccccccagagggcaacatggaggacaaggagatgacaggcccccagctgcctgagagcctggaggatgtggccatgtacatcagccaggaggagtggggccaccaggaccccagcaagagggccctgagccgggacacagtgcaggagagctatgaaaatgtggacagcctggagagccacatccccagccaggaggtgcccggcacccaggtgggccagggcggcaagctgtgggaccccagcgtgcagagctgcaaggagggcctgagcccccggggccctgcccctggagaggagaagtttgagaacctggagggcgtgcccagcgtgtgcagcgagaacatccacccccaggtgctgctgcctgaccaggcccggggggaggtgccctggagccctgagctgggccggccccatgacaggagccagggcgactgggcccctcctcctgagggcggcatggagcaggccctggccggggccagcagcggccgggagctgggccggcccaaggagctgcagcccaagaagctgcacctgtgccccctgtgtgggaagaacttcagcaacaacagcaacctgatccgccaccagagaattcatgctgctgagcggctgtgcatgggcgtggactgcacagagatctttggaggcaacccccgcttcctgagcctgcaccgggcccacctgggggaggaggcccacaagtgcctggagtgtgggaagtgcttcagccagaacacccacctgaccaggcaccagaggacccacactggagagaagccctaccagtgcaacatctgtgggaagtgcttcagctgcaacagcaacctgcaccgccaccagaggacccacactggagagaagccctacaagtgcccagaatgtggggagatctttgcccacagcagcaacctgctgcggcaccagaggatccacactggagagcggccctacaagtgcccagaatgtgggaagagcttcagccgcagcagccacctggtgatccacgagaggacccatgagcgggagcggctgtaccccttctctgaatgtggggaggccgtgtctgacagcacccccttcctgaccaaccacggggcccacaaggccgagaagaagctgtttgagtgcctgacctgtgggaagagcttccggcagggcatgcacctgaccaggcaccagaggacccacactggagagaagccctacaagtgcaccctgtgtggggagaacttcagccacaggagcaacctgatccgccaccagaggatccacactggagagaagccctacacctgccatgaatgtggggacagcttcagccacagcagcaaccgcatccgccacctgcggacccacactggagagcggccctacaagtgcagtgaatgtggggagagcttcagccgcagcagccggctgatgagccaccagaggacccacactggatag

SEQ ID NO: 20356 - DNA, 1755 bp, Artificial Sequence
  Description of Artificial Sequence: Synthetic coding sequence
atgcagaagttcttcggcctgccccagacaggagacctggaccagaacaccatcgagaccatgaggaagccccgctgtggcaacccagatgtggccaactacaacttcttccccaggaagcccaagtgggacaagaaccagatcacctaccgcatcatcggctacaccccagacctggaccctgagaccgtggatgatgcctttgcccgggccttccaggtgtggagcgatgtgacccccctgcgcttcagccgcatccatgatggagaggccgacatcatgatcaactttggccgctgggagcacggagatggctacccctttgatggcaaggatggcctgctggcccacgcctttgcccctggcactggagtgggcggggacagccactttgatgatgatgagctgtggaccctgggggagggccaggtggtgcgggtgaagtatggaaatgctgatggagagtactgcaagttccccttcctgttcaacgggaaggagtacaacagctgcacagacaccggccgcagtgatggcttcctgtggtgcagcaccacctacaactttgagaaggatggcaagtatggcttctgcccccatgaggccctcttcaccatgggcggcaatgctgagggccagccctgcaagttccccttccgcttccagggcaccagctatgacagctgcaccacagagggccgcacagatggctaccgctggtgtggcaccacagaagattatgaccgggacaagaagtatggcttctgcccagagacagccatgagcacagtgggcggcaacagcgagggcgccccctgtgtgttccccttcaccttcctgggcaacaagtatgagagctgcaccagcgctggccgcagtgatggcaagatgtggtgtgccaccacagccaactatgatgatgacaggaagtggggcttctgcccagaccagggctacagcctcttcctggtggccgcccatgaatttggacatgccatgggcctggagcacagccaggaccccggggccctgatggcccccatctacacctacaccaagaacttccggctgagccaggatgacatcaagggcatccaggagctgtatggagccagcccagacatcgacctgggcaccggccccacccccaccctgggccctgtgaccccagagatctgcaagcaggacatcgtgtttgatggcatcgcccagatccggggggagatcttcttcttcaaggaccgcttcatctggaggacagtgaccccccgggacaagcccatgggccccctgctggtggccaccttctggccagagctgcctgagaagattgatgctgtgtatgaggccccccaggaggagaaggctgtgttctttgctggaaatgagtactggatctacagcgccagcaccctggagcggggctaccccaagcccctgaccagcctgggcctgcccccagatgtgcagagggtggatgctgccttcaactggagcaagaacaagaagacctacatctttgctggggacaagttctggagatacaatgaggtgaagaagaagatggaccccggcttccccaagctgattgctgatgcctggaatgccatcccagacaacctggatgctgtggtggacctgcagggcggcggccacagctacttcttcaagggggcctactacctgaagctggagaaccagagcctgaagtctgtgaagtttggcagcatcaagagtgactggctgggctgctag

SEQ ID NO: 20357 - DNA, 1434 bp, Artificial Sequence
  Description of Artificial Sequence: Synthetic coding sequence
atgaagagcctgcccatcctgctgctgctgtgtgtggccgtgtgcagcgcctaccccctggatggagctgcccggggggaggacacctccatgaacctggtgcagaagtacctggagaactactatgacctgaagaaggatgtgaagcagtttgtgcggaggaaggacagcggccctgtggtgaagaagatccgggagatgcagaagttcctgggcctggaggtgacaggcaagctggacagcgacaccctggaggtgatgaggaagccccgctgtggggtgcctgatgtgggccacttccgcaccttccctggcatccccaagtggaggaagacccacctgacctaccgcatcgtgaactacaccccagacctgcccaaggatgctgtggacagcgctgtggagaaggccctgaaggtgtgggaggaggtgacccccctgaccttcagccggctgtatgaaggagaggccgacatcatgatcagctttgctgtgcgggagcacggggacttctacccctttgatggccctggaaatgtgctggcccacgcctatgcccctggccctggcatcaatggagatgcccactttgatgatgatgagcagtggaccaaggacaccaccggcaccaacctcttcctggtggccgcccacgagatcggccacagcctgggcctcttccacagcgccaacacagaggccctgatgtaccccctgtaccacagcctgacagacctgacccgcttccggctgagccaggatgacatcaatggcatccagagcctgtatggccccccaccagacagccctgagacccccctggtgcccacagagcctgtgcccccagagcccggcaccccagccaactgtgaccctgccctgagctttgatgctgtgtccaccctgcggggggagatcctgatcttcaaggacagacacttctggaggaagagcctgaggaagctggagcctgagctgcacctgatcagcagcttctggcccagcctgcccagcggcgtggatgctgcctatgaggtgaccagcaaggacctggtgttcatcttcaagggcaaccagttctgggccatcagaggaaatgaggtgcgggccggctacccccggggcatccacaccctgggcttcccccccaccgtgaggaagattgatgctgccatcagtgacaaggagaagaacaagacctacttctttgtggaggacaagtactggaggtttgatgagaagagaaattccatggagcccggcttccccaagcagattgctgaggacttccctggcatcgacagcaagattgatgctgtgtttgaggagtttggcttcttctacttcttcaccggcagcagccagctggagtttgaccccaatgccaagaaggtgacccacaccctgaagagcaacagctggctgaactgctag

SEQ ID NO: 20358 - DNA, 804 bp, Artificial Sequence
  Description of Artificial Sequence: Synthetic coding sequence
atgaggctgactgtgctgtgtgctgtgtgcctgctgcccggcagcctggccctgcccctgccccaggaggccggcggcatgtctgagctgcagtgggagcaggcccaggactacctgaagcgcttctacctgtatgattctgagaccaagaatgccaacagcctggaggccaagctgaaggagatgcagaagttcttcggcctgcccatcaccggcatgctgaacagccgggtgattgagatcatgcagaagccccgctgtggggtgcctgatgtggccgagtacagcctcttccccaacagccccaagtggaccagcaaggtggtgacctacagaattgtgtcctacacccgggacctgccccacatcaccgtggaccggctggtgtccaaggccctgaacatgtggggcaaggagatccccctgcacttcaggaaggtggtgtggggcacagctgacatcatgattggatttgcccggggggcccatggagacagctacccctttgatggccctggcaacaccctggcccacgcctttgcccctggcaccggcctgggcggagatgcccactttgatgaagatgagcgctggacagatggcagcagcctgggcatcaacttcctgtatgctgccacccatgagctgggccacagcctgggcatgggccacagcagtgaccccaatgctgtgatgtaccccacctatggaaatggagacccccagaacttcaagctgagccaggatgacatcaagggcatccagaagctgtatggcaagaggagcaacagcaggaagaagtag

SEQ ID NO: 20359 - DNA, 2124 bp, Artificial Sequence
  Description of Artificial Sequence: Synthetic coding sequence
atgagcctgtggcagcccctggtgctggtgctgctggtgctgggctgctgctttgctgccccccggcagaggcagagcaccctggtgctcttccctggggacctgcggaccaacctgacagaccggcagctggccgaggagtacctgtaccgctatggctacaccagggtggccgagatgagaggagagagcaagagcctgggccctgccctgctgctgctgcagaagcagctgagcctgcctgagactggagagctggacagcgccaccctgaaggccatgaggaccccccgctgtggggtgcctgacctgggccgcttccagacctttgaaggagacctgaagtggcaccaccacaacatcacctactggatccagaactacagcgaggacctgcccagggctgtgattgatgatgcctttgcccgggcctttgccctgtggagcgctgtgacccccctgaccttcaccagggtgtacagcagagatgctgacatcgtcatccagtttggagtggccgagcacggagatggctacccctttgatggcaaggatggcctgctggcccacgccttccccccaggccctggcatccagggagatgcccactttgatgatgatgagctgtggagcctgggcaagggcgtggtggtgcccaccaggtttggaaatgctgatggagctgcctgccacttccccttcatctttgagggccgcagctacagcgcctgcaccacagatggccgcagtgatggcctgccctggtgcagcaccacagccaactatgacacagatgaccgcttcggcttctgccccagcgagcggctgtacacccaggatggaaatgctgatggcaagccctgccagttccccttcatcttccagggccagagctacagcgcctgcaccacagatggccgcagtgatggctaccgctggtgtgccaccacagccaactatgaccgggacaagctgtttggcttctgccccaccagggctgacagcacagtgatgggcggcaacagcgctggggagctgtgtgtgttccccttcaccttcctgggcaaggagtacagcacctgcaccagcgagggcagaggagatggccgcctgtggtgtgccaccaccagcaactttgacagcgacaagaagtggggcttctgcccagaccagggctacagcctcttcctggtggccgcccatgaatttggacatgccctgggcctggaccacagctctgtgcctgaggccctgatgtaccccatgtaccgcttcacagagggcccccccctgcacaaggatgatgtgaatggcatccgccacctgtatggccccaggcctgagcctgagcccaggcctcccaccaccaccaccccccagcccacagccccacccaccgtgtgccccaccggcccccccaccgtgcaccccagcgagcggcccacagctggccccaccggcccccccagcgctggccccaccggccccccaacagctggccccagcacagccaccaccgtgcccctgagccctgtggatgatgcctgcaatgtgaacatctttgatgccatcgccgagatcggcaaccagctgtacctgttcaaggatggcaagtactggaggttcagcgagggccggggcagccggccccagggccccttcctgattgctgacaagtggccagccctgcccaggaagctggacagcgtgtttgaggagcggctgagcaagaagctgttcttcttcagcggccggcaggtgtgggtgtacacaggagcctctgtgctgggcccccggcggctggacaagctgggcctgggcgcagatgtggcccaggtgactggagccctgcggagcggccggggcaagatgctgctcttcagcggccggcggctgtggaggtttgatgtgaaggcccagatggtggaccccaggtctgccagcgaggtggacaggatgtttcctggggtgcccctggacacccatgatgtgttccagtaccgggagaaggcctacttctgccaggaccgcttctactggagggtgagcagccgctctgagctgaaccaggtggaccaggtgggctacgtgacctatgacatcctgcagtgcccagaggactag

SEQ ID NO: 20360 - DNA, 834 bp, Artificial Sequence
  Description of Artificial Sequence: Synthetic coding sequence
atgggcggcaacagcgctggggagctgtgtgtgttccccttcaccttcctgggcaaggagtacagcaactttgacagcgacaagaagtggggcttctgcccagaccagggctacagcctcttcctggtggccgcccacgagtttggccacgccctgggcctggaccacagctctgtgcctgaggccctgatgtaccccatgtaccgcttcacagagggcccccccctgcacaaggatgatgtgaatggcatccgccacctgtatggccccaggcctgagcctgagccccggccccccaccaccaccaccccccagcccacagcccccccaacagtgtgccccactggaccacccaccgtgcacccccccttcctgattgctgacaagtggccagccctgcccaggaagctggacagcgtgtttgaggagcggctgagcaagaagctgttcttcttcagcggccggcaggtgtgggtgtacacaggagcctctgtgctgggcccccggcggctggacaagctgggcctgggcgcagatgtggcccaggtgactggagccctgcggagcggccggggcaagatgctgctcttcagcggccggcggctgtggaggtttgatgtgaaggcccagatggtggaccccaggtctgccagcgaggtggacaggatgtttcctggggtgcccctggacacccatgatgtgttccagtaccgggagaaggcctacttctgccaggaccgcttctactggagggtgagcagccgctctgagctgaaccaggtggaccaggtgggctacgtgacctatgacatcctgcagtgcccagaggactag

SEQ ID NO: 20361 - DNA, 324 bp, Artificial Sequence
  Description of Artificial Sequence: Synthetic coding sequence
atggccggggaggatgtgggcgcccccccagaccacctgtgggtgcaccaggagggcatctacagagatgagtaccagaggacctgggtggccgtggtggaggaggagaccagcttcctgcgggcccgggtgcagcagatccaggtgcccctgggagatgctgcccggcccagccacctgctgaccagccagctgcccctgatgtggcagctgtacccagaggagcgctacatggacaacaacagccggctgtggcagatccagcaccacctgatggtgcggggcgtgcaggagctgctgctgaagctgctgcctgatgactag

SEQ ID NO: 20362 - DNA, 324 bp, Artificial Sequence; identical to SEQ ID NO: 20361
  Description of Artificial Sequence: Synthetic coding sequence

SEQ ID NO: 20363 - DNA, 1329 bp, Artificial Sequence
  Description of Artificial Sequence: Synthetic coding sequence
atggtgcgcagccggcagatgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggtgctcttctacctgggccagtacatcatgaccaagaggctgtatgatgagaagcagcagcacatcgtgtactgcagcaatgacctgctgggggacctgtttggagtgcccagcttctctgtgaaggagcacaggaagatctacaccatgatctacagaaacctggtggtggtgaaccagcaggaggagaacagtgatgagctgtctggagagcggcagaggaagaggcacaagagtgacagcatcagcctgagctttgatgagagcctggccctgtgtgtgatccgggagatctgctgtgagaggagcagcagcagcgagagcacaggcacccccagcaacccagacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaggaggaccctgagatcagcctggccgactactggaagtgcaccagctgcaatgagatgaacccccccctgcccagccactgcaaccgctgctgggccctgcgggagaactggctgcctgaagataaaggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20364 - DNA, 1311 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggtgctcttctacctgggccagtacatcatgaccaagaggctgtatgatgagaagcagcagcacatcgtgtactgcagcaatgacctgctgggggacctgtttggagtgcccagcttctctgtgaaggagcacaggaagatctacaccatgatctacagaaacctggtggtggtgaaccagcaggaggagaacagtgatgagctgtctggagagcggcagaggaagaggcacaagagtgacagcatcagcctgagctttgatgagagcctggccctgtgtgtgatccgggagatctgctgtgagaggagcagcagcagcgagagcacaggcacccccagcaacccagacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaggaggaccctgagatcagcctggccgactactggaagtgcaccagctgcaatgagatgaacccccccctgcccagccactgcaaccgctgctgggccctgcgggagaactggctgcctgaagataaaggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20365 - DNA, 966 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaagaagatcctgagatcagcctggccgactactggaagtgcaccagctgcaatgagatgaacccccccctgcccagccactgcaaccgctgctgggccctgcgggagaactggctgcctgaggacaagggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgcgtcatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20366 - DNA, 1359 bp, Artificial Sequence
  Description of Artificial Sequence: Synthetic coding sequence
atggtgcgcagccggcagatgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggagaagatctacaccatgatctacagaaacctggtggtggtgaaccagcaggagagcagtgacagcggcacctctgtgtctgaaaatcgctgccacctggagggcggcagtgaccagaaggacctggtgcaggagctgcaggaggagaagcccagcagcagccacctggtgtcccggcccagcaccagcagcagaagaagagccatcagcgagacagaagaaaattctgatgagctgtctggagagcggcagaggaagaggcacaagagtgacagcatcagcctgagctttgatgagagcctggccctgtgtgtgatccgggagatctgctgtgagaggagcagcagcagcgagagcacaggcacccccagcaacccagacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaggaggaccctgagatcagcctggccgactactggaagtgcaccagctgcaatgagatgaacccccccctgcccagccactgcaaccgctgctgggccctgcgggagaactggctgcctgaagataaaggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20367 - DNA, 771 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggtgctcttctacctgggccagtacatcatgaccaagaggctgtatgatgagaagcagcagcacatcgtgtactgcagcaatgacctgctgggggacctgtttggagtgcccagcttctctgtgaaggagcacaggaagatctacaccatgatctacagaaacctggtggtggtgaaccagcaggagagcagtgacagcggcacctctgtgtctgagaaccgctgccacctggagggcggcagtgaccagaaggacctggtgcaggagctgcaggaggagaagcccagcagcagccacctggtgtcccggcccagcaccagcagcagaagaagagccatcagcgagacagaggagaacagtgatgagctgagcggggagcggcagaggaagaggcacaagagtgacagcatcagcctgagctttgatgagagcctggccctgtgtgtgatccgggagatctgctgtgagaggagcagcagcagcgagagcacaggcacccccagcaacccagacctgctgctgggcgtgtaccaggtgacagtgtaccaggccggggagagtgacacagacagctttgaggaggaccctgagatcagcctggcccactacctgtag

SEQ ID NO: 20368 - DNA, 798 bp, Artificial Sequence
  Description of Artificial Sequence: Synthetic coding sequence
atgtctgtgcccacagatggagctgtgaccaccagccagatcccagccagcgagcaggagaccctggacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggactactggaagtgcaccagctgcaatgagatgaacccccccctgcccagccactgcaaccgctgctgggccctgcgggagaactggctgcctgaggacaagggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgcgtcatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20369 - DNA, 1401 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgctcttctacctgggccagtacatcatgaccaagaggctgtatgatgagaagcagcagcacatcgtgtactgcagcaatgacctgctgggggacctgtttggagtgcccagcttctctgtgaaggagcacaggaagatctacaccatgatctacagaaacctggtggtggtgaaccagcaggagagcagtgacagcggcacctctgtgtctgaaaatcgctgccacctggagggcggcagtgaccagaaggacctggtgcaggagctgcaggaggagaagcccagcagcagccacctggtgtcccggcccagcaccagcagcagaagaagagccatcagcgagacagaagaaaattctgatgagctgtctggagagcggcagaggaagaggcacaagagtgacagcatcagcctgagctttgatgagagcctggccctgtgtgtgatccgggagatctgctgtgagaggagcagcagcagcgagagcacaggcacccccagcaacccagacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaggaggaccctgagatcagcctggccgactactggaagtgcaccagctgcaatgagatgaacccccccctgcccagccactgcaaccgctgctgggccctgcgggagaactggctgcctgaagataaaggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20370 - DNA, 966 bp, Artificial Sequence; identical to SEQ ID NO: 20365
  Description of Artificial Sequence: Synthetic coding sequence

SEQ ID NO: 20371 - DNA, 480 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaagaagatcctgagatcagcctggccgactactggaagtgcctgaagaagaggaacaagccctgccctgtgtgccggcagcccatccagatgattgtgctgacctacttcccctag

SEQ ID NO: 20372 - DNA, 891 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaggaggaccctgagatcagcctggccgactactggaagtgcaccagctgcaatgagatgaacccccccctgcccagccactgcaaccgctgctgggccctgcgggagaactggctgcctgaagataaaggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20373 - DNA, 732 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggactactggaagtgcaccagctgcaatgagatgaacccccccctgcccagccactgcaaccgctgctgggccctgcgggagaactggctgcctgaggacaagggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgcgtcatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20374 - DNA, 657 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggactactggaagtgcaccagctgcaatgagatgaacccccccctgcccagccactgcaaccgctgctgggccctgcgggagaactggctgcctgaagataaaggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20375 - DNA, 657 bp, Artificial Sequence; identical to SEQ ID NO: 20374
  Description of Artificial Sequence: Synthetic coding sequence

SEQ ID NO: 20376 - DNA, 771 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggtgctcttctacctgggccagtacatcatgaccaagaggctgtatgatgagaagcagcagcacatcgtgtactgcagcaatgacctgctgggggacctgtttggagtgcccagcttctctgtgaaggagcacaggaagatctacaccatgatctacagaaacctggtggtggtgaaccagcaggagagcagtgacagcggcacctctgtgtctgagaaccgctgccacctggagggcggcagtgaccagaaggacctggtgcaggagctgcaggaggagaagcccagcagcagccacctggtgtcccggcccagcaccagcagcagaagaagagccatcagcgagacagaggagaacagtgatgagctgagcggggagcggcagaggaagaggcacaagagtgacagcatcagcctgagctttgatgagagcctggccctgtgtgtgatccgggagatctgctgtgagaggagcagcagcagcgagagcacaggcacccccagcaacccagacctggatgctggggtgtaccaggtgacagtgtaccaggccggggagagtgacacagacagctttgaggaggaccctgagatcagcctggccgactactggtag

SEQ ID NO: 20377 - DNA, 813 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggactactggaagtgcaccagctgcaatgagatgaacccccccctgcccagccactgcaaccgctgctgggccctgcgggagaactggctgcctgaagataaaggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20378 - DNA, 1494 bp, Artificial Sequence
  Description of Artificial Sequence: Synthetic coding sequence
atggtgcgcagccggcagatgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggtgctcttctacctgggccagtacatcatgaccaagaggctgtatgatgagaagcagcagcacatcgtgtactgcagcaatgacctgctgggggacctgtttggagtgcccagcttctctgtgaaggagcacaggaagatctacaccatgatctacagaaacctggtggtggtgaaccagcaggagagcagtgacagcggcacctctgtgtctgagaaccgctgccacctggagggcggcagtgaccagaaggacctggtgcaggagctgcaggaggagaagcccagcagcagccacctggtgtcccggcccagcaccagcagcagaagaagagccatcagcgagacagaggagaacagtgatgagctgagcggggagcggcagaggaagaggcacaagagtgacagcatcagcctgagctttgatgagagcctggccctgtgtgtgatccgggagatctgctgtgagaggagcagcagcagcgagagcacaggcacccccagcaacccagacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaagaagatcctgagatcagcctggccgactactggaagtgcaccagctgcaatgagatgaacccccccctgcccagccactgcaaccgctgctgggccctgcgggagaactggctgcctgaggacaagggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgcgtcatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20379 - DNA, 393 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20380 - DNA, 774 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggaggtgctcttctacctgggccagtacatcatgaccaagaggctgtatgatgagaagcagcagcacatcgtgtactgcagcaatgacctgctgggggacctgtttggagtgcccagcttctctgtgaaggagcacaggaagatctacaccatgatctacagaaacctggtggtggtgaaccagcaggagagcagtgacagcggcacctctgtgtctgagaaccgctgccacctggagggcggcagtgaccagaaggacctggtgcaggagctgcaggaggagaagcccagcagcagccacctggtgtcccggcccagcaccagcagcagaagaagagccatcagcgagacagaggagaacagtgatgagctgagcggggagcggcagaggaagaggcacaagagtgacagcatcagcctgagctttgatgagagcctggccctgtgtgtgatccgggagatctgctgtgagaggagcagcagcagcgagagcacaggcacccccagcaacccagacctggatgctggggtgtctgagcacagcggggactggctggaccaggacagcgtgtctgaccagttctctgtggagtttgaggtggagagcctggacagcgagtag

SEQ ID NO: 20381 - DNA, 891 bp, Artificial Sequence; identical to SEQ ID NO: 20372
  Description of Artificial Sequence: Synthetic coding sequence

SEQ ID NO: 20382 - DNA, 1341 bp, Artificial Sequence
  Description of Artificial Sequence: Synthetic coding sequence
atgtgcaacaccaacatgtctgtgcccacagatggagctgtgaccaccagccagatcccagccagcgagcaggagaccctggtgcggcccaagcccctgctgctgaagctgctgaagtctgtgggcgcccagaaggacacctacaccatgaaggagaagatctacaccatgatctacagaaacctggtggtggtgaaccagcaggagagcagtgacagcggcacctctgtgtctgaaaatcgctgccacctggagggcggcagtgaccagaaggacctggtgcaggagctgcaggaggagaagcccagcagcagccacctggtgtcccggcccagcaccagcagcagaagaagagccatcagcgagacagaagaaaattctgatgagctgtctggagagcggcagaggaagaggcacaagagtgacagcatcagcctgagctttgatgagagcctggccctgtgtgtgatccgggagatctgctgtgagaggagcagcagcagcgagagcacaggcacccccagcaacccagacctggatgctggggtgtctgagcacagcggggactggctggaccaggacagcgtgtctgaccagttctctgtggagtttgaggtggagagcctggacagcgaggactacagcctgtctgaggagggccaggagctgagtgatgaagatgatgaggtgtaccaggtgacagtgtaccaggccggggagagtgacacagacagctttgaggaggaccctgagatcagcctggccgactactggaagtgcaccagctgcaatgagatgaacccccccctgcccagccactgcaaccgctgctgggccctgcgggagaactggctgcctgaagataaaggcaaggacaagggggagatcagcgagaaggccaagctggagaacagcacccaggccgaggagggctttgatgtgcctgactgcaagaagaccatcgtgaatgacagccgggagagctgtgtggaggagaatgatgacaagatcacccaggccagccagagccaggagagcgaggactacagccagcccagcaccagcagcagcatcatctacagcagccaggaggatgtgaaggagtttgagcgggaggagacccaggacaaggaggagagcgtggagagcagcctgcccctgaatgccatcgagccctgtgtgatctgccagggccggcccaagaatggctgcatcgtgcacggcaagacaggccacctgatggcctgcttcacctgtgccaagaagctgaagaagaggaacaagccctgccctgtgtgccggcagcccatccagatgattgtgctgacctacttcccctag

SEQ ID NO: 20383 - DNA, 642 bp, Artificial Sequence
  Description of Artificial Sequence: Synthetic coding sequence
atgcccaactttgtggtggactggagggtgtacacagacagcctcttcctgactgtggactttggcctgtgtgccgaggagagcagcaccagcaggaagaggaccacagaagatgacatccccaccctgcccaccagcgagcacaagtgcatccacagcagagaagatgaggacctgattgagaacctggcccaggatgagaccagccggctggacctgggctttgaggagtgggatgtggccggcctgccctggtggttcctgggcaacctgcggagcaactacacccccaggagcaatggcagcacagacctgcagaccaaccaggatgtgggcacagccatcgtgtctgacaccacagatgacctgtggttcctgaatgaatctgtgtctgagcagctgggcgtgggcatcaaggtggaggccgctgacacagagcagaccagcgaggaggtgggcaaggtgtctgacaagaaggtgattgaggtgggcaagaatgatgacctggaggacagcaagagcctgagtgatgacacagatgtggaggtgaccagtgaagatgagtggcagtgcacagagtgcaagaagttcaacagccccagcaagcgctactgcttccgctgctgggccctgaggaagtag

SEQ ID NO: 20384 - DNA, 396 bp, Artificial Sequence
  Description of Artificial Sequence: Synthetic coding sequence
atgaccagcttcagcaccagcgcccagtgcagcaccagtgacagcgcctgccgcatcagccctggccagatcaaccaggtgcggcccaagctgcccctgctgaagatcctgcatgctgctggggcccagggcgagatgttcaccgtgaaggaggtgatgcactacctgggccagtacatcatggtgaagcagctgtatgaccagcaggagcagcacatggtgtactgcggcggggacctgctgggggagctgctgggccggcagagcttctctgtgaaggaccccagccccctgtatgacatgctgaggaagaacctggtgaccctggccacagccaccacagagatgggccacctgttctgccgcatcagccacgccctggagctggccgactag

SEQ ID NO: 20385 - DNA, 1473 bp, Artificial Sequence
  Description of Artificial Sequence: Synthetic coding sequence
atgaccagcttcagcaccagcgcccagtgcagcaccagtgacagcgcctgccgcatcagccctggccagatcaaccaggtgcggcccaagctgcccctgctgaagatcctgcatgctgctggggcccagggcgagatgttcaccgtgaaggaggtgatgcactacctgggccagtacatcatggtgaagcagctgtatgaccagcaggagcagcacatggtgtactgcggcggggacctgctgggggagctgctgggccggcagagcttctctgtgaaggaccccagccccctgtatgacatgctgaggaagaacctggtgaccctggccacagccaccacagatgctgcccagaccctggccctggcccaggaccacagcatggacatccccagccaggaccagctgaagcagagcgctgaggagagcagcaccagcaggaagaggaccacagaagatgacatccccaccctgcccaccagcgagcacaagtgcatccacagccgggaggatgaggacctgattgagaacctggcccaggatgagaccagccggctggacctgggctttgaggagtgggatgtggccggcctgccctggtggttcctgggcaacctgcggagcaactacacccccaggagcaatggcagcacagacctgcagaccaaccaggatgtgggcacagccatcgtgtctgacaccacagatgacctgtggttcctgaatgaatctgtgtctgagcagctgggcgtgggcatcaaggtggaggccgctgacacagagcagaccagcgaggaggtgggcaaggtgtctgacaagaaggtgattgaggtgggcaagaatgatgacctggaggacagcaagagcctgagtgatgacacagatgtggaggtgaccagtgaagatgagtggcagtgcacagagtgcaagaagttcaacagccccagcaagcgctactgcttccgctgctgggccctgaggaaggactggtacagcgactgcagcaagctgacccacagcctgagcaccagtgacatcacagccatccctgagaaggaaaatgaaggaaatgatgtgcctgactgcaggaggaccatcagcgcccctgtggtgcggcccaaggatgcctacatcaagaaggagaacagcaagctgtttgacccctgcaacagcgtggagttcctggacctggcccacagcagcgagagccaggagaccatcagctccatgggagagcagctggacaacctgtctgagcagaggacagacacagagaacatggaggactgccagaacctgctgaagccctgcagcctgtgtgagaagaggcccagagatggcaacatcatccacggccgcacaggccacctggtgacctgcttccactgtgcccggcggctgaagaaggccggggccagctgccccatctgcaagaaggagatccagctggtgatcaaggtgttcatcgcctag

SEQ ID NO: 20386 - DNA, 495 bp, Artificial Sequence
  Description of Artificial Sequence: Synthetic coding sequence
atgaccagcttcagcaccagcgcccagtgcagcaccagtgacagcgcctgccgcatcagccctggccagatcaaccaggagaatgaaggaaatgatgtgcctgactgcaggaggaccatcagcgcccctgtggtgcggcccaaggatgcctacatcaagaaggagaacagcaagctgtttgacccctgcaacagcgtggagttcctggacctggcccacagcagcgagagccaggagaccatcagctccatgggagagcagctggacaacctgtctgagcagaggacagacacagagaacatggaggactgccagaacctgctgaagccctgcagcctgtgtgagaagaggcccagagatggcaacatcatccacggccgcacaggccacctggtgacctgcttccactgtgcccggcggctgaagaaggccggggccagctgccccatctgcaagaaggagatccagctggtgatcaaggtgttcatcgcctag

SEQ ID NO: 20387 - DNA, 423 bp, Artificial Sequence
  Description of Artificial Sequence: Synthetic coding sequence
atgaccagcttcagcaccagcgcccagtgcagcaccagtgacagcgcctgccgcatcagccctggccagatcaaccaggtgcggcccaagctgcccctgctgaagatcctgcatgctgctggggcccagggcgagatgttcaccgtgaaggaggtgatgcactacctgggccagtacatcatggtgaagcagctgtatgaccagcaggagcagcacatggtgtactgcggcggggacctgctgggggagctgctgggccggcagagcttctctgtgaaggaccccagccccctgtatgacatgctgaggaagaacctggtgaccctggccacagccaccacagccaagtgccggggcaagttccacttccagaagaagaactacagaagacgctacccccacacagcctacctgcgggcctag

SEQ ID NO: 20388 - DNA, 516 bp, Artificial Sequence
  Description of Artificial Sequence: Synthetic coding sequence
gacctgattgagaacctggcccaggatgagaccagccggctggacctgggctttgaggagtgggatgtggccggcctgccctggtggttcctgggcaacctgcggagcaactacacccccaggagcaatggcagcacagacctgcagaccaaccaggtgattgaggtgggcaagaatgatgacctggaggacagcaagagcctgagtgatgacacagatgtggaggtgaccagtgaagatgagtggcagtgcacagagtgcaagaagttcaacagccccagcaagcgctactgcttccgctgctgggccctgaggaaggactggtacagcgactgcagcaagctgacccacagcctgagcaccagtgacatcacagccatccctgagaaggaaaatgaaggaaatgatgtgcctgactgcaggaggaccatcagcgcccctgtggtgcggcccaaggatgcctacatcaagaaggagaacagcaagctgtttgacccctgcaacagcgtggagtag

SEQ ID NO: 20389 - DNA, 1323 bp, Artificial Sequence
  Description of Artificial Sequence: Synthetic coding sequence
atgaccagcttcagcaccagcgcccagtgcagcaccagtgacagcgcctgccgcatcagccctggccagatcaaccaggtgcggcccaagctgcccctgctgaagatcctgcatgctgctggggcccagggcgagatgttcaccgtgaaggaggtgatgcactacctgggccagtacatcatggtgaagcagctgtatgaccagcaggagcagcacatggtgtactgcggcggggacctgctgggggagctgctgggccggcagagcttctctgtgaaggaccccagccccctgtatgacatgctgaggaagaacctggtgaccctggccacagccaccacagatgctgcccagaccctggccctggcccaggaccacagcatggacatccccagccaggaccagctgaagcagagcgctgaggagagcagcaccagcaggaagaggaccacagaagatgacatccccaccctgcccaccagcgagcacaagtgcatccacagccgggaggatgaggacctgattgagaacctggcccaggatgagaccagccggctggacctgggctttgaggagtgggatgtggccggcctgccctggtggttcctgggcaacctgcggagcaactacacccccaggagcaatggcagcacagacctgcagaccaaccaggtgattgaggtgggcaagaatgatgacctggaggacagcaagagcctgagtgatgacacagatgtggaggtgaccagtgaagatgagtggcagtgcacagagtgcaagaagttcaacagccccagcaagcgctactgcttccgctgctgggccctgaggaaggactggtacagcgactgcagcaagctgacccacagcctgagcaccagtgacatcacagccatccctgagaaggaaaatgaaggaaatgatgtgcctgactgcaggaggaccatcagcgcccctgtggtgcggcccaaggatgcctacatcaagaaggagaacagcaagctgtttgacccctgcaacagcgtggagttcctggacctggcccacagcagcgagagccaggagaccatcagctccatgggagagcagctggacaacctgtctgagcagaggacagacacagagaacatggaggactgccagaacctgctgaagccctgcagcctgtgtgagaagaggcccagagatggcaacatcatccacggccgcacaggccacctggtgacctgcttccactgtgcccggcggctgaagaaggccggggccagctgccccatctgcaagaaggagatccagctggtgatcaaggtgttcatcgcctag

SEQ ID NO: 20390 - DNA, 384 bp, Artificial Sequence
  Description of Artificial Sequence: Synthetic coding sequence
atgaccagcttcagcaccagcgcccagtgcagcaccagtgacagcgcctgccgcatcagccctggccagatcaaccaggtgcggcccaagctgcccctgctgaagatcctgcatgctgctggggcccagggcgagatgttcaccgtgaaggaggtgatgcactacctgggccagtacatcatggtgaagcagctgtatgaccagcaggagcagcacatggtgtactgcggcggggacctgctgggggagctgctgggccggcagagcttctctgtgaaggaccccagccccctgtatgacatgctgaggaagaacctggtgaccctggccacagccaccaccggctgccagaggagagtgaatggcccccagagggcctggtag

SEQ ID NO: 20391 - DNA, 462 bp, Artificial Sequence
  Description of Artificial Sequence: Synthetic coding sequence
atgaccagcttcagcaccagcgcccagtgcagcaccagtgacagcgcctgccgcatcagccctggccagatcaaccaggtgcggcccaagctgcccctgctgaagatcctgcatgctgctggggcccagggcgagatgttcaccgtgaaggaggtgatgcactacctgggccagtacatcatggtgaagcagctgtatgaccagcaggagcagcacatggtgtactgcggcggggacctgctgggggagctgctgggccggcagagcttctctgtgaaggaccccagccccctgtatgacatgctgaggaagaacctggtgaccctggccacagccaccaccggcagccagtatggctacagcaagagccggcccacagaggccaagtgccggggcaagttccacttccagaagaagaactacagaagacgctacccccacacagcctacctgcgggcctag

SEQ ID NO: 20392 - DNA, 7650 bp, Artificial Sequence
  Description of Artificial Sequence: Synthetic coding sequence
atgctgggcaccggccctgctgctgccaccacagctgccaccaccagcagcaatgtgtctgtgctgcagcagtttgccagcggcctgaagagcagaaatgaggagacccgggccaaggccgccaaggagctgcagcactacgtgaccatggagctgcgggagatgagccaggaggagagcacccgcttctatgaccagctgaaccaccacatctttgagctggtgagcagcagtgatgccaatgaaaggaagggcggcatcctggccatcgccagcctcatcggcgtggagggcggcaatgccacccgcatcggccgctttgccaactacctgaggaacctgctgcccagcaatgaccctgtggtgatggagatggccagcaaggccatcggccgcctggccatggccggggacaccttcaccgcagaatatgtggagtttgaggtgaagagggccctggagtggctgggcgctgacagaaatgaaggaagaagacatgctgctgtgctggtgctgcgggagctggccatctctgtgcccaccttcttcttccagcaggtgcagcccttctttgacaacatctttgtggccgtgtgggaccccaagcaggccatccgggagggcgctgtggccgccctgcgggcctgcctgatcctgaccacccagcgggagcccaaggagatgcagaagccccagtggtaccgccacacctttgaggaggccgagaagggctttgatgagaccctggccaaggagaagggcatgaacagagatgaccgcatccacggggccctgctgatcctgaatgagctggtgcgcatcagctccatggagggggagcggctgcgggaggagatggaggagatcacccagcagcagctggtgcatgacaagtactgcaaggacctgatgggcttcggcaccaagcccaggcacatcacccccttcaccagcttccaggccgtgcagccccagcagagcaatgccctggtgggcctgctgggctacagcagccaccagggcctgatgggcttcggcaccagccccagccctgccaagagcaccctggtggagagccgctgctgccgggacctgatggaggagaagtttgaccaggtgtgccagtgggtgctgaagtgcaggaacagcaagaacagcctcatccagatgaccatcctgaacctgctgccccggctggccgccttccggcccagcgccttcacagacacccagtacctgcaggacaccatgaaccacgtgctgagctgtgtgaagaaggagaaggagaggacagctgccttccaggccctgggcctgctgtctgtggccgtgcgctctgagttcaaggtgtacctgccccgggtgctggacatcatccgggccgccctgccccccaaggactttgcccacaagaggcagaaggccatgcaggtggatgccaccgtcttcacctgcatctccatgctggcccgggccatgggccctggcatccagcaggacatcaaggagctgctggagcccatgctggccgtgggcctgagccctgccctgacagctgtgctgtatgacctgagccggcagatcccccagctgaagaaggacatccaggacggcctgctgaagatgctgagcctggtgctgatgcacaagcccctgcggcaccctggcatgcccaagggcctggcccaccagctggccagccctggcctgaccaccctgcctgaggccagtgatgtgggcagcatcaccctggccctgcggaccctgggcagctttgaatttgagggccacagcctgacccagtttgtgcgccactgtgccgaccacttcctgaacagcgagcacaaggagatccgcatggaggccgcccggacctgcagccggctgctgacccccagcatccacctgatcagcggccacgcccacgtggtgtcccagacagctgtgcaggtggtggctgatgtgctgagcaagctgctggtggtgggcatcacagatcctgaccctgacatccgctactgtgtgctggccagcctggatgaaagatttgatgcccacctggcccaggccgagaacctgcaggccctgtttgtggccctgaatgaccaggtgtttgagatccgggagctggccatctgcaccgtgggccgcctgagctccatgaacccagcctttgtgatgcccttcctgaggaagatgctgatccagatcctgacagagctggagcacagcggcatcggccgcatcaaggagcagagcgccaggatgctgggccacctggtgtccaatgcccccaggctcatccggccctacatggagcccatcctgaaggccctgatcctgaagctgaaggaccctgaccctgaccccaaccctggggtcatcaacaacgtgctggccaccatcggggagctggcccaggtgtctggcctggagatgaggaagtgggtggatgagctgttcatcatcatcatggacatgctgcaggacagcagcctgctggccaagaggcaggtggccctgtggaccctgggccagctggtggccagcacaggctacgtggtggagccctacaggaagtaccccaccctgctggaggtgctgctgaacttcctgaagacagagcagaaccagggcacccggcgggaggccatccgggtgctgggcctgctgggcgccctggacccctacaagcacaaggtgaacatcggcatgattgaccagagcagagatgccagcgctgtgtccctgtctgagagcaagagcagccaggacagcagtgactacagcaccagcgagatgctggtgaacatgggcaacctgcccctggatgagttctacccagctgtgtccatggtggccctgatgaggatcttccgggaccagagcctgagccaccaccacaccatggtggtgcaggccatcaccttcatcttcaagagcctgggcctgaagtgtgtgcagttcctgccccaggtgatgcccaccttcctgaatgtcatccgggtgtgtgatggagccatccgggagttcctgttccagcagctgggcatgctggtgtcctttgtgaagagccacatccggccctacatggatgagatcgtgaccctgatgagggagttctgggtgatgaacaccagcatccagagcaccatcatcctgctgattgagcagatcgtggtggccctgggcggggagttcaagctgtacctgccccagctgatcccccacatgctgcgggtcttcatgcatgacaacagccctggaagaattgtgtccatcaagctgctggccgccatccagctgtttggagccaacctggatgactacctgcacctgctgctgccccccatcgtgaagctgtttgatgcccctgaggcccccctgcccagcaggaaggccgccctggagaccgtggaccggctgacagagagcctggacttcacagattatgccagccgcatcatccaccccatcgtgaggaccctggaccagagccctgagctgcggagcacagccatggacaccctgagcagcctggtgttccagctgggcaagaagtaccagatcttcatccccatggtgaacaaggtgctggtgcgccaccgcatcaaccaccagagatatgatgtgctgatctgccgcatcgtgaagggctacaccctggctgatgaggaggaggaccccctcatctaccagcacaggatgctgcggagcggccagggagatgccctggccagcggccctgtggagaccggccccatgaagaagctgcacgtgtccaccatcaacctgcagaaggcctggggcgccgccaggagagtgtccaaggatgactggctggagtggctgcggcggctgagcctggagctgctgaaggacagcagcagccccagcctgcggagctgctgggccctggcccaggcctacaaccccatggcccgggacctcttcaatgctgcctttgtgtcctgctggagcgagctgaatgaagaccagcaggatgagctgatccgcagcattgagctggccctgaccagccaggacattgctgaggtgacccagaccctgctgaacctggccgagttcatggagcacagcgacaagggccccctgcccctgagagatgacaatggcatcgtgctgctgggggagagagctgccaagtgccgggcctatgccaaggccctgcactacaaggagctggagttccagaagggccccaccccagccatcctggagagcctcatcagcatcaacaacaagctgcagcagcctgaggccgccgccggcgtgctggagtatgccatgaagcactttggagagctggagatccaggccacctggtatgagaagctgcacgagtgggaggatgccctggtggcctatgacaagaagatggacaccaacaaggatgatcctgagctgatgctgggccgcatgcgctgcctggaggccctgggggagtggggccagctgcaccagcagtgctgtgagaagtggaccctggtgaatgatgagacccaggccaagatggccaggatggctgctgctgctgcctggggcctgggccagtgggacagcatggaggagtacacctgcatgatcccccgggacacccatgatggagccttctacagagctgtgctggccctgcaccaggacctcttcagcctggcccagcagtgcatcgacaaggcccgggacctgctggatgctgagctgacagccatggccggggagagctacagccgggcctatggagccatggtgtcctgccacatgctgtctgagctggaggaggtgatccagtacaagctggtgcctgagcggcgggagatcatccggcagatctggtgggagcggctgcagggctgccagagaattgtggaggactggcagaagatcctgatggtgcgcagcctggtggtgagcccccatgaggacatgaggacctggctgaagtatgccagcctgtgtgggaagagcggccgcctggccctggcccacaagaccctggtgctgctgctgggcgtggaccccagccggcagctggaccaccccctgcccaccgtgcacccccaggtgacctacgcctacatgaagaacatgtggaagagcgccaggaagattgatgccttccagcacatgcagcactttgtgcagaccatgcagcagcaggcccagcacgccatcgccacagaggaccagcagcacaagcaggagctgcacaagctgatggcccgctgcttcctgaagctgggggagtggcagctgaacctgcagggcatcaatgaaagcaccatccccaaggtgctgcagtactacagcgctgccacagaacatgaccgctcctggtacaaggcctggcacgcctgggccgtgatgaactttgaggccgtgctgcactacaagcaccagaaccaggccagagatgagaagaagaagctgcggcatgccagcggggccaacatcaccaatgccaccacagctgccaccacagctgccacagccaccaccacagccagcacagagggcagcaacagcgagagcgaggccgagagcacagagaacagccccacccccagccccctgcagaagaaggtgacagaggacctgagcaagaccctgctgatgtacacagtgcctgctgtgcagggcttcttccgcagcatcagcctgagccggggcaacaacctgcaggacaccctgcgggtgctgaccctgtggtttgattatggccactggccagatgtgaatgaggccctggtggagggcgtgaaggccatccagattgacacctggctgcaggtgatcccccagctgattgccagaattgacaccccccggcccctggtgggccgcctcatccaccagctgctgacagacatcggccgctaccacccccaggccctgatctaccccctgactgtggccagcaagagcaccaccacagcccggcacaatgctgccaacaagatcctgaagaacatgtgtgagcacagcaacaccctggtgcagcaggccatgatggtgtctgaggagctgatccgggtggccatcctgtggcatgagatgtggcatgagggcctggaggaggccagccggctgtactttggagagagaaatgtgaagggcatgtttgaggtgctggagcccctgcacgccatgatggagcggggcccccagaccctgaaggagaccagcttcaaccaggcctacggccgggacctgatggaggcccaggagtggtgcaggaagtacatgaagtctggaaatgtgaaggacctgacccaggcctgggacctgtactaccacgtgttccgccgcatcagcaagcagctgccccagctgaccagcctggagctgcagtatgtgagccccaagctgctgatgtgccgggacctggagctggccgtgcccggcacctatgaccccaaccagcccatcatccgcatccagagcatcgcccccagcctgcaggtgatcaccagcaagcagaggcccaggaagctgaccctgatgggcagcaatggccacgagtttgtgttcctgctgaagggccacgaggacctgcggcaggatgagcgggtgatgcagctgtttggcctggtgaacaccctgctggccaatgaccccaccagcctgaggaagaacctgagcatccagagatatgctgtgatccccctgagcaccaacagcggcctgattggctgggtgccccactgtgacaccctgcacgccctgatccgggactaccgggagaagaagaagatcctgctgaacatcgagcaccgcatcatgctgaggatggccccagactatgaccacctgaccctgatgcagaaggtggaggtgtttgaacatgctgtgaacaacacagctggagatgacctggccaagctgctgtggctgaagagccccagcagcgaggtgtggtttgacaggaggaccaactacaccaggagcctggccgtgatgtccatggtgggctacatcctgggcctgggggacagacaccccagcaacctgatgctggaccggctgagcggcaagatcctgcacatcgactttggagactgctttgaggtggccatgacccgggagaagtttcctgagaagatccccttccggctgaccaggatgctgaccaatgccatggaggtgacaggcctggatggcaactaccgcatcacctgccacacagtgatggaggtgctgcgggagcacaaggacagcgtgatggctgtgctggaggcctttgtgtatgaccccctgctgaactggaggctgatggacaccaacaccaagggcaacaagaggagcaggaccaggacagacagctacagcgctggccagagcgtggagatcctggatggagtggagctgggggagcccgcccacaagaagacaggcaccaccgtgcctgagagcatccacagcttcatcggagatggcctggtgaagccagaggccctgaacaagaaggccatccagatcatcaacagagtgcgggacaagctgaccggccgggacttcagccatgatgacaccctggatgtgcccacccaggtggagctgctgatcaagcaggccaccagccatgagaacctgtgccagtgctacatcggctggtgccccttctggtag

SEQ ID NO: 20393 - DNA, 2265 bp, Artificial Sequence
  Description of Artificial Sequence: Synthetic coding sequence
atgaactttgaagctgtgctgcactacaagcaccagaaccaggccagagatgagaagaagaagctgcggcatgccagcggggccaacatcaccaatgccaccacagctgccaccacagctgccacagccaccaccacagccagcacagagggcagcaacagcgagagcgaggccgagagcacagagaacagccccacccccagccccctgcagaagaaggtgacagaggacctgagcaagaccctgctgatgtacacagtgcctgctgtgcagggcttcttccgcagcatcagcctgagccggggcaacaacctgcaggacaccctgcgggtgctgaccctgtggtttgattatggccactggccagatgtgaatgaggccctggtggagggcgtgaaggccatccagattgacacctggctgcaggtgatcccccagctgattgccagaattgacaccccccggcccctggtgggccgcctcatccaccagctgctgacagacatcggccgctaccacccccaggccctgatctaccccctgactgtggccagcaagagcaccaccacagcccggcacaatgctgccaacaagatcctgaagaacatgtgtgagcacagcaacaccctggtgcagcaggccatgatggtgtctgaggagctgatccgggtggccatcctgtggcatgagatgtggcatgagggcctggaggaggccagccggctgtactttggagagagaaatgtgaagggcatgtttgaggtgctggagcccctgcacgccatgatggagcggggcccccagaccctgaaggagaccagcttcaaccaggcctacggccgggacctgatggaggcccaggagtggtgcaggaagtacatgaagtctggaaatgtgaaggacctgacccaggcctgggacctgtactaccacgtgttccgccgcatcagcaagcagctgccccagctgaccagcctggagctgcagtatgtgagccccaagctgctgatgtgccgggacctggagctggccgtgcccggcacctatgaccccaaccagcccatcatccgcatccagagcatcgcccccagcctgcaggtgatcaccagcaagcagaggcccaggaagctgaccctgatgggcagcaatggacatgaatttgtgttcctgctgaagggccacgaggacctgcggcaggatgagcgggtgatgcagctgtttggcctggtgaacaccctgctggccaatgaccccaccagcctgaggaagaacctgagcatccagagatatgctgtgatccccctgagcaccaacagcggcctcatcggctgggtgccccactgtgacaccctgcacgccctgatccgggactaccgggagaagaagaagatcctgctgaacatcgagcaccgcatcatgctgaggatggccccagactatgaccacctgaccctgatgcagaaggtggaggtgtttgagcacgctgtgaacaacacagctggagatgacctggccaagctgctgtggctgaagagccccagcagcgaggtgtggtttgacaggaggaccaactacaccaggagcctggccgtgatgtccatggtgggctacatcctgggcctgggggacagacaccccagcaacctgatgctggaccggctgagcggcaagatcctgcacatcgactttggagactgctttgaggtggccatgacccgggagaagtttcctgagaagatccccttccggctgaccaggatgctgaccaatgccatggaggtgacaggcctggatggcaactaccgcatcacctgccacacagtgatggaggtgctgcgggagcacaaggacagcgtgatggctgtgctggaggcctttgtgtatgaccccctgctgaactggaggctgatggacaccaacaccaagggcaacaagaggagcaggaccaggacagacagctacagcgctggccagagcgtggagatcctggatggagtggagctgggggagcccgcccacaagaagacaggcaccaccgtgcctgagagcatccacagcttcatcggagatggcctggtgaagccagaggccctgaacaagaaggccatccagatcatcaacagagtgcgggacaagctgaccggccgggacttcagccatgatgacaccctggatgtgcccacccaggtggagctgctgatcaagcaggccaccagccatgagaacctgtgccagtgctacatcggctggtgccccttctggtag

SEQ ID NO: 20394 - DNA, 486 bp, Artificial Sequence
  Description of Artificial Sequence: Synthetic coding sequence
atgctggaccggctgagcggcaagatcctgcacatcgactttggagactgctttgaggtggccatgacccgggagaagtttcctgagaagatccccttccggctgaccaggatgctgaccaatgccatggaggtgacaggcctggatggcaactaccgcatcacctgccacacagtgatggaggtgctgcgggagcacaaggacagcgtgatggctgtgctggaggcctttgtgtatgaccccctgctgaactggaggctgatggacaccaacaccaagggcaacaagaggagcaggaccaggacagacagctacagcgctggccagagcgtggagatcctggatggagtggagctgggggagcccgcccacaagaagacaggcaccaccgtgcctgagagcatccacagcttcatcggagatggcctggtgaagccagaggccctgaacaagaaggccatccagatcatcaacagagtgaggtag

SEQ ID NO: 20395 - DNA, 5187 bp, Artificial Sequence
  Description of Artificial Sequence: Synthetic coding sequence
atgctgggcaccggccctgctgctgccaccacagctgccaccaccagcagcaatgtgtctgtgctgcagcagtttgccagcggcctgaagagcagaaatgaggagacccgggccaaggccgccaaggagctgcagcactacgtgaccatggagctgcgggagatgagccaggaggagagcacccgcttctatgaccagctgaaccaccacatctttgagctggtgagcagcagtgatgccaatgaaaggaagggcggcatcctggccatcgccagcctcatcggcgtggagggcggcaatgccacccgcatcggccgctttgccaactacctgaggaacctgctgcccagcaatgaccctgtggtgatggagatggccagcaaggccatcggccgcctggccatggccggggacaccttcaccgcagaatatgtggagtttgaggtgaagagggccctggagtggctgggcgctgacagaaatgaaggaagaagacatgctgctgtgctggtgctgcgggagctggccatctctgtgcccaccttcttcttccagcaggtgcagcccttctttgacaacatctttgtggccgtgtgggaccccaagcaggccatccgggagggcgctgtggccgccctgcgggcctgcctgatcctgaccacccagcgggagcccaaggagatgcagaagccccagtggtaccgccacacctttgaggaggccgagaagggctttgatgagaccctggccaaggagaagggcatgaacagagatgaccgcatccacggggccctgctgatcctgaatgagctggtgcgcatcagctccatggagggggagcggctgcgggaggagatggaggagatcacccagcagcagctggtgcatgacaagtactgcaaggacctgatgggcttcggcaccaagcccaggcacatcacccccttcaccagcttccaggccgtgcagccccagcagagcaatgccctggtgggcctgctgggctacagcagccaccagggcctgatgggcttcggcaccagccccagccctgccaagagcaccctggtggagagccgctgctgccgggacctgatggaggagaagtttgaccaggtgtgccagtgggtgctgaagtgcaggaacagcaagaacagcctcatccagatgaccatcctgaacctgctgccccggctggccgccttccggcccagcgccttcacagacacccagtacctgcaggacaccatgaaccacgtgctgagctgtgtgaagaaggagaaggagaggacagctgccttccaggccctgggcctgctgtctgtggccgtgcgctctgagttcaaggtgtacctgccccgggtgctggacatcatccgggccgccctgccccccaaggactttgcccacaagaggcagaaggccatgcaggtggatgccaccgtcttcacctgcatctccatgctggcccgggccatgggccctggcatccagcaggacatcaaggagctgctggagcccatgctggccgtgggcctgagccctgccctgacagctgtgctgtatgacctgagccggcagatcccccagctgaagaaggacatccaggacggcctgctgaagatgctgagcctggtgctgatgcacaagcccctgcggcaccctggcatgcccaagggcctggcccaccagctggccagccctggcctgaccaccctgcctgaggccagtgatgtgggcagcatcaccctggccctgcggaccctgggcagctttgaatttgagggccacagcctgacccagtttgtgcgccactgtgccgaccacttcctgaacagcgagcacaaggagatccgcatggaggccgcccggacctgcagccggctgctgacccccagcatccacctgatcagcggccacgcccacgtggtgtcccagacagctgtgcaggtggtggctgatgtgctgagcaagctgctggtggtgggcatcacagatcctgaccctgacatccgctactgtgtgctggccagcctggatgaaagatttgatgcccacctggcccaggccgagaacctgcaggccctgtttgtggccctgaatgaccaggtgtttgagatccgggagctggccatctgcaccgtgggccgcctgagctccatgaacccagcctttgtgatgcccttcctgaggaagatgctgatccagatcctgacagagctggagcacagcggcatcggccgcatcaaggagcagagcgccaggatgctgggccacctggtgtccaatgcccccaggctcatccggccctacatggagcccatcctgaaggccctgatcctgaagctgaaggaccctgaccctgaccccaaccctggggtcatcaacaacgtgctggccaccatcggggagctggcccaggtgtctggcctggagatgaggaagtgggtggatgagctgttcatcatcatcatggacatgctgcaggacagcagcctgctggccaagaggcaggtggccctgtggaccctgggccagctggtggccagcacaggctacgtggtggagccctacaggaagtaccccaccctgctggaggtgctgctgaacttcctgaagacagagcagaaccagggcacccggcgggaggccatccgggtgctgggcctgctgggcgccctggacccctacaagcacaaggtgaacatcggcatgattgaccagagcagagatgccagcgctgtgtccctgtctgagagcaagagcagccaggacagcagtgactacagcaccagcgagatgctggtgaacatgggcaacctgcccctggatgagttctacccagctgtgtccatggtggccctgatgaggatcttccgggaccagagcctgagccaccaccacaccatggtggtgcaggccatcaccttcatcttcaagagcctgggcctgaagtgtgtgcagttcctgccccaggtgatgcccaccttcctgaatgtcatccgggtgtgtgatggagccatccgggagttcctgttccagcagctgggcatgctggtgtcctttgtgaagagccacatccggccctacatggatgagatcgtgaccctgatgagggagttctgggtgatgaacaccagcatccagagcaccatcatcctgctgattgagcagatcgtggtggccctgggcggggagttcaagctgtacctgccccagctgatcccccacatgctgcgggtcttcatgcatgacaacagccctggaagaattgtgtccatcaagctgctggccgccatccagctgtttggagccaacctggatgactacctgcacctgctgctgccccccatcgtgaagctgtttgatgcccctgaggcccccctgcccagcaggaaggccgccctggagaccgtggaccggctgacagagagcctggacttcacagattatgccagccgcatcatccaccccatcgtgaggaccctggaccagagccctgagctgcggagcacagccatggacaccctgagcagcctggtgttccagctgggcaagaagtaccagatcttcatccccatggtgaacaaggtgctggtgcgccaccgcatcaaccaccagagatatgatgtgctgatctgccgcatcgtgaagggctacaccctggctgatgaggaggaggaccccctcatctaccagcacaggatgctgcggagcggccagggagatgccctggccagcggccctgtggagaccggccccatgaagaagctgcacgtgtccaccatcaacctgcagaaggcctggggcgccgccaggagagtgtccaaggatgactggctggagtggctgcggcggctgagcctggagctgctgaaggacagcagcagccccagcctgcggagctgctgggccctggcccaggcctacaaccccatggcccgggacctcttcaatgctgcctttgtgtcctgctggagcgagctgaatgaagaccagcaggatgagctgatccgcagcattgagctggccctgaccagccaggacattgctgaggtgacccagaccctgctgaacctggccgagttcatggagcacagcgacaagggccccctgcccctgagagatgacaatggcatcgtgctgctgggggagagagctgccaagtgccgggcctatgccaaggccctgcactacaaggagctggagttccagaagggccccaccccagccatcctggagagcctcatcagcatcaacaacaagctgcagcagcctgaggccgccgccggcgtgctggagtatgccatgaagcactttggagagctggagatccaggccacctggtatgagaagctgcacgagtgggaggatgccctggtggcctatgacaagaagatggacaccaacaaggatgatcctgagctgatgctgggccgcatgcgctgcctggaggccctgggggagtggggccagctgcaccagcagtgctgtgagaagtggaccctggtgaatgatgagacccaggccaagatggccaggatggctgctgctgctgcctggggcctgggccagtgggacagcatggaggagtacacctgcatgatcccccgggacacccatgatggagccttctacagagctgtgctggccctgcaccaggacctcttcagcctggcccagcagtgcatcgacaaggcccgggacctgctggatgctgagctgacagccatggccggggagagctacagccgggcctatggagccatggtgtcctgccacatgctgtctgagctggaggaggtgatccagtacaagctggtgcctgagcggcgggagatcatccggcagatctggtgggagcggctgcagggctgccagagaattgtggaggactggcagaagatcctgatggtgcgcagcctggtggtgagcccccatgaggacatgaggacctggctgaagtatgccagcctgtgtgggaagagcggccgcctggccatcgcccccctgaacatgggcacagccaacagcgcccagcccaggagcctgcgctcctggaggacctggatccgcatcctggactgcaaggacacagaagatgctgacctgaccccagccacctaccccaagaccagcctggtgtgtggccagcagcagaagtgcctgcaggaccggcccaagtag

SEQ ID NO: 20396 - DNA, 6270 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagaaggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcaccctggatgagccctgggaggtgctggccacccagcccttctgcctgcgggagagtgaagattctgagacccagccctttgacacccacctggaggcctacggcccctgcctgagccccccccgggccatccctggggaccagcaccctgagagccctgtgcacacagagcccatgggcatccagggccggggccggcagacagtggacaaggtgatgggcatccccaaggagacagctgagcgggtgggccctgagcggggccccctggagcgggagacagagaagctgctgcctgagcggcagacagatgtgactggagaggaggagctgaccaagggcaagcaggaccgggagcagaagcagctgctggcccgggacacccagaggcaggagagtgacaagaatggagagagcgccagccctgagcgggaccgggagagcctgaaggtggagattgagaccagcgaggagatccaggagaagcaggtgcagaagcagaccctgcccagcaaggcctttgagcgggaggtggagaggcctgtggccaacagagaatgtgaccctgctgagctggaggagaaggtgcccaaggtgatcctggagcgggacacccagagaggagagcctgagggcggcagccaggaccagaagggccaggccagcagccccaccccagagcccggggtgggcgctggggacctgcccggccccaccagcgcccctgtgcccagcggcagccagagcggcggccggggcagccctgtgagcccccggcggcaccagaagggcctgctgaactgcaagatgcccccagctgagaaggccagccgcatccgggctgctgagaaggtgtccagaggagaccaggagagcccagatgcctgcctgcccccaacagtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgcccacagcccctgagctgcagcccagcaccagcacagaccagcctgtgaccagcgagcccacctaccaggccacccggggcaggaagaacagaagctctgtgaagaccccagagcctgtggtgcccacagcccctgagctgcggcccagcaccagcacagacaggcctgtgacccccaagcccaccagcaggaccaccaggagcaggaccaacatgagctctgtgaagaccccagagaccgtggtgcccacagcccctgagctgcagatcagcaccagcacagaccagcctgtgacccccaagcccaccagcaggaccaccaggagcaggaccaacatgagctctgtgaagaaccctgagagcacagtgcccatcgcccctgagctgccccccagcaccagcacagagcagcctgtgaccccagagcccaccagccgggccacccggggcaggaagaacagaagcagcggcaagaccccagagaccctggtgcccacagcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgcccctgagctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcccgccggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatccggaggacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 20397 - DNA, 489 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgtag

SEQ ID NO: 20398 - DNA, 384 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtag

SEQ ID NO: 20399 - DNA, 921 bp, Artificial Sequence
  Description of Artificial Sequence: Synthetic coding sequence
tgacatgtgggcggcaccaaggacagcgaggacaactatggagacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcctgctgaactgcaagatgcctcctgctgagaaggccagccgcatccgggctgctgagaaggtgtccagaggagaccaggagagcccagatgcctgcctgccccccaccgtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgccctag

SEQ ID NO: 20400 - DNA, 342 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccactag

SEQ ID NO: 20401 - DNA, 5409 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagaaggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcaccctggatgagccctgggaggtgctggccacccagcccttctgcctgcgggagagtgaagattctgagacccagccctttgacacccacctggaggcctacggcccctgcctgagccccccccgggccatccctggggaccagcaccctgagagccctgtgcacacagagcccatgggcatccagggccggggccggcagacagtggacaaggtgatgggcatccccaaggagacagctgagcgggtgggccctgagcggggccccctggagcgggagacagagaagctgctgcctgagcggcagacagatgtgactggagaggaggagctgaccaagggcaagcaggaccgggagcagaagcagctgctggcccgggacacccagaggcaggagagtgacaagaatggagagagcgccagccctgagcgggaccgggagagcctgaaggtggagattgagaccagcgaggagatccaggagaagcaggtgcagaagcagaccctgcccagcaaggcctttgagcgggaggtggagaggcctgtggccaacagagaatgtgaccctgctgagctggaggagaaggtgcccaaggtgatcctggagcgggacacccagagaggagagcctgagggcggcagccaggaccagaagggccaggccagcagccccaccccagagcccggggtgggcgctggggacctgcccggccccaccagcgcccctgtgcccagcggcagccagagcggcggccggggcagccctgtgagcccccggcggcaccagaagggcctgctgaactgcaagatgcccccagctgagaaggccagccgcatccgggctgctgagaaggtgtccagaggagaccaggagagcccagatgcctgcctgcccccaacagtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgcccctgagctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcctgctggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatcagaagaacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 20402 - DNA, 666 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgagcagcagcctgcccccaccccagaccagcctgctgcccctgagcctgcggctgcggctgctgggggaggagcagattgaccccctgagccggctgctgaagcagctgagcccccagcccctgagctaccgcctgcccccaccccagaccagcctgagccccctgagcccccacctgggccccctgggggaggagaagattggccccctgagccggcccctgaagcagctgtgcccccagcccctgagcagcagcctgcccccaccccagaccaacctgagccccctgagcccccacctgggccccctgggcgccggccagatcggccccctgagccggcccctgaaccagctgagcctgtag

SEQ ID NO: 20403 - DNA, 738 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggcctag

SEQ ID NO: 20404 - DNA, 735 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagccccacagaggaggcctgctgagctgccagaagcgctgccactgccggggctag

SEQ ID NO: 20405 - DNA, 5478 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagaaggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcctgctgaactgcaagatgcccccagctgagaaggccagccgcatccgggctgctgagaaggtgtccagaggagaccaggagagcccagatgcctgcctgcccccaacagtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgcccacagcccctgagctgcagcccagcaccagcacagaccagcctgtgaccagcgagcccacctaccaggccacccggggcaggaagaacagaagctctgtgaagaccccagagcctgtggtgcccacagcccctgagctgcggcccagcaccagcacagacaggcctgtgacccccaagcccaccagcaggaccaccaggagcaggaccaacatgagctctgtgaagaccccagagaccgtggtgcccacagcccctgagctgcagatcagcaccagcacagaccagcctgtgacccccaagcccaccagcaggaccaccaggagcaggaccaacatgagctctgtgaagaaccctgagagcacagtgcccatcgcccctgagctgccccccagcaccagcacagagcagcctgtgaccccagagcccaccagccgggccacccggggcaggaagaacagaagcagcggcaagaccccagagaccctggtgcccacagcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgcccctgagctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcccgccggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatccggaggacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 20406 - DNA, 4968 bp, Artificial Sequence
  Description of Artificial Sequence: Synthetic coding sequence
atgtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagaaggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggtgcagagcatggaggatgagcccacccaggccttcatgctgaccccaccccaggagctgggccccagccactgcagcttccagaccaccggcctgctgaactgcaagatgcctcctgctgagaaggccagccgcatccgggctgctgagaaggtgtccagaggagaccaggagagcccagatgcctgcctgccccccaccgtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgcccacagcccctgagctgcagcccagcaccagcacagaccagcctgtgaccagcgagcccacctaccaggccacccggggcaggaagaacagaagctctgtgaagaccccagagcctgtggtgcccacagcccctgagctgcggcccagcaccagcacagacaggcctgtgacccccaagcccaccagcaggaccaccaggagcaggaccaacatgagctctgtgaagaaccctgagagcacagtgcccatcgcccctgagctgccccccagcaccagcacagagcagcctgtgaccccagagcccaccagccgggccacccggggcaggaagaacagaagcagcggcaagaccccagagaccctggtgcccacagcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgcccctgagctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcccgccggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatccggaggacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 20407 - DNA, 1941 bp, Artificial Sequence
  Description of Artificial Sequence: Synthetic coding sequence
atgggcctgccccggctggtgtgtgccttcctgctggccgcctgctgctgctgcccccgggtggccggcgtgcctggagaggccgagcagcctgcccctgagctggtggaggtggaggtgggcagcacagccctgctgaagtgtggcctgagccagagccagggcaacctgagccacgtggactggttctctgtgcacaaggagaagaggaccctcatcttccgggtgcggcagggccagggccagagcgagcctggagaatatgagcagaggctgagcctgcaggacagaggagccaccctggccctgacccaggtgaccccccaggatgagcgcatcttcctgtgccagggcaagaggcccaggagccaggagtaccgcatccagctgcgggtgtacaaggcccctgaggagcccaacatccaggtgaaccccctgggcatccctgtgaacagcaaggagcctgaggaggtggccacctgtgtgggcagaaatggctaccccatcccccaggtgatctggtacaagaatggccggcccctgaaggaggagaagaacagagtgcacatccagagcagccagacagtggagagcagcggcctgtacaccctgcagagcatcctgaaggcccagctggtgaaggaggacaaggatgcccagttctactgtgagctgaactaccgcctgcccagcggcaaccacatgaaggagagccgggaggtgacagtgcctgtgttctaccccacagagaaggtgtggctggaggtggagcctgtgggcatgctgaaggagggggacagagtggagatccgctgcctggctgatggcaaccccccaccccacttcagcatcagcaagcagaaccccagcacccgggaggccgaggaggagaccaccaatgacaacggggtgctggtgctggagcccgccaggaaggagcacagcggccgctatgagtgccagggcctggacctggacaccatgatcagcctgctgtctgagccccaggagctgctggtgaactacgtgtctgatgtgcgggtgtccccagctgcccctgagcggcaggagggcagcagcctgaccctgacctgtgaggccgagagcagccaggacctggagttccagtggctgcgggaggagaccggccaggtgctggagcggggccctgtgctgcagctgcatgacctgaagcgggaggccggcggcggctaccgctgtgtggcctctgtgcccagcatccctggcctgaacagaacccagctggtgaatgtggccatcttcggccccccctggatggccttcaaggagaggaaggtgtgggtgaaggagaacatggtgctgaacctgagctgtgaggccagcggccacccccggcccaccatctcctggaatgtgaatggaacagccagcgagcaggaccaggacccccagagggtgctgagcaccctgaatgtgctggtgaccccagagctgctggagactggagtggagtgcacagccagcaatgacctgggcaagaacaccagcatcctcttcctggagctggtgaacctgaccaccctgaccccagacagcaacaccaccaccggcctgagcaccagcacagccagcccccacacccgggccaacagcaccagcacagagaggaagctgcctgagcctgagagcagaggagtggtgattgtggccgtcatcgtgtgcatcctggtgctggccgtgctgggcgctgtgctgtacttcctgtacaagaagggcaagctgccctgcagaagaagtggcaagcaggagatcaccctgccccccagcaggaagtctgagctggtggtggaggtgaagagtgacaagctgcctgaggagatgggcctgctgcagggcagcagcggggacaagagggcccctggggaccagggcgagaagtacatcgacctgcggcactag

SEQ ID NO: 20408 - DNA, 1584 bp, Artificial Sequence
  Description of Artificial Sequence: Synthetic coding sequence
atggtgtacatcgtgcggcagttcctgctgtacaacgtgtctggctctgtgtacctggaccagctgattgtgctgctgacagccaagttcagcatcctgagaattgctggcagccgggtgcaccacagccccttcagcggccacctggatggctgcagcttcctgagcctgcagcacagcctgcacaccagcctggacatgagcagacatgaaaatgtgttcctgggcctgaccctgagcagcaagtctgctggcctgaagggcttccagctggcctttgtgcccggcctgctgcagggcactggaggctacctggatggccccctgcccacccctgtggacaacccccgggtgggcctggaggtgggcctgcggctgagcctgccccccctgcccccctgccctggggtgcacatccagagcagccagacagtggagagcagcggcctgtacaccctgcagagcatcctgaaggcccagctggtgaaggaggacaaggatgcccagttctactgtgagctgaactaccgcctgcccagcggcaaccacatgaaggagagccgggaggtgacagtgcctgtgttctaccccacagagaaggtgtggctggaggtggagcctgtgggcatgctgaaggagggggacagagtggagatccgctgcctggctgatggcaaccccccaccccacttcagcatcagcaagcagaaccccagcacccgggaggccgaggaggagaccaccaatgacaatggagtgctggtgctggagcccgccaggaaggagcacagcggccgctatgagtgccagggcctggacctggacaccatgatcagcctgctgtctgagccccaggagctgctggtgaactacgtgtctgatgtgcgggtgtccccagctgcccctgagcggcaggagggcagcagcctgaccctgacctgtgaggccgagagcagccaggacctggagttccagtggctgcgggaggagaccggccaggtgctggagcggggccctgtgctgcagctgcatgacctgaagcgggaggccggcggcggctaccgctgtgtggcctctgtgcccagcatccctggcctgaacagaacccagctggtgaatgtggccatctttggaccaccctggatggccttcaaggagaggaaggtgtgggtgaaggagaacatggtgctgaacctgagctgtgaggccagcggccacccccggcccaccatctcctggaatgtgaatggaacagccagcgagcaggaccaggacccccagagggtgctgagcaccctgaatgtgctggtgaccccagagctgctggagaccggggtggagtgcacagccagcaatgacctgggcaagaacaccagcatcctcttcctggagctggtgaacctgaccaccctgaccccagacagcaacaccaccaccggcctgagcaccagcacagccagcccccacacccgggccaacagcaccagcacaggcaagccaggcctggcccgggagcagggctgtgcccgggccagcttcctgccctgccccagccctgagagccctgtgcagaagggggagtag

SEQ ID NO: 20409 - DNA, 141 bp, Artificial Sequence
  Description of Artificial Sequence: Synthetic coding sequence
ggtgtggtgattgtggccgtcatcgtgtgcatcctggtgctggccgtgctgggcgctgtgctgtacttcctgtacaagaagggcaagctgccctgcagaagaagtggcaagcaggagatggagaggaacaccagcatctag

SEQ ID NO: 20410 - DNA, 2253 bp, Artificial Sequence
  Description of Artificial Sequence: Synthetic coding sequence
atgggcaagtctgagagccagatggacatcacagacatcaacacccccaagcccaagaagaagcagcgctggacccccctggagatcagcctgtctgtgctggtgctgctgctgaccatcatcgctgtgaccatgattgccctgtatgccacctatgatgatggcatctgcaagagcagtgactgcatcaagtctgctgcccggctcatccagaacatggatgccaccacagagccctgcacagacttcttcaagtatgcctgtggcggctggctgaagagaaatgtcatccctgagaccagcagccgctatggcaactttgacatcctgagagatgagctggaggtggtgctgaaggatgtgctgcaggagcccaagacagaggacatcgtggccgtgcagaaggccaaggccctgtaccgcagctgcatcaatgaaagtgccatcgacagcagaggaggagagcccctgctgaagctgctgcctgacatctacggctggcctgtggccacagagaactgggagcagaagtacggggcctcctggacagctgagaaggccatcgcccagctgaacagcaaatatggcaagaaggtgctgatcaacctgtttgtgggcacagatgacaagaacagcgtgaaccacgtgatccacatcgaccagccccggctgggcctgcccagccgggactactatgaatgtacaggcatctacaaggaggcctgcacagcctacgtggacttcatgatctctgtggcccggctcatccggcaggaggagcggctgcccattgatgagaaccagctggccctggagatgaacaaggtgatggagctggagaaggagatcgccaatgccacagccaagccagaagatagaaatgaccccatgctgctgtacaacaagatgaccctggcccagatccagaacaacttcagcctggagatcaatggcaagcccttctcctggctgaacttcaccaatgagatcatgagcacagtgaacatcagcatcaccaatgaggaggatgtggtggtgtatgcccctgagtacctgaccaagctgaagcccatcctgaccaagtacagcgcccgggacctgcagaacctgatgtcctggaggttcatcatggacctggtgagcagcctgagcaggacctacaaggagagcagaaatgccttcaggaaggccctgtatggcaccaccagcgagacagccacctggaggcgctgtgccaactacgtgaatggaaacatggagaatgctgtgggccgcctgtatgtggaggccgcctttgctggggagagcaagcacgtggtggaggacctgattgcccagatccgggaggtgttcatccagaccctggatgacctgacctggatggatgctgagaccaagaagagagctgaggagaaggccctggccatcaaggagcgcatcggctacccagatgacatcgtgtccaatgacaacaagctgaacaatgagtacctggagctgaactacaaggaggatgagtactttgagaacatcatccagaacctgaagttcagccagagcaagcagctgaagaagctgcgggagaaggtggacaaggatgagtggatctctggagctgctgtggtgaatgccttctacagcagcggcaggaaccagatcgtgtttcctgctggcatcctgcagccccccttcttcagcgcccagcagagcaacagcctgaactatggaggcatcggcatggtgattggccacgagatcacccacggctttgatgacaatggaagaaacttcaacaaggatggagacctggtggactggtggacccagcagagcgccagcaacttcaaggagcagagccagtgcatggtgtaccagtatggcaacttctcctgggacctggccggcggccagcacctgaatggcatcaacaccctgggagaaaatattgctgacaatggaggcctgggccaggcctaccgggcctaccagaactacatcaagaagaatggagaggagaagctgctgcccggcctggacctgaaccacaagcagctgttcttcctgaactttgcccaggtgtggtgtggcacctacagaccagaatatgctgtgaacagcatcaagacagatgtgcacagccctggcaacttccgcatcatcggcaccctgcagaacagcgctgagttcagcgaggccttccactgcaggaagaacagctacatgaaccctgagaagaagtgccgggtgtggtag

SEQ ID NO: 20411 - DNA, 2253 bp, Artificial Sequence; identical to SEQ ID NO: 20410
  Description of Artificial Sequence: Synthetic coding sequence

SEQ ID NO: 20412 - DNA, 2253 bp, Artificial Sequence; identical to SEQ ID NO: 20410
  Description of Artificial Sequence: Synthetic coding sequence

SEQ ID NO: 20413 - DNA, 486 bp, Artificial Sequence
  Description of Artificial Sequence: Synthetic coding sequence
atgggcaagtctgagagccagatggacatcacagacatcaacacccccaagcccaagaagaagcagcgctggacccccctggagatcagcctgtctgtgctggtgctgctgctgaccatcatcgctgtgaccatgattgccctgtatgccacctatgatgatggcatctgcaagagcagtgactgcatcaagtctgctgcccggctcatccagaacatggatgccaccacagagccctgcacagacttcttcaagtatgcctgtggcggctggctgaagagaaatgtcatccctgagaccagcagccgctatggcaactttgacatcctgagagatgagctggaggtggtgctgaaggatgtgctgcaggagcccaagacagaggacatcgtggccgtgcagaaggccaaggccctgtaccgcagctgcatcaatgaaagtgccatcgacagcagaggaggagagcccctgctgaagctgctgtag

SEQ ID NO: 20414 - DNA, 282 bp, Artificial Sequence
  Description of Artificial Sequence: Synthetic coding sequence
atgggcaagtctgagagccagatggacatcacagacatcaacacccccaagcccaagaagaagcagcgctggacccccctggagatcagcctgtctgtgctggtgctgctgctgaccatcatcgctgtgaccatgattgccctgtatgccacctatgatgatggcatctgcaagagcagtgactgcatcaagtctgctgcccggctcatccagaacatggatgccaccacagagccctgcacagacttcttcaagtatgcctgtggcggctggctgaagtag

SEQ ID NO: 20415 - DNA, 702 bp, Artificial Sequence
  Description of Artificial Sequence: Synthetic coding sequence
atgggcaagtctgagagccagatggacatcacagacatcaacacccccaagcccaagaagaagcagcgctggacccccctggagatcagcctgtctgtgctggtgctgctgctgaccatcatcgctgtgaccatgattgccctgtatgccacctatgatgatggcatctgcaagagcagtgactgcatcaagtctgctgcccggctcatccagaacatggatgccaccacagagccctgcacagacttcttcaagtatgcctgtggcggctggctgaagagaaatgtcatccctgagaccagcagccgctatggcaactttgacatcctgagagatgagctggaggtggtgctgaaggatgtgctgcaggagcccaagacagaggacatcgtggccgtgcagaaggccaaggccctgtaccgcagctgcatcaatgaaagtgccatcgacagcagaggaggagagcccctgctgaagctgctgcctgacatctacggctggcctgtggccacagagaactgggagcagaagtacggggcctcctggacagctgagaaggccatcgcccagctgaacagcaaatatggcaagaaggtgctgatcaacctgtttgtgggcacagatgacaagaacagcgtgaaccacgtgatccacatcgaccagccccggctgggcctgcccagccgggactactatgaatag

SEQ ID NO: 20416 - DNA, 360 bp, Artificial Sequence
  Description of Artificial Sequence: Synthetic coding sequence
atgggcaagtctgagagccagatggacatcacagacatcaacacccccaagcccaagaagaagcagcgctggacccccctggagatcagcctgtctgtgctggtgctgctgctgaccatcatcgctgtgaccatgattgccctgtatgccacctatgatgatggcatctgcaagagcagtgactgcatcaagtctgctgcccggctcatccagaacatggatgccaccacagagccctgcacagacttcttcaagtatgcctgtggcggctggctgaagagaaatgtcatccctgagaccagcagccgctatggcaactttgacatcctgagagatgagctggaggtggtgctgaagtag

SEQ ID NO: 20417 - DNA, 2253 bp, Artificial Sequence; identical to SEQ ID NO: 20410
  Description of Artificial Sequence: Synthetic coding sequence

SEQ ID NO: 20418 - DNA, 2253 bp, Artificial Sequence; identical to SEQ ID NO: 20410
  Description of Artificial Sequence: Synthetic coding sequence

SEQ ID NO: 20419 - DNA, 48 bp, Artificial Sequence
  Description of Artificial Sequence: Synthetic coding sequence
atgggcaagtctgagagccagatggacatcacagacatcaacacctag

SEQ ID NO: 20420 - DNA, 894 bp, Artificial Sequence
  Description of Artificial Sequence: Synthetic coding sequence
atgaccaccccaagaaattctgtgaatggcaccttccctgctgagcccatgaagggccccatcgccatgcagagcggccccaagcccctcttccggaggatgagcagcctggtgggccccacccagagcttcttcatgagggagagcaagaccctgggcgctgtgcagatcatgaatggcctcttccacatcgccctgggcggcctgctgatgatcccagctggcatctatgcccccatctgtgtgacagtgtggtaccccctgtggggcggcatcatgtacatcatcagcggcagcctgctggccgccacagagaagaacagcaggaagtgcctggtgaagggcaagatgatcatgaacagcctgagcctgtttgctgccatcagcggcatgatcctgagcatcatggacatcctgaacatcaagatcagccacttcctgaagatggagagcctgaacttcatccgggcccacaccccctacatcaacatctacaactgtgagcccgccaaccccagcgagaagaacagccccagcacccagtactgctacagcatccagagcctcttcctgggcatcctgtctgtgatgctgatctttgccttcttccaggagctggtgattgctggcatcgtggagaatgagtggaagaggacctgcagccggcccaagagcaacatcgtgctgctgtctgctgaggagaagaaggagcagaccatcgagatcaaggaggaggtggtgggcctgacagagaccagcagccagcccaagaatgaggaggacatcgagatcatccccatccaggaggaggaggaggaggagacagagaccaacttccctgagcccccccaggaccaggagagcagccccattgaaaatgacagcagcccctag

SEQ ID NO: 20421 - DNA, 894 bp, Artificial Sequence; identical to SEQ ID NO: 20420
  Description of Artificial Sequence: Synthetic coding sequence

SEQ ID NO: 20422 - DNA, 24 bp, Artificial Sequence
  Description of Artificial Sequence: Synthetic coding sequence
atgaccaccccaagaaacagctag

SEQ ID NO: 20423 - DNA, 855 bp, Artificial Sequence
  Description of Artificial Sequence: Synthetic coding sequence
atgaccaccccaagaaattctgtgaatggcaccttccctgctgagcccatgaagggccccatcgccatgcagagcggccccaagcccctcttccggaggatgagcagcctggtgggccccacccagagcttcttcatgagggagagcaagaccctgggcgctgtgcagatcatgaatggcctcttccacatcgccctgggcggcctgctgatgatcccagctggcatctatgcccccatctgtgtgacagtgtggtaccccctgtggggcggcatcatgtacatcatcagcggcagcctgctggccgccacagagaagaacagcaggaagtgcctggtgaagggcaagatgatcatgaacagcctgagcctgtttgctgccatcagcggcatgatcctgagcatcatggacatcctgaacatcaagatcagccacttcctgaagatggagagcctgaacttcatccgggcccacaccccctacatcaacatctacaactgtgagcccgccaaccccagcgagaagaacagccccagcacccagtactgctacagcatccagagcctcttcctggagctggtgattgctggcatcgtggagaatgagtggaagaggacctgcagccggcccaagagcaacatcgtgctgctgtctgctgaggagaagaaggagcagaccatcgagatcaaggaggaggtggtgggcctgacagagaccagcagccagcccaagaatgaagaagatattgagatcatccccatccaggaggaggaggaggaggagacagagaccaacttccctgagcccccccaggaccaggagagcagccccattgaaaatgacagcagcccctag

SEQ ID NO: 20424 - DNA, 21 bp, Artificial Sequence
  Description of Artificial Sequence: Synthetic coding sequence
atgaccaccccaagaaattag

SEQ ID NO: 20425 - DNA, 894 bp, Artificial Sequence; identical to SEQ ID NO: 20420
  Description of Artificial Sequence: Synthetic coding sequence

SEQ ID NO: 20426 - DNA, 930 bp, Artificial Sequence
  Description of Artificial Sequence: Synthetic coding sequence
atggatgaccagggctgcccccgctgcaagaccaccaagtacagaaaccccagcctgaagctgatggtgaatgtgtgtggccacaccctgtgtgagagctgtgtggacctgctgtttgtgagaggagctggcaactgcccagaatgtggcacccccctgaggaagagcaacttccgggtgcagctgtttgaggaccccaccgtggacaaggaggtggagatcaggaagaaggtgctgaagatctacaacaagcgggaggaggacttccccagcctgcgggagtacaatgacttcctggaggaggtggaggagatcgtgttcaacctgaccaacaacgtggacctggacaacaccaagaagaagatggagatctaccagaaggagaacaaggatgtgatccagaagaacaagctgaagctgacccgggagcaggaggagctggaggaggccctggaggtggagcggcaggagaatgagcagaggaggctcttcatccagaaggaggagcagctgcagcagatcctgaagaggaagaacaagcaggccttcctggatgagctggagagcagtgacctgcctgtggccctgctgctggcccagcacaaggacaggagcacccagctggagatgcagctggagaagcccaagcctgtgaagcctgtgaccttcagcacaggcatcaagatgggccagcacatcagcctggcccccatccacaagctggaggaggccctgtatgagtaccagcccctgcagatcgagacctacggcccccacgtgcctgagctggagatgctgggccgcctgggctacctgaaccacgtgcgggccgccagcccccaggacctggccggcggctacaccagcagcctggcctgccaccgggccctgcaggatgccttcagcggcctcttctggcagcccagctag

SEQ ID NO: 20427 - DNA, 804 bp, Artificial Sequence
  Description of Artificial Sequence: Synthetic coding sequence
atggatgaccagggctgcccccgctgcaagaccaccaagtacagaaaccccagcctgaagctgatggtgaatgtgtgtggccacaccctgtgtgagagctgtgtggacctgctgtttgtgagaggagctggcaactgcccagaatgtggcacccccctgaggaagagcaacttccgggtgcagctgtttgaggaccccaccgtggacaaggaggtggagatcaggaagaaggtgctgaagatctacaacaagcgggaggaggacttccccagcctgcgggagtacaatgacttcctggaggaggtggaggagatcgtgttcaacctgaccaacaacgtggacctggacaacaccaagaagaagatggagatctaccagaaggagaacaaggatgtgatccagaagaacaagctgaagctgacccgggagcaggaggagctggaggaggccctggaggtggagcggcaggagaatgagcagaggaggctcttcatccagaaggaggagcagctgcagcagatcctgaagaggaagaacaagcaggccttcctggatgagctgggccagcacatcagcctggcccccatccacaagctggaggaggccctgtatgagtaccagcccctgcagatcgagacctacggcccccacgtgcctgagctggagatgctgggccgcctgggctacctgaaccacgtgcgggccgccagcccccaggacctggccggcggctacaccagcagcctggcctgccaccgggccctgcaggatgccttcagcggcctcttctggcagcccagctag

SEQ ID NO: 20428 - DNA, 510 bp, Artificial Sequence
  Description of Artificial Sequence: Synthetic coding sequence
acccgggagcaggaggagctggaggaggccctggaggtggagcggcaggagaatgagcagaggaggctcttcatccagaaggaggagcagctgcagcagatcctgaagaggaagaacaagcaggccttcctggatgagctggagagcagtgacctgcctgtggccctgctgctggcccagcacaaggacaggagcacccagctggagatgcagctggagaagcccaagcctgtgaagcctgtgaccttcagcacaggcatcaagatgggccagcacatcagcctggcccccatccacaagctggaggaggccctgtatgagtaccagcccctgcagatcgagacctacggcccccacgtgcctgagctggagatgctgggccgcctgggctacctgaaccacgtgcgggccgccagcccccaggacctggccggcggctacaccagcagcctggcctgccaccgggccctgcaggatgccttcagcggcctcttctggcagcccagctag

SEQ ID NO: 20429 - DNA, 3963 bp, Artificial Sequence
  Description of Artificial Sequence: Synthetic coding sequence
atgtttggcctggaccagtttgagccccaggtgaacagcagaaatgccggccagggcgagaggaacttcaatgagaccggcctgtccatgaacacccacttcaaggccccagccttccacactggaggccccccaggccctgtggaccctgccatgtctgccctgggggagccccccatcctgggcatgaacatggagccctacggcttccacgcccggggccacagcgagctgcacgccggcggcctgcaggcccagcctgtgcacggcttcttcggcggccagcagccccaccacggccaccctggcagccaccacccccaccagcaccacccccactttggaggcaactttggaggccctgaccccggggccagctgcctgcatggaggccgcctgctgggctacggcggggccgccggcggcctgggcagccagcccccatttgctgagggctatgagcacatggccgagagccagggccctgagagctttggcccccagaggcctggcaacctgcctgacttccacagcagcggggccagcagccatgctgtgcctgccccctgcctgcccctggaccagagccccaacagagctgccagcttccacggcctgcccagcagcagcggcagtgacagccacagcctggagccccggcgggtgaccaaccagggcgctgtggacagcctggagtacaactacccaggagaggcccccagcggccactttgacatgttcagccccagcgacagcgagggccagctgccccactacgccgccggccggcaggtgcctgggggcgccttccctggggccagcgccatgcccagggctgctggcatggtgggcctgagcaagatgcacgcccagcccccccagcagcagccccagcagcagcagcagccccagcagcagcagcagcagcacggcgtcttctttgagcgcttcagcggggccaggaagatgcctgtgggcctggagcccagcgtgggcagccgccaccccctgatgcagcccccccagcaggcccctcctccaccccagcagcagcccccccagcagcccccccagcagcagcccccacctcctcctggcctgctggtgcggcagaacagctgccccccagccctgccccggccccagcagggcgaggccggcacccccagcggcggcctgcaggacggcggccccatgctgcccagccagcacgcccagtttgagtaccccatccaccggctggagaacagatccatgcacccctacagcgagcctgtgttctccatgcagcaccccccaccccagcaggcccccaaccagaggctgcagcactttgatgccccaccctacatgaatgtggccaagaggcccaggtttgacttccctggcagcgctggggtggacagatgtgcctcctggaatggctccatgcacaatggagccctggacaaccacctgagccccagcgcctacccaggcctgcctggagagttcaccccacctgtgcctgacagcttccccagcggcccccccctgcagcacccagccccagaccaccagagcctgcagcagcagcagcagcagcagcagcagcagcagcagcagcagcagcagcagcagcagcagcagcagcagcagcagcagcagcagaggcagaatgctgccctgatgatcaagcagatggccagcaggaaccagcagcagaggctgcggcagcccaacctggcccagctgggccaccctggagatgtgggccagggcggcctggtgcatggaggccctgtgggcggcctggcccagcccaactttgagcgggagggcggcagcactggagctggccgcctgggcacctttgagcagcaggccccccacctggcccaggagagcgcctggttcagcggcccccaccccccacctggggacctgctgcccaggaggatgggcggcagcggcctgcctgctgactgtggcccccatgaccccagcctggcccctcctcctcctcctgggggcagcggcgtgctcttccggggccccctgcaggagcccatgaggatgcctggagagggccacgtgcctgccctgcccagccctggcctgcagtttggaggcagcctgggcggcctgggccagctgcagagccctggagctggggtgggcctgcccagcgctgccagcgagcggcggcccccacctccagactttgccaccagcgccctgggcggccagcccggcttcccctttggagctgctggccggcagagcaccccccacagcggccctggggtgaacagcccccccagcgctgggggcggcggcggcagcagcggcggcggcggcggcggcggggcctacccaccccagcctgacttccagcccagccagaggaccagcgccagcaagctgggcgccctgagcctgggcagcttcaacaagcccagcagcaaggacaacctgtttggccagagctgcctggccgccctgagcacagcctgccagaacatgattgccagcctgggcgcccccaacctgaatgtgaccttcaacaagaagaaccccccagagggcaagaggaagctgagccagaatgaaacagatggagctgctgtggccggcaaccctggcagtgactacttccctgggggcacagcccctggggcccctggccctgggggccccagcggcaccagcagcagcggcagcaaggccagcggcccccccaaccccccagcccagggagatggcaccagcctgagccccaactacaccctggagagcaccagcggaaatgatggcaagcctgtgtctgggggcggcggccggggccggggccgcaggaagagggacagcggccacgtgtccccaggcaccttctttgacaagtacagcgctgccccagacagcggcggggcccctggggtgtccccaggccagcagcaggccagcggggctgctgtgggcggcagcagcgctggggagaccaggggggcccccacccctcatgagaaggccctgaccagccccagctggggcaaaggagctgagctgctgctgggggaccagcctgacctgattggcagcctggatggaggagccaagagtgacagcagcagccccaacgtgggggagtttgccagtgatgaggtgtccaccagctatgccaatgaagatgaggtgagcagcagcagtgacaacccccaggccctggtgaaggccagccgcagccccctggtgacaggcagccccaagctgcccccccggggcgtgggcgctggggagcacggccccaaggcccctcctccagccctgggcctgggcatcatgagcaacagcaccagcaccccagacagctatggaggcggcggcggccctggccaccctggcaccccaggcctggagcaggtgaggacccccaccagcagcagcggggcccctcctccagatgagatccaccccctggagatcctgcaggcccagatccagctgcagaggcagcagttcagcatcagcgaggaccagcccctgggcctgaagggcggcaagaagggggagtgtgctgtgggcgccagcggggcccagaatggagacagcgagctgggcagctgctgcagcgaggccgtgaagagcgccatgagcaccatcgacctggacagcctgatggccgagcacagcgctgcctggtacatgcctgctgacaaggccctggtggacagcgcagatgatgacaagaccctggccccctgggagaaggccaagccccagaaccccaacagcaaggaggcccatgacctgcctgccaacaaggccagcgccagccagcccggcagccacctgcagtgcctgtctgtgcactgcacagatgatgtgggagatgccaaggcccgggcctctgtgcccacctggaggagcctgcacagcgacatcagcaaccgcttcggcacctttgtggccgccctgacctag

SEQ ID NO: 20430 - DNA, 4227 bp, Artificial Sequence
  Description of Artificial Sequence: Synthetic coding sequence
atgaaggccccagctgtgctggcccctggcatcctggtgctgctcttcaccctggtgcagaggagcaatggagagtgcaaggaggccctggccaagtctgagatgaatgtgaacatgaagtaccagctgcccaacttcaccgctgagacccccatccagaatgtcatcctgcacgagcaccacatcttcctgggcgccaccaactacatctacgtgctgaatgaggaggacctgcagaaggtggccgagtacaagacaggccctgtgctggagcacccagactgcttcccctgccaggactgcagcagcaaggccaacctgagcggcggcgtgtggaaggacaacatcaacatggccctggtggtggacacctactatgatgaccagctgatcagctgtggctctgtgaacagaggcacctgccagagacatgtgttcccccacaaccacacagctgacatccagagcgaggtgcactgcatcttcagcccccagatcgaggagcccagccagtgcccagactgtgtggtgtctgccctgggcgccaaggtgctgagctctgtgaaggaccgcttcatcaacttctttgtgggcaacaccatcaacagcagctacttcccagaccaccccctgcacagcatctctgtgcggcggctgaaggagaccaaggatggcttcatgttcctgacagaccagagctacattgatgtgctgcctgagttccgggacagctaccccatcaagtatgtgcacgcctttgagagcaacaacttcatctacttcctgactgtgcagcgggagaccctggatgcccagaccttccacacccgcatcatccgcttctgcagcatcaacagcggcctgcacagctacatggagatgcccctggagtgcatcctgacagagaagaggaagaagaggagcaccaagaaggaggtgttcaacatcctgcaggccgcctacgtgtccaagccaggggcccagctggcccggcagattggagccagcctgaatgatgacatcctgtttggagtgtttgcccagagcaagccagattctgctgagcccatggacagaagtgccatgtgtgccttccccatcaagtatgtgaatgacttcttcaacaagatcgtgaacaagaacaacgtgcgctgcctgcagcacttctacggccccaaccacgagcactgcttcaacagaaccctgctgaggaacagcagcggctgtgaggccaggagagatgagtacagaacagagttcaccacagccctgcagagggtggacctcttcatgggccagttcagcgaggtgctgctgaccagcatcagcaccttcatcaagggggacctgaccatcgccaacctgggcaccagcgagggccgcttcatgcaggtggtggtgagccgcagcggccccagcaccccccacgtgaacttcctgctggacagccaccctgtgtccccagaggtgattgtggagcacaccctgaaccagaatggctacaccctggtgatcaccgggaagaagatcaccaagatccccctgaatggcctgggctgccgccacttccagagctgcagccagtgcctgagcgcccccccatttgtgcagtgtggctggtgccacgacaagtgtgtgcgctctgaggagtgcctgagcggcacctggacccagcagatctgcctgcctgccatctacaaggtgttccccaacagcgcccccctggagggcggcacccggctgaccatctgtggctgggactttggcttcagaagaaacaacaagtttgacctgaagaagaccagggtgctgctgggcaatgaaagctgcaccctgaccctgtctgagagcaccatgaacaccctgaagtgcaccgtgggccctgccatgaacaagcacttcaacatgagcatcatcatcagcaatggccacggcaccacccagtacagcaccttctcctatgtggaccctgtgatcaccagcatcagccccaagtatggccccatggccggcggcaccctgctgaccctgaccggcaactacctgaacagcggcaacagccgccacatcagcatcggcggcaagacctgcaccctgaagtctgtgagcaacagcatcctggagtgctacaccccagcccagaccatcagcacagaatttgctgtgaagctgaagattgacctggccaaccgggagaccagcatcttctcctaccgggaggaccccatcgtgtatgagatccaccccaccaagagcttcatcagcacctggtggaaggagcccctgaacatcgtgtccttcctgttctgctttgccagcggcggcagcaccatcactggagtgggcaagaacctgaacagcgtgtctgtgcccaggatggtgatcaacgtgcatgaggccggcaggaacttcaccgtggcctgccagcacaggagcaacagcgagatcatctgctgcaccacccccagcctgcagcagctgaacctgcagctgcccctgaagaccaaggccttcttcatgctggatggcatcctgagcaagtactttgacctgatctacgtgcacaaccctgtgttcaagccctttgagaagcctgtgatgatctccatgggaaatgaaaatgtgctggagatcaagggaaatgacattgatcctgaggccgtgaagggggaggtgctgaaggtgggcaacaagagctgtgagaacatccacctgcacagcgaggccgtgctgtgcaccgtgcccaatgacctgctgaagctgaacagcgagctgaacatcgagtggaagcaggccatcagcagcacagtgctgggcaaggtgattgtgcagcctgaccagaacttcaccggcctgattgctggggtggtgtccatcagcacagccctgctgctgctgctgggcttcttcctgtggctgaagaagaggaagcagatcaaggacctgggcagcgagctggtgcgctatgatgcccgggtgcacaccccccacctggaccggctggtgtctgcccggtctgtgagccccaccacagagatggtgtccaatgaatctgtggactaccgggccaccttccctgaggaccagttccccaacagcagccagaatggcagctgccggcaggtgcagtaccccctgacagacatgagccccatcctgaccagcggggacagcgacatcagcagccccctgctgcagaacacagtgcacatcgacctgagcgccctgaaccctgagctggtgcaggccgtgcagcacgtggtgattggccccagcagcctgattgtgcacttcaatgaagtcatcggccggggccacttcggctgtgtgtaccacggcaccctgctggacaatgatggcaagaagatccactgtgctgtgaagagcctgaaccgcatcacagacatcggggaggtgtcccagttcctgacagagggcatcatcatgaaggacttcagccaccccaacgtgctgagcctgctgggcatctgcctgcggtctgagggcagccccctggtggtgctgccctacatgaagcacggggacctgaggaacttcatcagaaatgagacccacaaccccaccgtgaaggacctgattggcttcggcctgcaggtggccaagggcatgaagtacctggccagcaagaagtttgtgcaccgggacctggccgccaggaactgcatgctggatgagaagttcaccgtgaaggtggccgactttggcctggcccgggacatgtatgacaaggagtactacagcgtgcacaacaagacaggagccaagctgcctgtgaagtggatggccctggagagcctgcagacccagaagttcaccaccaagagtgatgtgtggagctttggagtgctgctgtgggagctgatgaccaggggggccccaccctacccagatgtgaacacctttgacatcaccgtgtacctgctgcagggccggcggctgctgcagcctgagtactgcccagaccccctgtatgaggtgatgctgaagtgctggcaccccaaggccgagatgaggcccagcttcagcgagctggtgagccgcatcagcgccatcttcagcaccttcatcggggagcactacgtgcacgtgaatgccacctacgtgaatgtgaagtgtgtggccccctaccccagcctgctgagcagcgaggacaatgctgatgatgaggtggacaccaggcctgccagcttctgggagaccagctag

SEQ ID NO: 20431 - DNA, 4173 bp, Artificial Sequence
  Description of Artificial Sequence: Synthetic coding sequence
atgaaggccccagctgtgctggcccctggcatcctggtgctgctcttcaccctggtgcagaggagcaatggagagtgcaaggaggccctggccaagtctgagatgaatgtgaacatgaagtaccagctgcccaacttcaccgctgagacccccatccagaatgtcatcctgcacgagcaccacatcttcctgggcgccaccaactacatctacgtgctgaatgaggaggacctgcagaaggtggccgagtacaagacaggccctgtgctggagcacccagactgcttcccctgccaggactgcagcagcaaggccaacctgagcggcggcgtgtggaaggacaacatcaacatggccctggtggtggacacctactatgatgaccagctgatcagctgtggctctgtgaacagaggcacctgccagagacatgtgttcccccacaaccacacagctgacatccagagcgaggtgcactgcatcttcagcccccagatcgaggagcccagccagtgcccagactgtgtggtgtctgccctgggcgccaaggtgctgagctctgtgaaggaccgcttcatcaacttctttgtgggcaacaccatcaacagcagctacttcccagaccaccccctgcacagcatctctgtgcggcggctgaaggagaccaaggatggcttcatgttcctgacagaccagagctacattgatgtgctgcctgagttccgggacagctaccccatcaagtatgtgcacgcctttgagagcaacaacttcatctacttcctgactgtgcagcgggagaccctggatgcccagaccttccacacccgcatcatccgcttctgcagcatcaacagcggcctgcacagctacatggagatgcccctggagtgcatcctgacagagaagaggaagaagaggagcaccaagaaggaggtgttcaacatcctgcaggccgcctacgtgtccaagccaggggcccagctggcccggcagattggagccagcctgaatgatgacatcctgtttggagtgtttgcccagagcaagccagattctgctgagcccatggacagaagtgccatgtgtgccttccccatcaagtatgtgaatgacttcttcaacaagatcgtgaacaagaacaacgtgcgctgcctgcagcacttctacggccccaaccacgagcactgcttcaacagaaccctgctgaggaacagcagcggctgtgaggccaggagagatgagtacagaacagagttcaccacagccctgcagagggtggacctcttcatgggccagttcagcgaggtgctgctgaccagcatcagcaccttcatcaagggggacctgaccatcgccaacctgggcaccagcgagggccgcttcatgcaggtggtggtgagccgcagcggccccagcaccccccacgtgaacttcctgctggacagccaccctgtgtccccagaggtgattgtggagcacaccctgaaccagaatggctacaccctggtgatcaccgggaagaagatcaccaagatccccctgaatggcctgggctgccgccacttccagagctgcagccagtgcctgagcgcccccccatttgtgcagtgtggctggtgccacgacaagtgtgtgcgctctgaggagtgcctgagcggcacctggacccagcagatctgcctgcctgccatctacaaggtgttccccaacagcgcccccctggagggcggcacccggctgaccatctgtggctgggactttggcttcagaagaaacaacaagtttgacctgaagaagaccagggtgctgctgggcaatgaaagctgcaccctgaccctgtctgagagcaccatgaacaccctgaagtgcaccgtgggccctgccatgaacaagcacttcaacatgagcatcatcatcagcaatggccacggcaccacccagtacagcaccttctcctatgtggaccctgtgatcaccagcatcagccccaagtatggccccatggccggcggcaccctgctgaccctgaccggcaactacctgaacagcggcaacagccgccacatcagcatcggcggcaagacctgcaccctgaagtctgtgagcaacagcatcctggagtgctacaccccagcccagaccatcagcacagaatttgctgtgaagctgaagattgacctggccaaccgggagaccagcatcttctcctaccgggaggaccccatcgtgtatgagatccaccccaccaagagcttcatcagcggcggcagcaccatcactggagtgggcaagaacctgaacagcgtgtctgtgcccaggatggtgatcaacgtgcatgaggccggcaggaacttcaccgtggcctgccagcacaggagcaacagcgagatcatctgctgcaccacccccagcctgcagcagctgaacctgcagctgcccctgaagaccaaggccttcttcatgctggatggcatcctgagcaagtactttgacctgatctacgtgcacaaccctgtgttcaagccctttgagaagcctgtgatgatctccatgggaaatgaaaatgtgctggagatcaagggaaatgacattgatcctgaggccgtgaagggggaggtgctgaaggtgggcaacaagagctgtgagaacatccacctgcacagcgaggccgtgctgtgcaccgtgcccaatgacctgctgaagctgaacagcgagctgaacatcgagtggaagcaggccatcagcagcacagtgctgggcaaggtgattgtgcagcctgaccagaacttcaccggcctgattgctggggtggtgtccatcagcacagccctgctgctgctgctgggcttcttcctgtggctgaagaagaggaagcagatcaaggacctgggcagcgagctggtgcgctatgatgcccgggtgcacaccccccacctggaccggctggtgtctgcccggtctgtgagccccaccacagagatggtgtccaatgaatctgtggactaccgggccaccttccctgaggaccagttccccaacagcagccagaatggcagctgccggcaggtgcagtaccccctgacagacatgagccccatcctgaccagcggggacagcgacatcagcagccccctgctgcagaacacagtgcacatcgacctgagcgccctgaaccctgagctggtgcaggccgtgcagcacgtggtgattggccccagcagcctgattgtgcacttcaatgaagtcatcggccggggccacttcggctgtgtgtaccacggcaccctgctggacaatgatggcaagaagatccactgtgctgtgaagagcctgaaccgcatcacagacatcggggaggtgtcccagttcctgacagagggcatcatcatgaaggacttcagccaccccaacgtgctgagcctgctgggcatctgcctgcggtctgagggcagccccctggtggtgctgccctacatgaagcacggggacctgaggaacttcatcagaaatgagacccacaaccccaccgtgaaggacctgattggcttcggcctgcaggtggccaagggcatgaagtacctggccagcaagaagtttgtgcaccgggacctggccgccaggaactgcatgctggatgagaagttcaccgtgaaggtggccgactttggcctggcccgggacatgtatgacaaggagtactacagcgtgcacaacaagacaggagccaagctgcctgtgaagtggatggccctggagagcctgcagacccagaagttcaccaccaagagtgatgtgtggagctttggagtgctgctgtgggagctgatgaccaggggggccccaccctacccagatgtgaacacctttgacatcaccgtgtacctgctgcagggccggcggctgctgcagcctgagtactgcccagaccccctgtatgaggtgatgctgaagtgctggcaccccaaggccgagatgaggcccagcttcagcgagctggtgagccgcatcagcgccatcttcagcaccttcatcggggagcactacgtgcacgtgaatgccacctacgtgaatgtgaagtgtgtggccccctaccccagcctgctgagcagcgaggacaatgctgatgatgaggtggacaccaggcctgccagcttctgggagaccagctag

SEQ ID NO: 20432 - DNA, 2295 bp, Artificial Sequence
  Description of Artificial Sequence: Synthetic coding sequence
atgaaggccccagctgtgctggcccctggcatcctggtgctgctcttcaccctggtgcagaggagcaatggagagtgcaaggaggccctggccaagtctgagatgaatgtgaacatgaagtaccagctgcccaacttcaccgctgagacccccatccagaatgtcatcctgcacgagcaccacatcttcctgggcgccaccaactacatctacgtgctgaatgaggaggacctgcagaaggtggccgagtacaagacaggccctgtgctggagcacccagactgcttcccctgccaggactgcagcagcaaggccaacctgagcggcggcgtgtggaaggacaacatcaacatggccctggtggtggacacctactatgatgaccagctgatcagctgtggctctgtgaacagaggcacctgccagagacatgtgttcccccacaaccacacagctgacatccagagcgaggtgcactgcatcttcagcccccagatcgaggagcccagccagtgcccagactgtgtggtgtctgccctgggcgccaaggtgctgagctctgtgaaggaccgcttcatcaacttctttgtgggcaacaccatcaacagcagctacttcccagaccaccccctgcacagcatctctgtgcggcggctgaaggagaccaaggatggcttcatgttcctgacagaccagagctacattgatgtgctgcctgagttccgggacagctaccccatcaagtatgtgcacgcctttgagagcaacaacttcatctacttcctgactgtgcagcgggagaccctggatgcccagaccttccacacccgcatcatccgcttctgcagcatcaacagcggcctgcacagctacatggagatgcccctggagtgcatcctgacagagaagaggaagaagaggagcaccaagaaggaggtgttcaacatcctgcaggccgcctacgtgtccaagccaggggcccagctggcccggcagattggagccagcctgaatgatgacatcctgtttggagtgtttgcccagagcaagccagattctgctgagcccatggacagaagtgccatgtgtgccttccccatcaagtatgtgaatgacttcttcaacaagatcgtgaacaagaacaacgtgcgctgcctgcagcacttctacggccccaaccacgagcactgcttcaacagaaccctgctgaggaacagcagcggctgtgaggccaggagagatgagtacagaacagagttcaccacagccctgcagagggtggacctcttcatgggccagttcagcgaggtgctgctgaccagcatcagcaccttcatcaagggggacctgaccatcgccaacctgggcaccagcgagggccgcttcatgcaggtggtggtgagccgcagcggccccagcaccccccacgtgaacttcctgctggacagccaccctgtgtccccagaggtgattgtggagcacaccctgaaccagaatggctacaccctggtgatcaccgggaagaagatcaccaagatccccctgaatggcctgggctgccgccacttccagagctgcagccagtgcctgagcgcccccccatttgtgcagtgtggctggtgccacgacaagtgtgtgcgctctgaggagtgcctgagcggcacctggacccagcagatctgcctgcctgccatctacaaggtgttccccaacagcgcccccctggagggcggcacccggctgaccatctgtggctgggactttggcttcagaagaaacaacaagtttgacctgaagaagaccagggtgctgctgggcaatgaaagctgcaccctgaccctgtctgagagcaccatgaacaccctgaagtgcaccgtgggccctgccatgaacaagcacttcaacatgagcatcatcatcagcaatggccacggcaccacccagtacagcaccttctcctatgtggaccctgtgatcaccagcatcagccccaagtatggccccatggccggcggcaccctgctgaccctgaccggcaactacctgaacagcggcaacagccgccacatcagcatcggcggcaagacctgcaccctgaagtctgtgagcaacagcatcctggagtgctacaccccagcccagaccatcagcacagaatttgctgtgaagctgaagattgacctggccaaccgggagaccagcatcttctcctaccgggaggaccccatcgtgtatgagatccaccccaccaagagcttcatccgccacgtgaacatcgccctgatccagaggtag

SEQ ID NO: 20433 - DNA, 783 bp, Artificial Sequence
  Description of Artificial Sequence: Synthetic coding sequence
atgaaggacttcagccaccccaacgtgctgagcctgctgggcatctgcctgcggtctgagggcagccccctggtggtgctgccctacatgaagcacggggacctgaggaacttcatcagaaatgagacccacaaccccaccgtgaaggacctgattggcttcggcctgcaggtggccaagggcatgaagtacctggccagcaagaagtttgtgcaccgggacctggccgccaggaactgcatgctggatgagaagttcaccgtgaaggtggccgactttggcctggcccgggacatgtatgacaaggagtactacagcgtgcacaacaagacaggagccaagctgcctgtgaagtggatggccctggagagcctgcagacccagaagttcaccaccaagagtgatgtgtggagctttggagtgctgctgtgggagctgatgaccaggggggccccaccctacccagatgtgaacacctttgacatcaccgtgtacctgctgcagggccggcggctgctgcagcctgagtactgcccagaccccctgtatgaggtgatgctgaagtgctggcaccccaaggccgagatgaggcccagcttcagcgagctggtgagccgcatcagcgccatcttcagcaccttcatcggggagcactacgtgcacgtgaatgccacctacgtgaatgtgaagtgtgtggccccctaccccagcctgctgagcagcgaggacaatgctgatgatgaggtggacaccaggcctgccagcttctgggagaccagctag

SEQ ID NO: 20434 - DNA, 1749 bp, Artificial Sequence
  Description of Artificial Sequence: Synthetic coding sequence
atggccgcccgctcctggcaggatgagctggcccagcaggccgaggagggcagcgcccggctgcgggagatgctgtctgtgggcctgggcttcctgaggacagagctgggcctggacctgggcctggagcccaagcgctacccaggctgggtgatcctggtgggcaccggggccctgggcctgctgctgctcttcctgctgggctacggctgggccgccgcctgtgccggggccaggaagaagaggaggagcccccccaggaagcgggaggaggccgctgctgtgcctgctgctgccccagatgacctggccctgctgaagaacctgcggtctgaggagcagaagaagaagaacaggaagaagctgtctgagaagcccaagcccaatggaagaacagtggaggtggccgagggggaggccgtgaggaccccccagagcgtgacagccaagcagcccccagaaattgacaagaagaatgagaagagcaagaagaacaagaagaagagcaagagtgatgccaaggctgtgcagaacagcagcagacatgatggcaaggaggtggatgagggcgcctgggagaccaagatcagccaccgggagaagaggcagcagaggaagagggacaaggtgctgacagacagcggcagcctggacagcaccatccctggcatcgagaacaccatcaccgtgaccacagagcagctgaccacagccagcttccctgtgggcagcaagaagaacaagggggacagccacctgaatgtgcaggtgagcaacttcaagagcggcaagggggacagcaccctgcaggtgagcagcggcctgaatgaaaacctgactgtgaatggaggcggctggaatgagaagtctgtgaagctgagcagccagatctctgctggggaggagaagtggaacagcgtgtccccagccagcgctgggaagaggaagacagagcccagcgcctggagccaggacacaggagatgccaacaccaacgggaaggactggggccgctcctggagcgacaggagcatcttctctggaattggcagcacagctgagcctgtgtcccagagcaccaccagtgactaccagtgggatgtgtccaggaaccagccctacattgatgatgagtggagcggcctgaatggcctgagcagcgctgaccccaacagcgactggaatgccccagctgaggagtggggcaactgggtggatgaggagcgggccagcctgctgaagagccaggagcccatcccagatgaccagaaggtgtctgatgatgacaaggagaagggggagggcgccctgcccaccgggaagagcaagaagaagaagaagaagaagaagaagcagggcgaggacaacagcacagcccaggacacagaggagctggagaaggagatccgggaggacctgcctgtgaacaccagcaagacccggcccaagcaggagaaggccttcagcctgaagaccatcagcaccagtgaccctgctgaggtgctggtgaagaacagccagcccatcaagaccctgcccccagccaccagcacagagcccagcgtcatcctgagcaagagtgacagcgacaagagcagcagccaggtgccccccatcctgcaggagacagacaagagcaagagcaacaccaagcagaacagcgtgccccccagccagaccaagtctgagacctcctgggagagccccaagcagatcaagaagaagaagaaggcccggcgggagacctag

SEQ ID NO: 20435 - DNA, 2148 bp, Artificial Sequence
  Description of Artificial Sequence: Synthetic coding sequence
atggccgccaacatgtacagagtgggggactatgtgtactttgagaacagcagcagcaacccctacctgatcagaagaattgaggagctgaacaagacagccaatggaaatgtggaggccaaggtggtgtgcttctacagaagaagagacatcagcagcaccctcatcgccctggccgacaagcacgccaccctgtctgtgtgctacaaggccggccctggagctgacaatggagaggagggggagattgaggaggagatggagaaccctgagatggtggacctgcctgagaagctgaagcaccagctgcggcaccgggagctgttcctgagccggcagctggagagcctgcctgccacccacatccggggcaaatgttctgtgaccctgctgaatgaaacagagagcctgaagagctacctggagcgggaggacttcttcttctacagcctggtgtatgacccccagcagaagaccctgctggccgacaagggggagatccgggtgggcaaccgctaccaggccgacatcacagacctgctgaaggagggggaggaggatggccgggaccagagccggctggagacccaggtgtgggaggcccacaaccccctgacagacaagcagattgaccagttcctggtggtggcccggtctgtgggcacctttgcccgggccctggactgcagcagctctgtgcggcagcccagcctgcacatgtctgctgctgctgccagccgggacatcaccctcttccacgccatggacaccctgcacaagaacatctatgacatcagcaaggccatcagcgccctggtgccccagggcggccctgtgctgtgcagagatgagatggaggagtggagcgccagcgaggccaacctgtttgaggaggccctggagaagtatggcaaggacttcacagacatccagcaggacttcctgccctggaagagcctgaccagcatcatcgagtactactacatgtggaagaccacagaccgctacgtgcagcagaagaggctgaaggctgctgaggccgagagcaagctgaagcaggtgtacatccccaactacaacaagcccaaccccaaccagatctctgtgaacaacgtgaaggccggcgtggtgaatggcaccggggcccctggccagagccctggagctggccgggcctgtgagagctgctacaccacccagagctaccagtggtacagctggggcccccccaacatgcagtgccgcctgtgtgccagctgctggacctactggaagaagtatggaggcctgaagatgcccacccggctggatggagagaggcctggccccaacagaagcaacatgagcccccacggcctgcctgcccggagcagcggcagccccaagtttgccatgaagacccggcaggccttctacctgcacaccaccaagctgaccagaattgcccggcggctgtgccgggagatcctgcggccctggcatgctgcccggcacccctacctgcccatcaacagcgctgccatcaaggcagaatgtacagcccggctgcctgaggccagccagagccccctggtgctgaagcaggccgtgaggaagcccctggaggccgtgctgcgctacctggagacccaccccaggcctcccaagccagaccctgtgaagtctgtgtcctctgtgctgagcagcctgaccccagccaaggtggcccctgtgatcaacaacggcagccccaccatcctgggcaagaggagctatgagcagcacaatggagtggatggcaacatgaagaagaggctgctgatgcccagccggggcctggccaaccacggccaggcccggcacatgggccccagcaggaacctgctgctgaatggcaagagctaccccaccaaggtgcggctcatccggggcggcagcctgccccctgtgaagagaagaaggatgaactggattgatgccccagatgatgtgttctacatggccacagaggagaccaggaagatcaggaagctgctgagcagcagcgagaccaagagagctgcccggcggccctacaagcccatcgccctgcggcagagccaggccctgcccccccggcccccacctccagcccctgtgaatgatgagcccatcgtgattgaggactag

SEQ ID NO: 20436 - DNA, 1887 bp, Artificial Sequence
  Description of Artificial Sequence: Synthetic coding sequence
atggtggacctgcctgagaagctgaagcaccagctgcggcaccgggagctgttcctgagccggcagctggagagcctgcctgccacccacatccggggcaagtgcagcgtgaccctgctgaatgaaacagagagcctgaagagctacctggagcgggaggacttcttcttctacagcctggtgtatgacccccagcagaagaccctgctggccgacaagggggagatccgggtgggcaaccgctaccaggccgacatcacagacctgctgaaggagggggaggaggatggccgggaccagagccggctggagacccaggtgtgggaggcccacaaccccctgacagacaagcagattgaccagttcctggtggtggcccggtctgtgggcacctttgcccgggccctggactgcagcagctctgtgcggcagcccagcctgcacatgtctgctgctgctgccagccgggacatcaccctcttccacgccatggacaccctgcacaagaacatctatgacatcagcaaggccatcagcgccctggtgccccagggcggccctgtgctgtgcagagatgagatggaggagtggagcgccagcgaggccaacctgtttgaggaggccctggagaagtatggcaaggacttcacagacatccagcaggacttcctgccctggaagagcctgaccagcatcatcgagtactactacatgtggaagaccacagacagatatgtgcagcagaagaggctgaaggctgctgaggccgagagcaagctgaagcaggtgtacatccccaactacaacaagcccaaccccaaccagatctctgtgaacaacgtgaaggccggcgtggtgaatggaactggagcccctggccagagccctggggccggccgggcctgtgagagctgctacaccacccagagctaccagtggtacagctggggcccccccaacatgcagtgccgcctgtgtgccagctgctggacctactggaagaagtatggaggcctgaagatgcccacccggctggatggagagcggcccggccccaacagaagcaacatgagcccccacggcctgcctgcccggagcagcggcagccccaagtttgccatgaagacccggcaggccttctacctgcacaccaccaagctgacccgcatcgcccggcggctgtgccgggagatcctgcggccctggcacgccgcccggcacccctacctgcccatcaacagcgctgccatcaaggccgagtgcacagcccggctgcctgaggccagccagagccccctggtgctgaagcaggccgtgaggaagcccctggaggccgtgctgcgctacctggagacccacccccggccccccaagccagaccctgtgaagtctgtgtcctctgtgctgagcagcctgaccccagccaaggtggcccctgtgatcaacaacggcagccccaccatcctgggcaagaggagctatgagcagcacaacggggtggatggcaacatgaagaagaggctgctgatgcccagccggggcaccagcagcggcctggccaaccacggccaggcccggcacatgggccccagcaggaacctgctgctgaatggcaagagctaccccaccaaggtgcggctcatccggggcggcagcctgccccctgtgaagagaagaaggatgaactggattgatgccccagatgatgtgttctacatggccacagaggagaccaggaagatcaggaagctgctgagcagcagcgagaccaagagagctgcccggcggccctacaagcccatcgccctgcggcagagccaggccctgccccccaggcctcctcctccagcccctgtgaatgatgagcccatcgtgattgaagattag

SEQ ID NO: 20437 - DNA, 768 bp, Artificial Sequence
  Description of Artificial Sequence: Synthetic coding sequence
atgaagacccggcaggccttctacctgcacaccaccaagctgaccagaattgcccggcggctgtgccgggagatcctgcggccctggcatgctgcccggcacccctacctgcccatcaacagcgctgccatcaaggcagaatgtacagcccggctgcctgaggccagccagagccccctggtgctgaagcaggccgtgaggaagcccctggaggccgtgctgcgctacctggagacccaccccaggcctcccaagccagaccctgtgaagtctgtgtcctctgtgctgagcagcctgaccccagccaaggtggcccctgtgatcaacaacggcagccccaccatcctgggcaagaggagctatgagcagcacaatggagtggatggcaacatgaagaagaggctgctgatgcccagccggggcacctacctgggcctggccaaccacggccaggcccggcacatgggccccagcaggaacctgctgctgaatggcaagagctaccccaccaaggtgcggctcatccggggcggcagcctgccccctgtgaagagaagaaggatgaactggattgatgccccagatgatgtgttctacatggccacagaggagaccaggaagatcaggaagctgctgagcagcagcgagaccaagagagctgcccggcggccctacaagcccatcgccctgcggcagagccaggccctgcccccccggcccccacctccagcccctgtgaatgatgagcccatcgtgattgaggactag

SEQ ID NO: 20438 - DNA, 1293 bp, Artificial Sequence
  Description of Artificial Sequence: Synthetic coding sequence
atggccgccaacatgtacagagtgggggactatgtgtactttgagaacagcagcagcaacccctacctgatcagaagaattgaggagctgaacaagacagccaatggaaatgtggaggccaaggtggtgtgcttctacagaagaagagacatcagcagcaccctcatcgccctggccgacaagcacgccaccctgtctgtgtgctacaaggccggccctggagctgacaatggagaggagggggagattgaggaggagatggagaaccctgagatggtggacctgcctgagaagctgaagcaccagctgcggcaccgggagctgttcctgagccggcagctggagagcctgcctgccacccacatccggggcaaatgttctgtgaccctgctgaatgaaacagagagcctgaagagctacctggagcgggaggacttcttcttctacagcctggtgtatgacccccagcagaagaccctgctggccgacaagggggagatccgggtgggcaaccgctaccaggccgacatcacagacctgctgaaggagggggaggaggatggccgggaccagagccggctggagacccaggtgtgggaggcccacaaccccctgacagacaagcagattgaccagttcctggtggtggcccggtctgtgggcacctttgcccgggccctggactgcagcagctctgtgcggcagcccagcctgcacatgtctgctgctgctgccagccgggacatcaccctcttccacgccatggacaccctgcacaagaacatctatgacatcagcaaggccatcagcgccctggtgccccagggcggccctgtgctgtgcagagatgagatggaggagtggagcgccagcgaggccaacctgtttgaggaggccctggagaagtatggcaaggacttcacagacatccagcaggacttcctgccctggaagagcctgaccagcatcatcgagtactactacatgtggaagaccacagaccgctacgtgcagcagaagaggctgaaggctgctgaggccgagagcaagctgaagcaggtgtacatccccaactacaacaagcccaaccccaaccagatctctgtgaacaacgtgaaggccggcgtggtgaatggcaccggggcccctggccagagccctggagctggccgggcctgtgagagctgctacatgagcagcctgcgcatcctgctggacatcctggaggagatctggtggctggagaatgccaaccctgtgcgctggagggaggcccggaccaagccccagtag

SEQ ID NO: 20439 - DNA, 1422 bp, Artificial Sequence
  Description of Artificial Sequence: Synthetic coding sequence
atgctgcggcctgtgattgaggaggagatctccatgctgggggagatcacccacctgcagaccatcagcgaggacctgaagagcctgaccatggacccccacaagctgcccagcagcagcgagcaggtgatcctggacctgaagggcagtgactacagctggagctaccagaccccacccagcagccccagcaccaccatgagcaggaagagctctgtgtgcagcagcctgaacagcgtgaacagcagtgacagccgcagcagcggcagccacagccacagccccagcagccactaccgctaccgcagcagcaacctggcccagcaggcccctgtgcggctgagctctgtgagcagccatgacagcggcttcatcagccaggatgccttccagagcaagagccccagccccatgcctcctgaggcccccaaccagaggaggaaggagaagcgggagccagaccccaacggcggcggccccaccacagccagcggccccccagctgctgctgaggaggcccagaggcccaggtccatgacagtgtctgctgccaccaggcctggagaggagatggaggcctgtgaggagctggccctggccctgagccggggcctgcagctggacacccagaggagcagccgggacagcctgcagtgcagcagcggctacagcacccagaccaccaccccctgctgcagcgaggacaccatccccagccaggtgtctgactatgactacttctctgtgtctggggaccaggaggccgaccagcaggagtttgacaagagcagcaccatccccaggaacagcgacatcagccagagctacagaaggatgttccaggccaagaggcctgccagcacagctggcctgcccaccaccctgggccctgccatggtgaccccaggagtggccaccatccggaggacccccagcaccaagcccagcgtgcggcggggcaccatcggggccggccccatccccatcaagacccctgtgattcctgtgaagacccccaccgtgcctgacctgcccggggtgctgcctgcccccccagatggccctgaggagcggggggagcacagccctgagagccccagcgtgggggagggcccccagggcgtgacctccatgcccagctccatgtggagcggccaggcctctgtgaacccccccctgcccggccccaagcccagcatccctgaggagcaccggcaggccatccctgagagcgaggccgaggaccaggagcgggagccccccagcgccaccgtgtccccaggccagatccctgagagtgaccctgctgacctgagcccccgggacaccccccagggcgaggacatgctgaatgccatccggcggggcgtgaagctgaagaagaccaccaccaatgacagaagtgccccccgcttctcctag

SEQ ID NO: 20440 - DNA, 2193 bp, Artificial Sequence
  Description of Artificial Sequence: Synthetic coding sequence
atggaggccgtgattgagaaggagtgcagcgccctgggcggcctcttccagaccatcatcagtgacatgaagggcagctaccctgtgtgggaggacttcatcaacaaggccggcaagctgcagagccagctgcggaccaccgtggtggccgccgccgccttcctggatgccttccagaaggtggccgacatggccaccaacacccggggcggcacccgggagatcggcagcgccctgaccaggatgtgcatgaggcacaggagcattgaggccaagctgcggcagttcagcagcgccctgattgactgcctgatcaaccccctgcaggagcagatggaggagtggaagaaggtggccaaccagctggacaaggaccacgccaaggagtacaagaaggcccggcaggagatcaagaagaagagcagtgacaccctgaagctgcagaagaaggccaagaagggccgcggggacatccagccccagctggacagcgccctgcaggatgtgaatgacaagtacctgctgctggaggagacagagaagcaggccgtgaggaaggccctgattgaggagcggggccgcttctgcaccttcatctccatgctgcggcctgtgattgaggaggagatctccatgctgggggagatcacccacctgcagaccatcagcgaggacctgaagagcctgaccatggacccccacaagctgcccagcagcagcgagcaggtgatcctggacctgaagggcagtgactacagctggagctaccagaccccacccagcagccccagcaccaccatgagcaggaagagctctgtgtgcagcagcctgaacagcgtgaacagcagtgacagccgcagcagcggcagccacagccacagccccagcagccactaccgctaccgcagcagcaacctggcccagcaggcccctgtgcggctgagctctgtgagcagccatgacagcggcttcatcagccaggatgccttccagagcaagagccccagccccatgcctcctgaggcccccaaccagaacagcagcagcagcgccagcagcgaggccagcgagacctgccagagcgtgtctgagtgcagcagccccacctctgtgagcagcggcagcaccatgggcgcctgggtgtccacagagaaggactgggccaagccaggcccctatgaccagcccctggtgaacaccctgcagaggaggaaggagaagcgggagccagaccccaatggaggcggccccaccacagccagcggccccccagctgctgctgaggaggcccagaggcccaggtccatgacagtgtctgctgccaccaggcctggagaggagatggaggcctgtgaggagctggccctggccctgagccggggcctgcagctggacacccagaggagcagccgggacagcctgcagtgcagcagcggctacagcacccagaccaccaccccctgctgcagcgaggacaccatccccagccaggtgtctgactatgactacttctctgtgtctggggaccaggaggccgaccagcaggagtttgacaagagcagcaccatccccaggaacagcgacatcagccagagctacagaaggatgttccaggccaagaggcctgccagcacagctggcctgcccaccaccctgggccctgccatggtgaccccaggagtggccaccatccggaggacccccagcaccaagcccagcgtgagaagaggcaccatcggggccggccccatccccatcaagacccctgtgattcctgtgaagacccccaccgtgcctgacctgcccggggtgctgcctgcccccccagatggccctgaggagcggggggagcacagccctgagagccccagcgtgggggagggcccccagggcgtgacctccatgcccagctccatgtggagcggccaggcctctgtgaacccccccctgcccggccccaagcccagcatccctgaggagcaccggcaggccatccctgagagcgaggccgaggaccaggagcgggagcccccatctgccaccgtgtccccaggccagatccctgagagtgaccctgctgacctgagcccccgggacaccccccagggcgaggacatgctgaatgccatcagaagaggagtgaagctgaagaagaccaccaccaatgacagaagtgccccccgcttctcctag

SEQ ID NO: 20441 - DNA, 1590 bp, Artificial Sequence
  Description of Artificial Sequence: Synthetic coding sequence
atgagcaggaagagctctgtgtgcagcagcctgaacagcgtgaacagcagtgacagccgcagcagcggcagccacagccacagccccagcagccactaccgctaccgcagcagcaacctggcccagcaggcccctgtgcggctgagctctgtgagcagccatgacagcggcttcatcagccaggatgccttccagagcaagagccccagccccatgcctcctgaggcccccaaccagaacagcagcagcagcgccagcagcgaggccagcgagacctgccagagcgtgtctgagtgcagcagccccacctctgtgagcagcggcagcaccatgggcgcctgggtgtccacagagaagctgagcaatggcttcagccactacagcctgagcagcgagagccacgtgggccccaccggggccggcctcttcccccactgcctgcctgccagccggctgctgccccgggtgacctctgtgcacctgcctgactatgcccactactacaccatcggccctggcatgttccccagcagccagatccccagctggaaggactgggccaagccaggcccctatgaccagcccctggtgaacaccctgcagaggaggaaggagaagcgggagccagaccccaacggcggcggccccaccacagccagcggccccccagctgctgctgaggaggcccagaggcccaggtccatgacagtgtctgctgccaccaggcctggagaggagatggaggcctgtgaggagctggccctggccctgagccggggcctgcagctggacacccagaggagcagccgggacagcctgcagtgcagcagcggctacagcacccagaccaccaccccctgctgcagcgaggacaccatccccagccaggtgtctgactatgactacttctctgtgtctggggaccaggaggccgaccagcaggagtttgacaagagcagcaccatccccaggaacagcgacatcagccagagctacagaaggatgttccaggccaagaggcctgccagcacagctggcctgcccaccaccctgggccctgccatggtgaccccaggagtggccaccatccggaggacccccagcaccaagcccagcgtgcggcggggcaccatcggggccggccccatccccatcaagacccctgtgattcctgtgaagacccccaccgtgcctgacctgcccggggtgctgcctgcccccccagatggccctgaggagcggggggagcacagccctgagagccccagcgtgggggagggcccccagggcgtgacctccatgcccagctccatgtggagcggccaggcctctgtgaacccccccctgcccggccccaagcccagcatccctgaggagcaccggcaggccatccctgagagcgaggccgaggaccaggagcgggagccccccagcgccaccgtgtccccaggccagatccctgagagtgaccctgctgacctgagcccccgggacaccccccagggcgaggacatgctgaatgccatccggcggggcgtgaagctgaagaagaccaccaccaatgacagaagtgccccccgcttctcctag

SEQ ID NO: 20442 - DNA, 2268 bp, Artificial Sequence
  Description of Artificial Sequence: Synthetic coding sequence
atggaggccgtgattgagaaggagtgcagcgccctgggcggcctcttccagaccatcatcagtgacatgaagggcagctaccctgtgtgggaggacttcatcaacaaggccggcaagctgcagagccagctgcggaccaccgtggtggccgccgccgccttcctggatgccttccagaaggtggccgacatggccaccaacacccggggcggcacccgggagatcggcagcgccctgaccaggatgtgcatgaggcacaggagcattgaggccaagctgcggcagttcagcagcgccctgattgactgcctgatcaaccccctgcaggagcagatggaggagtggaagaaggtggccaaccagctggacaaggaccacgccaaggagtacaagaaggcccggcaggagatcaagaagaagagcagtgacaccctgaagctgcagaagaaggccaagaagggccgcggggacatccagccccagctggacagcgccctgcaggatgtgaatgacaagtacctgctgctggaggagacagagaagcaggccgtgaggaaggccctgattgaggagcggggccgcttctgcaccttcatctccatgctgcggcctgtgattgaggaggagatctccatgctgggggagatcacccacctgcagaccatcagcgaggacctgaagagcctgaccatggacccccacaagctgcccagcagcagcgagcaggtgatcctggacctgaagggcagtgactacagctggagctaccagaccccacccagcagccccagcaccaccatgagcaggaagagctctgtgtgcagcagcctgaacagcgtgaacagcagtgacagccgcagcagcggcagccacagccacagccccagcagccactaccgctaccgcagcagcaacctggcccagcaggcccctgtgcggctgagctctgtgagcagccatgacagcggcttcatcagccaggatgccttccagagcaagagccccagccccatgcctcctgaggcccccaaccagctgagcaatggcttcagccactacagcctgagcagcgagagccacgtgggccccaccggggccggcctcttcccccactgcctgcctgccagccggctgctgccccgggtgacctctgtgcacctgcctgactatgcccactactacaccatcggccctggcatgttccccagcagccagatccccagctggaaggactgggccaagccaggcccctatgaccagcccctggtgaacaccctgcagaggaggaaggagaagcgggagccagaccccaacggcggcggccccaccacagccagcggccccccagctgctgctgaggaggcccagaggcccaggtccatgacagtgtctgctgccaccaggcctggagaggagatggaggcctgtgaggagctggccctggccctgagccggggcctgcagctggacacccagaggagcagccgggacagcctgcagtgcagcagcggctacagcacccagaccaccaccccctgctgcagcgaggacaccatccccagccaggtgtctgactatgactacttctctgtgtctggggaccaggaggccgaccagcaggagtttgacaagagcagcaccatccccaggaacagcgacatcagccagagctacagaaggatgttccaggccaagaggcctgccagcacagctggcctgcccaccaccctgggccctgccatggtgaccccaggagtggccaccatccggaggacccccagcaccaagcccagcgtgcggcggggcaccatcggggccggccccatccccatcaagacccctgtgattcctgtgaagacccccaccgtgcctgacctgcccggggtgctgcctgcccccccagatggccctgaggagcggggggagcacagccctgagagccccagcgtgggggagggcccccagggcgtgacctccatgcccagctccatgtggagcggccaggcctctgtgaacccccccctgcccggccccaagcccagcatccctgaggagcaccggcaggccatccctgagagcgaggccgaggaccaggagcgggagccccccagcgccaccgtgtccccaggccagatccctgagagtgaccctgctgacctgagcccccgggacaccccccagggcgaggacatgctgaatgccatccggcggggcgtgaagctgaagaagaccaccaccaatgacagaagtgccccccgcttctcctag

SEQ ID NO: 20443 - DNA, 1437 bp, Artificial Sequence
  Description of Artificial Sequence: Synthetic coding sequence
atggccggcgtggaggaggtggccgccagcggcagccacctgaatggagacctggaccctgatgaccgggaggagggcgccgccagcacagctgaggaggccgccaagaagaagaggaggaagaagaagaagagcaagggccccagcgctgctggggagcaggagccagacaaggagagcggggcctctgtggatgaggtggcccggcagctggagaggtctgccctggaggacaaggagagagatgaagatgatgaagatggagatggagatggagatggagccaccgggaagaagaagaagaagaagaagaagaagaggggccccaaggtgcagacagatcctccttctgtgcccatctgtgacctgtaccccaacggggtcttccccaagggccaggagtgtgagtacccacccacccaggacggccgcacagctgcctggaggaccaccagcgaggagaagaaggccctggaccaggccagcgaggagatctggaatgacttccgggaggccgctgaggcccaccggcaggtgaggaaatatgtgatgtcctggatcaagccaggcatgaccatgattgagatctgtgagaagctggaggactgcagcaggaagctgatcaaggaaaatggcctgaatgccggcctggccttccccaccggctgcagcctgaacaactgtgccgcccactacaccccaaatgctggggacaccaccgtgctgcagtatgatgacatctgcaagattgactttggcacccacatcagcggccgcatcatcgactgtgccttcaccgtgaccttcaaccccaagtatgacaccctgctgaaggctgtgaaggatgccaccaacacaggcatcaagtgtgccggcattgatgtgcggctgtgtgatgtgggggaggccatccaggaggtgatggagagctatgaggtggagattgatggcaagacctaccaggtgaagcccatccggaacctgaatggccacagcatcggccagtaccgcatccacgccggcaagacagtgcccatcgtgaagggcggggaggccaccaggatggaggagggggaggtgtatgccatcgagaccttcggcagcactggaaaaggagtggtgcatgatgacatggagtgcagccactacatgaagaactttgatgtgggccacgtgcccatccggctgcccaggaccaagcacctgctgaatgtcatcaatgaaaattttggcaccctggccttctgccgccgctggctggaccggctgggggagagcaagtacctgatggccctgaagaacctgtgtgacctgggcatcgtggacccctacccacccctgtgtgacatcaagggcagctacacagcccagtttgagcacaccatcctgctgcggcccacctgcaaggaggtggtgtccagaggagatgactactag

SEQ ID NO: 20444 - DNA, 1743 bp, Artificial Sequence
  Description of Artificial Sequence: Synthetic coding sequence
atgggcaccaccggcctggagagcctgagcctgggggacagaggagctgcccccaccgtgaccagcagcgagcggctggtgcctgaccccccaaatgacctgaggaaagaagatgtggccatggagctggagcgggtgggggaggatgaggagcagatgatgatcaagaggagcagcgagtgcaaccccctgctgcaggagcccatcgccagcgcccagtttggagccacagctggaacagaatgtaggaagtctgtgccctgtggctgggagcgggtggtgaagcagaggctgtttgggaagacagctggccgctttgatgtgtacttcatcagcccccagggcctgaagttccgcagcaagagcagcctggccaactacctgcacaagaatggagagaccagcctgaagccagaagattttgacttcaccgtgctgagcaagaggggcatcaagagccgctacaaggactgcagcatggccgccctgaccagccacctgcagaaccagagcaacaacagcaactggaacctgcggaccaggagcaagtgcaagaaggatgtgttcatgccacccagcagcagcagcgagctgcaggagagccggggcctgagcaacttcaccagcacccacctgctgctgaaggaggatgaaggagtggatgatgtgaacttcaggaaggtgaggaagcccaagggcaaggtgaccatcctgaagggcatccccatcaagaagaccaagaagggctgcaggaagagctgcagcggctttgtgcagagcgacagcaagcgggagagcgtgtgcaacaaggcagatgctgagagcgagcctgtggcccagaagagccagctggacagaacagtgtgcatcagtgatgctggggcctgtggggagaccctgtctgtgaccagcgaggagaacagcctggtgaagaagaaggagaggagcctgagcagcggcagcaacttctgcagcgagcagaagaccagcggcatcatcaacaagttctgcagcgccaaggacagcgagcacaatgagaagtatgaggacaccttcctggagagcgaggagatcggcaccaaggtggaggtggtggagaggaaggagcacctgcacacagacatcctgaagaggggcagcgagatggacaacaactgcagccccaccaggaaggacttcaccggggagaagatcttccaggaggacaccatccccaggacccagattgaaagaaggaagaccagcctgtacttcagcagcaagtacaacaaggaggccctgagcccccccaggaggaaggccttcaagaagtggaccccacccaggagccccttcaacctggtgcaggagaccctcttccatgacccctggaagctgctgattgccaccatcttcctgaacagaaccagcggcaagatggccatccctgtgctgtggaagttcctggagaagtaccccagcgctgaggtggccaggacagctgactggagagatgtgtctgagctgctgaagcccctgggcctgtatgacctgcgggccaagaccatcgtgaagttcagtgatgagtacctgaccaagcagtggaagtaccccatcgagctgcatggaattggcaagtatggaaatgacagctaccgcatcttctgtgtgaatgagtggaagcaggtgcaccctgaggaccacaagctgaacaagtaccatgactggctgtgggagaaccacgagaagctgagcctgtcctag

SEQ ID NO: 20445 - DNA, 789 bp, Artificial Sequence
  Description of Artificial Sequence: Synthetic coding sequence
atgggcaccaccggcctggagagcctgagcctgggggacagaggagctgcccccaccgtgaccagcagcgagcggctggtgcctgaccccccaaatgacctgaggaaagaagatgtggccatggagctggagcgggtgggggaggatgaggagcagatgatgatcaagaggagcagcgagtgcaaccccctgctgcaggagcccatcgccagcgcccagtttggagccacagctggaacagagtgccaggacaccatccccaggacccagattgaaagaaggaagaccagcctgtacttcagcagcaagtacaacaaggaggccctgagcccccccaggaggaaggccttcaagaagtggaccccacccaggagccccttcaacctggtgcaggagaccctcttccatgacccctggaagctgctgattgccaccatcttcctgaacagaaccagcggcaagatggccatccctgtgctgtggaagttcctggagaagtaccccagcgctgaggtggccaggacagctgactggagagatgtgtctgagctgctgaagcccctgggcctgtatgacctgcgggccaagaccatcgtgaagttcagtgatgagtacctgaccaagcagtggaagtaccccatcgagctgcatggaattggcaagtatggaaatgacagctaccgcatcttctgtgtgaatgagtggaagcaggtgcaccctgaggaccacaagctgaacaagtaccatgactggctgtgggagaaccacgagaagctgagcctgtcctag

SEQ ID NO: 20446 - DNA, 1725 bp, Artificial Sequence
  Description of Artificial Sequence: Synthetic coding sequence
atgggcaccaccggcctggagagcctgagcctgggggacagaggagctgcccccaccgtgaccagcagcgagcggctggtgcctgaccccccaaatgacctgaggaaagaagatgtggccatggagctggagcgggtgggggaggatgaggagcagatgatgatcaagaggagcagcgagtgcaaccccctgctgcaggagcccatcgccagcgcccagtttggagccacagctggaacagaatgtaggaagtctgtgccctgtggctgggagcgggtggtgaagcagaggctgtttgggaagacagctggccgctttgatgtgtacttcatcagcccccagggcctgaagttccgcagcaagagcagcctggccaactacctgcacaagaatggagagaccagcctgaagccagaagattttgacttcaccgtgctgagcaagaggggcatcaagagccgctacaaggactgcagcatggccgccctgaccagccacctgcagaaccagagcaacaacagcaactggaacctgcggaccaggagcaagtgcaagaaggatgtgttcatgccacccagcagcagcagcgagctgcaggagagccggggcctgagcaacttcaccagcacccacctgctgctgaaggaggatgaaggagtggatgatgtgaacttcaggaaggtgaggaagcccaagggcaaggtgaccatcctgaagggcatccccatcaagaagaccaagaagggctgcaggaagagctgcagcggctttgtgcagagcgacagcaagcgggagagcgtgtgcaacaaggcagatgctgagagcgagcctgtggcccagaagagccagctggacagaacagtgtgcatcagtgatgctggggcctgtggggagaccctgtctgtgaccagcgaggagaacagcctggtgaagaagaaggagaggagcctgagcagcggcagcaacttctgcagcgagcagaagaccagcggcatcatcaacaagttctgcagcgccaaggacagcgagcacaatgagaagtatgaggacaccttcctggagagcgaggagatcggcaccaaggtggaggtggtggagaggaaggagcacctgcacacagacatcctgaagaggggcagcgagatggacaacaactgcagccccaccaggaaggacttcacagaggacaccatccccaggacccagattgaaagaaggaagaccagcctgtacttcagcagcaagtacaacaaggaggccctgagcccccccaggaggaaggccttcaagaagtggaccccacccaggagccccttcaacctggtgcaggagaccctcttccatgacccctggaagctgctgattgccaccatcttcctgaacagaaccagcggcaagatggccatccctgtgctgtggaagttcctggagaagtaccccagcgctgaggtggccaggacagctgactggagagatgtgtctgagctgctgaagcccctgggcctgtatgacctgcgggccaagaccatcgtgaagttcagtgatgagtacctgaccaagcagtggaagtaccccatcgagctgcatggaattggcaagtatggaaatgacagctaccgcatcttctgtgtgaatgagtggaagcaggtgcaccctgaggaccacaagctgaacaagtaccatgactggctgtgggagaaccacgagaagctgagcctgtcctag

SEQ ID NO: 20447 - DNA, 93 bp, Artificial Sequence
  Description of Artificial Sequence: Synthetic coding sequence
atggtgaatgaggcccggggcaacagcagcctgaacccctgcctggagggcagcgccagcagcggcagcgagagcagcaaggacagcagctag

SEQ ID NO: 20448 - DNA, 2094 bp, Artificial Sequence
  Description of Artificial Sequence: Synthetic coding sequence
atggaccacaggaaggcccgggtgctgcctgctggccactactgccccagcctgggcatctgggccagccaggtgggctctgtgcgcagctctgtgcccccatccatcagcaggaacccagccatggtgaatgaggcccggggcaacagcagcctgaacccctgcctggagggcagcgccagcagcggcagcgagagcagcaaggacagcagccgctgcagcaccccaggcctggaccctgagagacatgagcggctgcgggagaagatgagaagaaggctggagagcggggacaagtggttcagcctggagttcttcccccccaggacagctgagggcgctgtgaacctgatcagcagatttgacaggatggccgccggcggccccctgtacattgatgtgacctggcaccctgctggggaccccggcagtgacaaggagaccagctccatgatgattgccagcacagctgtgaactactgcggcctggagaccatcctgcacatgacctgctgccggcagaggctggaggagatcaccggccacctgcacaaggccaagcagctgggcctgaagaacatcatggccctgcggggggaccccatcggggaccagtgggaggaggaggagggcggcttcaactatgctgtggacctggtgaagcacatccgctcagaatttggagactactttgacatctgtgtggccggctaccccaagggccaccctgaggccggcagctttgaggccgacctgaagcacctgaaggagaaggtgtctgctggagctgacttcatcatcacccagctgttctttgaggccgacaccttcttccgctttgtgaaggcctgcacagacatgggcatcacctgccccatcgtgcccggcatcttccccatccagggctaccacagcctgcggcagctggtgaagctgagcaagctggaggtgccccaggagatcaaggatgtgattgagcccatcaaggacaatgatgctgccatccggaactacggcatcgagctggccgtgtccctgtgccaggagctgctggccagcggcctggtgcccggcctgcacttctacaccctgaaccgggagatggccaccacagaggtgctgaagaggctgggcatgtggacagaggacccccggcggcccctgccctgggccctgagcgcccaccccaagaggcgggaggaggatgtgcggcccatcttctgggccagccggcccaagagctacatctaccgcacccaggagtgggatgagttccccaacggccgctggggcaacagcagcagccctgccttcggggagctgaaggactactacctgttctacctgaagagcaagagccccaaggaggagctgctgaagatgtggggcgaggagctgaccagcgaggagagcgtgtttgaggtgtttgtgctgtacctgtctggagagcccaacagaaatggccacaaggtgacctgcctgccctggaatgatgagcccctggccgctgagaccagcctgctgaaggaggagctgctgcgggtgaaccggcagggcatcctgaccatcaacagccagcccaacatcaacgggaagcccagcagtgaccccatcgtgggctggggccccagcggcggctacgtgttccagaaggcctacctggagttcttcaccagccgggagacagctgaggccctgctgcaggtgctgaagaagtatgagctgcgggtgaactaccacctggtgaatgtgaagggggagaacatcaccaatgcccctgagctgcagcccaatgctgtgacctggggcatcttccctggccgggagatcatccagcccaccgtggtggaccctgtgtccttcatgttctggaaggatgaggcctttgccctgtggattgagcgctggggcaagctgtatgaggaggagagccccagcaggaccatcatccagtacatccatgacaactacttcctggtgaacctggtggacaatgacttccccctggacaactgcctgtggcaggtggtggaggacaccctggagctgctgaaccggcccacccagaatgcccgggagacagaggccccctag

SEQ ID NO: 20449 - DNA, 2094 bp, Artificial Sequence; identical to SEQ ID NO: 20448
  Description of Artificial Sequence: Synthetic coding sequence

SEQ ID NO: 20450 - DNA, 1971 bp, Artificial Sequence
  Description of Artificial Sequence: Synthetic coding sequence
atggtgaatgaggcccggggcaacagcagcctgaacccctgcctggagggcagcgccagcagcggcagcgagagcagcaaggacagcagccgctgcagcaccccaggcctggaccctgagagacatgagcggctgcgggagaagatgagaagaaggctggagagcggggacaagtggttcagcctggagttcttcccccccaggacagctgagggcgctgtgaacctgatcagcagatttgacaggatggctgctgggggccccctgtacattgatgtgacctggcaccctgctggggaccccggcagtgacaaggagaccagctccatgatgattgccagcacagctgtgaactactgcggcctggagaccatcctgcacatgacctgctgccggcagaggctggaggagatcaccggccacctgcacaaggccaagcagctgggcctgaagaacatcatggccctgcggggggaccccatcggggaccagtgggaggaggaggagggcggcttcaactatgctgtggacctggtgaagcacatccgctcagaatttggagactactttgacatctgtgtggccggctaccccaagggccaccctgaggccggcagctttgaagctgacctgaagcacctgaaggagaaggtgtctgctggagctgacttcatcatcacccagctgttctttgaagctgacaccttcttccgctttgtgaaggcctgcacagacatgggcatcacctgccccatcgtgcccggcatcttccccatccagggctaccacagcctgcggcagctggtgaagctgagcaagctggaggtgccccaggagatcaaggatgtgattgagcccatcaaggacaatgatgctgccatcagaaattatggaattgagctggccgtgtccctgtgccaggagctgctggccagcggcctggtgcccggcctgcacttctacaccctgaaccgggagatggccaccacagaggtgctgaagaggctgggcatgtggacagaggacccccggcggcccctgccctgggccctgagcgcccaccccaagagaagagaggaggatgtgcggcccatcttctgggccagccggcccaagagctacatctaccgcacccaggagtgggatgagttccccaacggccgctggggcaacagcagcagccctgcctttggagagctgaaggactactacctgttctacctgaagagcaagagccccaaggaggagctgctgaagatgtggggcgaggagctgaccagcgaggagagcgtgtttgaggtgtttgtgctgtacctgagcggggagcccaacagaaatggccacaaggtgacctgcctgccctggaatgatgagcccctggccgctgagaccagcctgctgaaggaggagctgctgcgggtgaaccggcagggcatcctgaccatcaacagccagcccaacatcaatggcaagcccagcagtgaccccatcgtgggctggggccccagcggcggctacgtgttccagaaggcctacctggagttcttcaccagccgggagacagctgaggccctgctgcaggtgctgaagaagtatgagctgcgggtgaactaccacctggtgaatgtgaagggggagaacatcaccaatgcccctgagctgcagcccaatgctgtgacctggggcatcttccctggccgggagatcatccagcccaccgtggtggaccctgtgtccttcatgttctggaaggatgaggcctttgccctgtggattgagcgctggggcaagctgtatgaggaggagagccccagcaggaccatcatccagtacatccatgacaactacttcctggtgaacctggtggacaatgacttccccctggacaactgcctgtggcaggtggtggaggacaccctggagctgctgaaccggcccacccagaatgcccgggagacagaggccccctag

SEQ ID NO: 20451 - DNA, 1971 bp, Artificial Sequence; identical to SEQ ID NO: 20450
  Description of Artificial Sequence: Synthetic coding sequence

SEQ ID NO: 20452 - DNA, 93 bp, Artificial Sequence; identical to SEQ ID NO: 20447
  Description of Artificial Sequence: Synthetic coding sequence

SEQ ID NO: 20453 - DNA, 432 bp, Artificial Sequence
  Description of Artificial Sequence: Synthetic coding sequence
atggtgaatgaggcccggggcaacagcagcctgaacccctgcctggagggcagcgccagcagcggcagcgagagcagcaaggacagcagccgctgcagcaccccaggcctggaccctgagagacatgagcggctgcgggagaagatgagaagaaggctggagagcggggacaagtggttcagcctggagttcttcccccccaggacagctgagggcgctgtgaacctgatcagcagatttgacaggatggctgctgggggccccctgtacattgatgtgacctggcaccctgctggggaccccggcagtgacaaggagaccagctccatgatgattgccagcacagctgtgaactactgcggcctggagaccatcctgcacatgacctgctgccggcagaggctggaggagatcaccggccacctgcactag

SEQ ID NO: 20454 - DNA, 162 bp, Artificial Sequence
  Description of Artificial Sequence: Synthetic coding sequence
atgtgccggggctgcggctgcctgcccccagatgccccctgccccaccctgtgcagcaggaacccagccatggtgaatgaggcccggggcaacagcagcctgaacccctgcctggagggcagcgccagcagcggcagcgagagcagcaaggacagcagctag

SEQ ID NO: 20455 - DNA, 93 bp, Artificial Sequence; identical to SEQ ID NO: 20447
  Description of Artificial Sequence: Synthetic coding sequence

SEQ ID NO: 20456 - DNA, 2508 bp, Artificial Sequence
  Description of Artificial Sequence: Synthetic coding sequence
atggccgcccccatcctgaaggatgtggtggcctacgtggaggtgtggagcagcaatggaacagagaactacagcaagaccttcaccacccagctggtggacatgggcgccaaggtgtccaagaccttcaacaagcaggtgacccacgtgatcttcaaggatggctaccagagcacctgggacaaggcccagaagaggggcgtgaagctggtgtctgtgctgtgggtggagaagtgcaggacagctggggcccacattgatgagagcctcttccctgctgccaacatgaatgagcacctgagcagcctcatcaagaagaagaggaagtgcatgcagcccaaggacttcaacttcaagaccccagaaaatgacaagcgcttccagaagaagtttgagaagatggccaaggagctgcagaggcagaagaccaacctggatgatgatgtgcccatcctgctgtttgagagcaatggcagcctcatctacacccccaccatcgagatcaacagccgccaccacagcgccatggagaagaggctgcaggagatgaaggagaagcgggagaacctgagccccaccagcagccagatgatccagcagagccatgacaaccccagcaacagcctgtgtgaggcccccctgaacatcagccgggacaccctgtgcagtgatgagtactttgctgggggcctgcacagcagctttgatgacctgtgtggcaacagcggctgcggcaaccaggagaggaagctggagggcagcatcaatgacatcaagagtgatgtgtgcatcagcagcctggtgctgaaggccaacaacatccacagcagccccagcttcacccacctggacaagagcagcccccagaagttcctgagcaacctgagcaaggaggagatcaacctgcagaggaacattgctgggaaggtggtgaccccagaccagaagcaggccgccggcatgagccaggagacctttgaggagaagtaccgcctgagccccaccctgagcagcaccaagggccacctgctgatccacagccggcccaggagcagctctgtgaagaggaagagggtgagccacggcagccacagcccccccaaggagaagtgcaagaggaagaggagcacccggcgcagcatcatgccccggctgcagctgtgccgctcagaagatcggctgcagcacgtggccggccctgccctggaggccctgagctgtggggagagcagctatgatgactacttctccccagacaacctgaaggagcgctacagcgagaacctgcccccagagagccagctgcccagcagccctgcccagctgagctgccgcagcctgagcaagaaggagaggaccagcatctttgagatgtctgacttcagctgtgtgggcaagaagaccaggacagtggacatcaccaacttcaccgccaagaccatcagcagccccaggaagacaggaaatggagagggccgggccaccagcagctgtgtgaccagcgcccctgaggaggccctgcgctgctgccggcaggccggcaaggaggatgcctgcccagagggcaatggcttctcctacaccatcgaggaccctgccctgcccaagggccatgatgatgacctgacccccctggagggcagcctggaggagatgaaggaggccgtgggcctgaagagcacccagaacaagggcaccaccagcaagatcagcaacagcagcgagggggaggcccagagcgagcacgagccctgcttcatcgtggactgcaacatggagaccagcacagaggagaaggagaacctgcccggcggctacagcggctctgtgaagaaccggcccaccaggcatgatgtgctggatgacagctgtgatggcttcaaggacctgatcaagccccatgaggagctgaagaagagcggccggggcaagaagcccaccaggaccctggtgatgacctccatgcccagcgagaagcagaatgtggtgatccaggtggtggacaagctgaagggcttcagcatcgccccagatgtgtgtgagaccaccacccacgtgctgagcggcaagcccctgcggaccctgaatgtgctgctgggcatcgcccggggctgctgggtgctgtcctatgactgggtgctgtggagcctggagctgggccactggatcagcgaggagccctttgagctgagccaccacttccctgctgcccccctgtgccgctctgagtgccacctgtctgctggcccctaccggggcaccctgtttgctgaccagcctgccatgtttgtgtccccagccagcagcccccctgtggccaagctgtgtgagctggtgcacctgtgtggcggccgggtgtcccaggtgccccggcaggccagcatcgtgattggcccctacagcggcaagaagaaggccaccgtgaagtacctgtctgagaagtgggtgctggacagcatcacccagcacaaggtgtgtgcccctgagaactacctgctgagccagtag

SEQ ID NO: 20457 - DNA, 1833 bp, Artificial Sequence
  Description of Artificial Sequence: Synthetic coding sequence
atggccgcccccatcctgaaggatgtggtggcctacgtggaggtgtggagcagcaatggaacagagaactacagcaagaccttcaccacccagctggtggacatgggcgccaaggtgtccaagaccttcaacaagcaggtgacccacgtgatcttcaaggatggctaccagagcacctgggacaaggcccagaagaggggcgtgaagctggtgtctgtgctgtgggtggagaagtgcaggacagctggggcccacattgatgagagcctcttccctgctgccaacatgaatgagcacctgagcagcctcatcaagaagaagaggaagtgcatgcagcccaaggacttcaacttcaagaccccagaaaatgacaagcgcttccagaagaagtttgagaagatggccaaggagctgcagaggcagaagaccaacctggatgatgatgtgcccatcctgctgtttgagagcaatggcagcctcatctacacccccaccatcgagatcaacagccgccaccacagcgccatggagaagaggctgcaggagatgaaggagaagcgggagaacctgagccccaccagcagccagatgatccagcagagccatgacaaccccagcaacagcctgtgtgaggcccccctgaacatcagccgggacaccctgtgcagtgatgagtactttgctgggggcctgcacagcagctttgatgacctgtgtggcaacagcggctgcggcaaccaggagaggaagctggagggcagcatcaatgacatcaagagtgatgtgtgcatcagcagcctggtgctgaaggccaacaacatccacagcagccccagcttcacccacctggacaagagcagcccccagaagttcctgagcaacctgagcaaggaggagatcaacctgcagaggaacattgctgggaaggtggtgaccccagaccagaagcaggccgccggcatgagccaggagacctttgaggagaagtaccgcctgagccccaccctgagcagcaccaagggccacctgctgatccacagccggcccaggagcagctctgtgaagaggaagagggtgagccacggcagccacagcccccccaaggagaagtgcaagaggaagaggagcacccggcgcagcatcatgccccggctgcagctgtgccgctcagaagatcggctgcagcacgtggccggccctgccctggaggccctgagctgtggggagagcagctatgatgactacttctccccagacaacctgaaggagcgctacagcgagaacctgcccccagagagccagctgcccagcagccctgcccagctgagctgccgcagcctgagcaagaaggagaggaccagcatctttgagatgtctgacttcagctgtgtgggcaagaagaccaggacagtggacatcaccaacttcaccgccaagaccatcagcagccccaggaagacaggaaatggagagggccgggccaccagcagctgtgtgaccagcgcccctgaggaggccctgcgctgctgccggcaggccggcaaggaggatgcctgcccagagggcaatggcttctcctacaccatcgaggaccctgccctgcccaagggccatgatgatgacctgacccccctggagggcagcctggaggagatgaaggaggccgtgggcctgaagagcacccagaacaagggcaccaccagcaagatcagcaacagcagcgagggggaggcccagagcgagcacgagccctgcttcatcgtggactgcaacatggagaccagcacagaggagaaggagaacctgcccggcggctacagcggctccatgtag

SEQ ID NO: 20458 - DNA, 1689 bp, Artificial Sequence
  Description of Artificial Sequence: Synthetic coding sequence
atggccgcccccatcctgaaggatgtggtggcctacgtggaggtgtggagcagcaatggaacagagaactacagcaagaccttcaccacccagctggtggacatgggcgccaaggtgtccaagaccttcaacaagcaggtgacccacgtgatcttcaaggatggctaccagagcacctgggacaaggcccagaagaggggcgtgaagctggtgtctgtgctgtgggtggagaagtgcaggacagctggggcccacattgatgagagcctcttccctgctgccaacatgaatgagcacctgagcagcctcatcaagaagaagaggaagtgcatgcagcccaaggacttcaacttcaagaccccagaaaatgacaagcgcttccagaagaagtttgagaagatggccaaggagctgcagaggcagaagaccaacctggccagccagatgatccagcagagccatgacaaccccagcaacagcctgtgtgaggcccccctgaacatcagccgggacaccctgtgcagtgatgagtactttgctgggggcctgcacagcagctttgatgacctgtgtggcaacagcggctgcggcaaccaggagaggaagctggagggcagcatcaatgacatcaagagtgatgtgtgcatcagcagcctggtgctgaaggccaacaacatccacagcagccccagcttcacccacctggacaagagcagcccccagaagttcctgagcaacctgagcaaggaggagatcaacctgcagaggaacattgctgggaaggtggtgaccccagaccagaagcaggccgccggcatgagccaggagacctttgaggagaagtaccgcctgagccccaccctgagcagcaccaagggccacctgctgatccacagccggcccaggagcagctctgtgaagaggaagagggtgagccacggcagccacagcccccccaaggagaagtgcaagaggaagaggagcacccggcgcagcatcatgccccggctgcagctgtgccgctcagaagatcggctgcagcacgtggccggccctgccctggaggccctgagctgtggggagagcagctatgatgactacttctccccagacaacctgaaggagcgctacagcgagaacctgcccccagagagccagctgcccagcagccctgcccagctgagctgccgcagcctgagcaagaaggagaggaccagcatctttgagatgtctgacttcagctgtgtgggcaagaagaccaggacagtggacatcaccaacttcaccgccaagaccatcagcagccccaggaagacaggaaatggagagggccgggccaccagcagctgtgtgaccagcgcccctgaggaggccctgcgctgctgccggcaggccggcaaggaggatgcctgcccagagggcaatggcttctcctacaccatcgaggaccctgccctgcccaagggccatgatgatgacctgacccccctggagggcagcctggaggagatgaaggaggccgtgggcctgaagagcacccagaacaagggcaccaccagcaagatcagcaacagcagcgagggggaggcccagagcgagcacgagccctgcttcatcgtggactgcaacatggagaccagcacagaggagaaggagaacctgcccggcggctacagcggctccatgtag

SEQ ID NO: 20459 - DNA, 234 bp, Artificial Sequence
  Description of Artificial Sequence: Synthetic coding sequence
atgaatgtgctgctgggctctgtggtgatctttgccacctttgtgaccctgtgcaatgccagctgctacttcatccccaatgaaggagtgcctggggacagcaccaggatgttcctgcacctgtgggtgatgaccaagaccacagccaaggagagcagcagaagaagaacagccagcatctcctggtggaggaggaggacccagaagaggcctgtgctgtctgtgaatggatag

SEQ ID NO: 20460 - DNA, 345 bp, Artificial Sequence
  Description of Artificial Sequence: Synthetic coding sequence
atgaatgtgctgctgggctctgtggtgatctttgccacctttgtgaccctgtgcaatgccagctgctacttcatccccaatgaaggagtgcctggggacagcaccaggaagtgcatggacctgaagggcaacaagcaccccatcaacagcgagtggcagacagacaactgtgagacctgcacctgctatgaaacagagatcagctgctgcaccctggtgtccacccctgtgggctatgacaaggacaactgccagaggatcttcaagaaggaggactgcaagtacatcgtggtggagaagaaggaccccaagaagacctgcagcgtgtctgagtggatcatctag

SEQ ID NO: 20461 - DNA, 3813 bp, Artificial Sequence
  Description of Artificial Sequence: Synthetic coding sequence
atgacagatgacaacagtgatgacaagattgaagatgagctgcagaccttcttcaccagtgacaaggatggcaacacccacgcctacaaccccaagagcccccccacccagaacagcagcgccagctctgtgaactggaacagcgccaacccagatgacatggtggtggactatgaaacagatcctgctgtggtgactggagagaacatcagcctgagcctgcagggcgtggaggtgtttggccacgagaagagcagcagtgacttcatcagcaagcaggtgctggacatgcacaaggacagcatctgccagtgcccagccctggtgggcacagagaagcccaagtacctgcagcacagctgccacagcctggaggccgtggagggccagagcgtggagcccagcctgccctttgtgtggaagcccaatgacaacctgaactgtgccggctactgtgatgccctggagctgaaccagacctttgacatgacagtggacaaggtgaactgcaccttcatcagccaccacgccatcggcaagagccagagcttccacacagctggcagcctgcccccaactggaagaagaagtggcagcaccagcagcctgagctacagcacctggaccagcagccacagcgacaagacccacgcccgggagaccacctatgaccgggagagctttgagaacccccaggtgacccccagcgaggcccaggacatgacctacacagccttcagtgatgtggtgatgcagagcgaggtgtttgtgtctgacatcggcaaccagtgtgcctgcagcagcggcaaggtgaccagcgagtacacagatggcagccagcagaggctggtgggggagaaggagacccaggccctgacccctgtgtctgatggcatggaggtgcccaatgattctgccctgcaggagttcttctgcctgagccatgatgagagcaacagcgagccccacagccagagcagctaccgccacaaggagatgggccagaacctgcgggagaccgtgtcctactgcctgattgatgatgaatgtcccctgatggtgcctgcctttgacaagtctgaggcccaggtgctgaaccctgagcacaaggtgacagaaacagaggacacccagatggtgtccaagggcaaggacctgggcacccagaaccacaccagcgagctgatcctgagcagccccccaggccagaaggtgggcagcagctttggcctgacctgggatgccaatgacatggtgatcagcacagacaagaccatgtgcatgagcacccctgtgctggagcccaccaaggtgaccttctctgtgagccccatcgaggccacagagaagtgcaagaaggtggagaagggcaacagaggcctgaagaacatcccagacagcaaggaggcccctgtgaacctgtgcaagcccagcctgggcaagagcaccatcaagaccaacacccccatcggctgcaaggtgaggaagacagagatcatctcctacccccggcccaacttcaagaatgtgaaggccaaggtgatgagcagagctgtgctgcagcccaaggatgctgccctgagcaaggtgaccccccggccccagcagaccagcgccagcagccccagctctgtgaacagccggcagcagacagtgctgagcaggacccccaggagtgacctgaatgctgacaagaaggccgagatcctgatcaacaagacccacaagcagcagttcaacaagctgatcaccagccaggccgtgcacgtgaccacccacagcaagaatgccagccaccgggtgcccaggaccaccagcgctgtgaagagcaaccaggaggatgtggacaaggccagcagcagcaacagcgcctgtgaaacaggctctgtgtctgccctcttccagaagatcaagggcatcctgcctgtgaagatggagagcgcagaatgtctggagatgacctacgtgcccaacatcgaccgcatcagccctgagaagaagggggagaaggaaaatggcacctccatggagaagcaggagctgaagcaggagatcatgaatgagacctttgaatatggcagcctcttcctgggcagcgccagcaagaccaccaccaccagcggcaggaacatcagcaagccagacagctgtggcctgcggcagattgctgcccccaaggccaaggtgggcccccctgtgtcctgcctgcggaggaacagcgacaacagaaaccccagcgctgacagagctgtgagcccccagaggatcagaagagtgagcagcagcggcaagcccaccagcctgaagacagcccagagctcctgggtgaacctgccccggcccctgcccaagagcaaggccagcctgaagagccctgccctgcggaggacaggcagcacccccagcatcgccagcacccacagcgagctgagcacctacagcaacaacagcggaaatgctgctgtgatcaagtatgaggagaagccacccaagccagccttccagaatggcagcagcggcagcttctacctgaagcccctggtgtcccgggcccacgtgcacctgatgaagaccccacccaagggccccagcaggaagaacctcttcaccgccctgaatgctgtggagaagagccggcagaagaaccccaggagcctgtgcatccagccccagacagccccagatgccctgcccccagagaagaccctggagctgacccagtacaagaccaagtgtgagaaccagagcggcttcatcctgcagctgaagcagctgctggcctgtggcaacaccaagtttgaggccctgactgtggtgatccagcacctgctgtctgagcgggaggaggccctgaagcagcacaagaccctgagccaggagctggtgaacctgcggggggagctggtgacagccagcaccacctgtgagaagctggagaaggccagaaatgagctgcagacagtgtatgaggcctttgtgcagcagcaccaggccgagaagacagagcgggagaaccggctgaaggagttctacacccgggagtatgagaagctgcgggacacctacatcgaggaggccgagaagtacaagatgcagctgcaggagcagtttgacaacctgaatgctgcccacgagaccagcaagctggagattgaggccagccacagcgagaagctggagctgctgaagaaggcctatgaggccagcctgtctgagatcaagaagggccatgaaattgagaagaagagcctggaggacctgctgtctgagaagcaggagagcctggagaagcagatcaatgacctgaagtcagaaaatgatgccctgaatgagaagctgaagtctgaggagcagaagaggcgggcccgggagaaggccaacctgaagaacccccagatcatgtacctggagcaggagctggagagcctgaaggctgtgctggagatcaagaatgagaagctgcaccagcaggacatcaagctgatgaagatggagaagctggtggacaacaacacagccctggtggacaagctgaagcgcttccagcaggagaatgaggagctgaaggccaggatggacaagcacatggccatcagccggcagctgagcacagagcaggccgtgctgcaggagagcctggagaaggagagcaaggtgaacaagaggctgtccatggagaatgaggagctgctgtggaagctgcacaacggggacctgtgcagccccaagaggagccccaccagcagcgccatccccctgcagagccccagaaattctggcagcttccccagccccagcatcagccccaggtag

SEQ ID NO: 20462 - DNA, 1311 bp, Artificial Sequence
  Description of Artificial Sequence: Synthetic coding sequence
atgctgctgagccccaagttcagcctgagcaccatccacatccggctgacagccaagggcctgctgaggaacctgcggctgcccagcggcttccgccgcagcacagtggtgttccacacagtggagaagagccggcagaagaaccccaggagcctgtgcatccagccccagacagccccagatgccctgcccccagagaagaccctggagctgacccagtacaagaccaagtgtgagaaccagagcggcttcatcctgcagctgaagcagctgctggcctgtggcaacaccaagtttgaggccctgactgtggtgatccagcacctgctgtctgagcgggaggaggccctgaagcagcacaagaccctgagccaggagctggtgaacctgcggggggagctggtgacagccagcaccacctgtgagaagctggagaaggccagaaatgagctgcagacagtgtatgaggcctttgtgcagcagcaccaggccgagaagacagagcgggagaaccggctgaaggagttctacacccgggagtatgagaagctgcgggacacctacatcgaggaggccgagaagtacaagatgcagctgcaggagcagtttgacaacctgaatgctgcccacgagaccagcaagctggagattgaggccagccacagcgagaagctggagctgctgaagaaggcctatgaggccagcctgtctgagatcaagaagggccatgaaattgagaagaagagcctggaggacctgctgtctgagaagcaggagagcctggagaagcagatcaatgacctgaagtcagaaaatgatgccctgaatgagaagctgaagtctgaggagcagaagaggcgggcccgggagaaggccaacctgaagaacccccagatcatgtacctggagcaggagctggagagcctgaaggctgtgctggagatcaagaatgagaagctgcaccagcaggacatcaagctgatgaagatggagaagctggtggacaacaacacagccctggtggacaagctgaagcgcttccagcaggagaatgaggagctgaaggccaggatggacaagcacatggccatcagccggcagctgagcacagagcaggccgtgctgcaggagagcctggagaaggagagcaaggtgaacaagaggctgtccatggagaatgaggagctgctgtggaagctgcacaacggggacctgtgcagccccaagaggagccccaccagcagcgccatccccctgcagagccccagaaattctggcagcttccccagccccagcatcagccccaggtag

SEQ ID NO: 20463 - DNA, 1554 bp, Artificial Sequence
  Description of Artificial Sequence: Synthetic coding sequence
atgacagtgcctgggggcttccgcagctgcacagaaacagacatcagcagcaagatcttcatcaacagcaccctgaccccacctgctggcagcgagcggcactatgatgccaccctgctgaccctgctggtggtgggcagctacagcctgtgcatcatccccctgctggccaccttcaccgggaagaagacaggaaatgctgctgtgatcaagtatgaggagaagccacccaagccagccttccagaatggcagcagcggcagcttctacctgaagcccctggtgtcccgggcccacgtgcacctgatgaagaccccacccaagggccccagcaggaagaacctcttcaccgccctgaatgctgtggagaagagccggcagaagaaccccaggagcctgtgcatccagccccagacagccccagatgccctgcccccagagaagaccctggagctgacccagtacaagaccaagtgtgagaaccagagcggcttcatcctgcagctgaagcagctgctggcctgtggcaacaccaagtttgaggccctgactgtggtgatccagcacctgctgtctgagcgggaggaggccctgaagcagcacaagaccctgagccaggagctggtgaacctgcggggggagctggtgacagccagcaccacctgtgagaagctggagaaggccagaaatgagctgcagacagtgtatgaggcctttgtgcagcagcaccaggccgagaagacagaaagagaaaatcggctgaaggagttctacacccgggagtatgagaagctgcgggacacctacatcgaggaggccgagaagtacaagatgcagctgcaggagcagtttgacaacctgaatgctgcccacgagaccagcaagctggagattgaggccagccacagcgagaagctggagctgctgaagaaggcctatgaggccagcctgtctgagatcaagaagggccacgagattgagaagaagagcctggaggacctgctgtctgagaagcaggagagcctggagaagcagatcaatgacctgaagtcagaaaatgatgccctgaatgagaagctgaagtctgaggagcagaagagaagagcccgggagaaggccaacctgaagaacccccagatcatgtacctggagcaggagctggagagcctgaaggctgtgctggagatcaagaatgagaagctgcaccagcaggacatcaagctgatgaagatggagaagctggtggacaacaacacagccctggtggacaagctgaagcgcttccagcaggagaatgaggagctgaaggccaggatggacaagcacatggccatcagccggcagctgagcacagagcaggccgtgctgcaggagagcctggagaaggagagcaaggtgaacaagaggctgtccatggagaatgaggagctgctgtggaagctgcacaatggagacctgtgcagccccaagaggagccccaccagcagcgccatccccctgcagagccccaggaacagcggcagcttccccagccccagcatcagccccaggtag

SEQ ID NO: 20464 - DNA, 2313 bp, Artificial Sequence
  Description of Artificial Sequence: Synthetic coding sequence
atgacagatgacaacagtgatgacaagattgaagatgagctgcagaccttcttcaccagtgacaaggatggcaacacccacgcctacaaccccaagagcccccccacccagaacagcagcgccagctctgtgaactggaacagcgccaacccagatgacatggtggtggactatgaaacagatcctgctgtggtgactggagagaacatcagcctgagcctgcagggcgtggaggtgtttggccacgagaagagcagcagtgacttcatcagcaagcaggtgctggacatgcacaaggacagcatctgccagtgcccagccctggtgggcacagagaagcccaagtacctgcagcacagctgccacagcctggaggccgtggagggccagagcgtggagcccagcctgccctttgtgtggaagcccaatgacaacctgaactgtgccggctactgtgatgccctggagctgaaccagacctttgacatgacagtggacaaggtgaactgcaccttcatcagccaccacgccatcggcaagagccagagcttccacacagctggcagcctgcccccaactggaagaagaagtggcagcaccagcagcctgagctacagcacctggaccagcagccacagcgacaagacccacgcccgggagaccacctatgaccgggagagctttgagaacccccaggtgacccccagcgaggcccaggacatgacctacacagccttcagtgatgtggtgatgcagagcgaggtgtttgtgtctgacatcggcaaccagtgtgcctgcagcagcggcaaggtgaccagcgagtacacagatggcagccagcagaggctggtgggggagaaggagacccaggccctgacccctgtgtctgatggcatggaggtgcccaatgattctgccctgcaggagttcttctgcctgagccatgatgagagcaacagcgagccccacagccagagcagctaccgccacaaggagatgggccagaacctgcgggagaccgtgtcctactgcctgattgatgatgaatgtcccctgatggtgcctgcctttgacaagtctgaggcccaggtgctgaaccctgagcacaaggtgacagaaacagaggacacccagatggtgtccaagggcaaggacctgggcacccagaaccacaccagcgagctgatcctgagcagccccccaggccagaaggtgggcagcagctttggcctgacctgggatgccaatgacatggtgatcagcacagacaagaccatgtgcatgagcacccctgtgctggagcccaccaaggtgaccttctctgtgagccccatcgaggccacagagaagtgcaagaaggtggagaagggcaacagaggcctgaagaacatcccagacagcaaggaggcccctgtgaacctgtgcaagcccagcctgggcaagagcaccatcaagaccaacacccccatcggctgcaaggtgaggaagacagagatcatctcctacccccggcccaacttcaagaatgtgaaggccaaggtgatgagcagagctgtgctgcagcccaaggatgctgccctgagcaaggtgaccccccggccccagcagaccagcgccagcagccccagctctgtgaacagccggcagcagacagtgctgagcaggacccccaggagtgacctgaatgctgacaagaaggccgagatcctgatcaacaagacccacaagcagcagttcaacaagctgatcaccagccaggccgtgcacgtgaccacccacagcaagaatgccagccaccgggtgcccaggaccaccagcgctgtgaagagcaaccaggaggatgtggacaaggccagcagcagcaacagcgcctgtgaaacaggctctgtgtctgccctcttccagaagatcaagggcatcctgcctgtgaagatggagagcgcagaatgtctggagatgacctacgtgcccaacatcgaccgcatcagccctgagaagaagggggagaaggaaaatggcacctccatggagaagcaggagctgaagcaggagatcatgaatgagacctttgaatatggcagcctcttcctgggcagcgccagcaagaccaccaccaccagcggcaggaacatcagcaagccagacagctgtggcctgcggcagattgctgcccccaaggccaaggtgggcccccctgtgtcctgcctgcggaggaacagcgacaacagaaaccccagcgctgacagagctgtgagcccccagaggatcagaagagtgagcagctctgtgctgcccaaggccgccttctcctag

SEQ ID NO: 20465 - DNA, 3651 bp, Artificial Sequence
  Description of Artificial Sequence: Synthetic coding sequence
atgacagatgacaacagtgatgacaagattgaagatgagctgcagaccttcttcaccagtgacaaggatggcaacacccacgcctacaaccccaagagcccccccacccagaacagcagcgccagctctgtgaactggaacagcgccaacccagatgacatggtggtggactatgaaacagatcctgctgtggtgactggagagaacatcagcctgagcctgcagggcgtggaggtgtttggccacgagaagagcagcagtgacttcatcagcaagcaggtgctggacatgcacaaggacagcatctgccagtgcccagccctggtgggcacagagaagcccaagtacctgcagcacagctgccacagcctggaggccgtggagggccagagcgtggagcccagcctgccctttgtgtggaagcccaatgacaacctgaactgtgccggctactgtgatgccctggagctgaaccagacctttgacatgacagtggacaaggtgaactgcaccttcatcagccaccacgccatcggcaagagccagagcttccacacagctggcagcctgcccccaactggaagaagaagtggcagcaccagcagcctgagctacagcacctggaccagcagccacagcgacaagacccacgcccgggagaccacctatgaccgggagagctttgagaacccccaggtgacccccagcgaggcccaggacatgacctacacagccttcagtgatgtggtgatgcagagcgaggtgtttgtgtctgacatcggcaaccagtgtgcctgcagcagcggcaaggtgaccagcgagtacacagatggcagccagcagaggctggtgggggagaaggagacccaggccctgacccctgtgtctgatggcatggaggtgcccaatgattctgccctgcaggagttcttctgcctgagccatgatgagagcaacagcgagccccacagccagagcagctaccgccacaaggagatgggccagaacctgcgggagaccgtgtcctactgcctgattgatgatgaatgtcccctgatggtgcctgcctttgacaagtctgaggcccaggtgctgaaccctgagcacaaggtgacagaaacagaggacacccagatggtgtccaagggcaaggacctgggcacccagaaccacaccagcgagctgatcctgagcagccccccaggccagaaggtgggcagcagctttggcctgacctgggatgccaatgacatggtgatcagcacagacaagaccatgtgcatgagcacccctgtgctggagcccaccaaggtgaccttctctgtgagccccatcgaggccacagagaagtgcaagaaggtggagaagggcaacagaggcctgaagaacatcccagacagcaaggaggcccctgtgaacctgtgcaagcccagcctgggcaagagcaccatcaagaccaacacccccatcggctgcaaggtgaggaagacagagatcatctcctacccccggcccaacttcaagaatgtgaaggccaaggtgatgagcagagctgtgctgcagcccaaggatgctgccctgagcaaggtgaccccccggccccagcagaccagcgccagcagccccagctctgtgaacagccggcagcagacagtgctgagcaggacccccaggagtgacctgaatgctgacaagaaggccgagatcctgatcaacaagacccacaagcagcagttcaacaagctgatcaccagccaggccgtgcacgtgaccacccacagcaagaatgccagccaccgggtgcccaggaccaccagcgctgtgaagagcaaccaggaggatgtggacaaggccagcagcagcaacagcgcctgtgaaacaggctctgtgtctgccctcttccagaagatcaagggcatcctgcctgtgaagatggagagcgcagaatgtctggagatgacctacgtgcccaacatcgaccgcatcagccctgagaagaagggggagaaggaaaatggcacctccatggagaagcaggagctgaagcaggagatcatgaatgagacctttgaatatggcagcctcttcctgggcagcgccagcaagaccaccaccaccagcggcaggaacatcagcaagccagacagctgtggcctgcggcagattgctgcccccaaggccaaggtgggcccccctgtgtcctgcctgcggaggaacagcgacaacagaaaccccagcgctgacagagctgtgagcccccagaggatcagaagagtgagcagcagcgctggaaatgctgctgtgatcaagtatgaggagaagccacccaagccagccttccagaatggcagcagcggcagcttctacctgaagcccctggtgtcccgggcccacgtgcacctgatgaagaccccacccaagggccccagcaggaagaacctcttcaccgccctgaatgctgtggagaagagccggcagaagaaccccaggagcctgtgcatccagccccagacagccccagatgccctgcccccagagaagaccctggagctgacccagtacaagaccaagtgtgagaaccagagcggcttcatcctgcagctgaagcagctgctggcctgtggcaacaccaagtttgaggccctgactgtggtgatccagcacctgctgtctgagcgggaggaggccctgaagcagcacaagaccctgagccaggagctggtgaacctgcggggggagctggtgacagccagcaccacctgtgagaagctggagaaggccagaaatgagctgcagacagtgtatgaggcctttgtgcagcagcaccaggccgagaagacagagcgggagaaccggctgaaggagttctacacccgggagtatgagaagctgcgggacacctacatcgaggaggccgagaagtacaagatgcagctgcaggagcagtttgacaacctgaatgctgcccacgagaccagcaagctggagattgaggccagccacagcgagaagctggagctgctgaagaaggcctatgaggccagcctgtctgagatcaagaagggccatgaaattgagaagaagagcctggaggacctgctgtctgagaagcaggagagcctggagaagcagatcaatgacctgaagtcagaaaatgatgccctgaatgagaagctgaagtctgaggagcagaagaggcgggcccgggagaaggccaacctgaagaacccccagatcatgtacctggagcaggagctggagagcctgaaggctgtgctggagatcaagaatgagaagctgcaccagcaggacatcaagctgatgaagatggagaagctggtggacaacaacacagccctggtggacaagctgaagcgcttccagcaggagaatgaggagctgaaggccaggatggacaagcacatggccatcagccggcagctgagcacagagcaggccgtgctgcaggagagcctggagaaggagagcaaggtgaacaagaggctgtccatggagaatgaggagctgctgtggaagctgcacaacggggacctgtgcagccccaagaggagccccaccagcagcgccatccccctgcagagccccagaaattctggcagcttccccagccccagcatcagccccaggtag

SEQ ID NO: 20466 - DNA, 1029 bp, Artificial Sequence
  Description of Artificial Sequence: Synthetic coding sequence
atgggctgccccagcagcaagctgtgcctgtacagcccctgtgccgccacccggcgggaggaggccctgaagcagcacaagaccctgagccaggagctggtgaacctgcggggggagctggtgacagccagcaccacctgtgagaagctggagaaggccagaaatgagctgcagacagtgtatgaggcctttgtgcagcagcaccaggccgagaagacagagcgggagaaccggctgaaggagttctacacccgggagtatgagaagctgcgggacacctacatcgaggaggccgagaagtacaagatgcagctgcaggagcagtttgacaacctgaatgctgcccacgagaccagcaagctggagattgaggccagccacagcgagaagctggagctgctgaagaaggcctatgaggccagcctgtctgagatcaagaagggccatgaaattgagaagaagagcctggaggacctgctgtctgagaagcaggagagcctggagaagcagatcaatgacctgaagtcagaaaatgatgccctgaatgagaagctgaagtctgaggagcagaagaggcgggcccgggagaaggccaacctgaagaacccccagatcatgtacctggagcaggagctggagagcctgaaggctgtgctggagatcaagaatgagaagctgcaccagcaggacatcaagctgatgaagatggagaagctggtggacaacaacacagccctggtggacaagctgaagcgcttccagcaggagaatgaggagctgaaggccaggatggacaagcacatggccatcagccggcagctgagcacagagcaggccgtgctgcaggagagcctggagaaggagagcaaggtgaacaagaggctgtccatggagaatgaggagctgctgtggaagctgcacaacggggacctgtgcagccccaagaggagccccaccagcagcgccatccccctgcagagccccagaaattctggcagcttccccagccccagcatcagccccaggtag

SEQ ID NO: 20467 - DNA, 3651 bp, Artificial Sequence; identical to SEQ ID NO: 20465
  Description of Artificial Sequence: Synthetic coding sequence

SEQ ID NO: 20468 - DNA, 1248 bp, Artificial Sequence
  Description of Artificial Sequence: Synthetic coding sequence
atgaagaccccacccaagggccccagcaggaagaacctcttcaccgccctgaatgctgtggagaagagccggcagaagaaccccaggagcctgtgcatccagccccagacagccccagatgccctgcccccagagaagaccctggagctgacccagtacaagaccaagtgtgagaaccagagcggcttcatcctgcagctgaagcagctgctggcctgtggcaacaccaagtttgaggccctgactgtggtgatccagcacctgctgtctgagcgggaggaggccctgaagcagcacaagaccctgagccaggagctggtgaacctgcggggggagctggtgacagccagcaccacctgtgagaagctggagaaggccagaaatgagctgcagacagtgtatgaggcctttgtgcagcagcaccaggccgagaagacagaaagagaaaatcggctgaaggagttctacacccgggagtatgagaagctgcgggacacctacatcgaggaggccgagaagtacaagatgcagctgcaggagcagtttgacaacctgaatgctgcccacgagaccagcaagctggagattgaggccagccacagcgagaagctggagctgctgaagaaggcctatgaggccagcctgtctgagatcaagaagggccacgagattgagaagaagagcctggaggacctgctgtctgagaagcaggagagcctggagaagcagatcaatgacctgaagtcagaaaatgatgccctgaatgagaagctgaagtctgaggagcagaagagaagagcccgggagaaggccaacctgaagaacccccagatcatgtacctggagcaggagctggagagcctgaaggctgtgctggagatcaagaatgagaagctgcaccagcaggacatcaagctgatgaagatggagaagctggtggacaacaacacagccctggtggacaagctgaagcgcttccagcaggagaatgaggagctgaaggccaggatggacaagcacatggccatcagccggcagctgagcacagagcaggccgtgctgcaggagagcctggagaaggagagcaaggtgaacaagaggctgtccatggagaatgaggagctgctgtggaagctgcacaatggagacctgtgcagccccaagaggagccccaccagcagcgccatccccctgcagagccccaggaacagcggcagcttccccagccccagcatcagccccaggtag

SEQ ID NO: 20469 - DNA, 7407 bp, Artificial Sequence
  Description of Artificial Sequence: Synthetic coding sequence
atggccaccgtggtggtggaggccacagagcctgagcccagcggcagcatcgccaacccagctgccagcaccagccccagcctgagccaccgcttcctggacagcaagttctacctgctggtggtggtgggggagatcgtgacagaggagcacctgcggcgggccatcggcaacatcgagctgggcatccgctcctgggacaccaacctgattgagtgcaacctggaccaggagctgaagctgtttgtgagccgccacagcgcccgcttcagccctgaggtgcccggccagaagatcctgcaccacagaagtgatgtgctggagaccgtggtgctgatcaaccccagtgatgaagctgtgtccacagaggtgcggctgatgatcacagatgctgcccggcacaagctgctggtgctgaccggccagtgctttgaaaatactggagagctgatcctgcagagcggcagcttctccttccagaacttcatcgagatcttcacagaccaggagattggagagctgctgagcaccacccacccagccaacaaggccagcctgaccctcttctgcccagaggagggggactggaagaacagcaacctggacagacacaacctgcaggacttcatcaacatcaagctgaacagcgccagcatcctgcctgagatggagggcctgtctgagttcacagagtacctgtctgagagcgtggaggtgcccagcccctttgacatcctggagccccccaccagcggcggcttcctgaagctgagcaagccctgctgctacatcttccctgggggccgcggggacagcgccctgtttgctgtgaatggcttcaacatgctgatcaatggaggcagcgagaggaagagctgcttctggaagctgatccgccacctggacagagtggacagcatcctgctgacccacatcggagatgacaacctgcccggcatcaacagcatgctgcagaggaagattgctgagctggaggaggagcagagccagggcagcaccaccaacagcgactggatgaagaacctgatcagcccagacctgggcgtggtgttcctgaatgtgcctgagaacctgaagaaccctgagcccaacatcaagatgaagaggagcattgaggaggcctgcttcaccctgcagtacctgaacaagctgtccatgaagccagagcccctcttccgctctgtgggcaacaccatcgaccccgtcatcctcttccagaagatgggcgtgggcaagctggagatgtatgtgctgaaccctgtgaagagcagcaaggagatgcagtacttcatgcagcagtggacaggcaccaacaaggacaaggccgagttcatcctgcccaacggccaggaggtggacctgcccatctcctacctgacctctgtgagcagcctgattgtgtggcacccagccaacccagctgagaagatcatccgggtgctcttccctggcaacagcacccagtacaacatcctggagggcctggagaagctgaagcacctggacttcctgaagcagcccctggccacccagaaggacctgaccggccaggtgcccacccctgtggtgaagcagaccaagctgaagcagagagctgacagccgggagagcctgaagccagctgccaagcccctgcccagcaagtctgtgaggaaggagagcaaggaggagaccccagaggtgaccaaggtgaaccacgtggagaagccacccaaggtggagagcaaggagaaggtgatggtgaagaaggacaagcccatcaagacagagaccaagcccagcgtgacagagaaggaggtgcccagcaaggaggagcccagccctgtgaaggccgaggtggccgagaagcaggccacagatgtgaagcccaaggccgccaaggagaagacagtgaagaaggagaccaaggtgaagccagaggacaagaaggaggagaaggagaagcccaagaaggaggtggccaagaaggaggacaagacccccatcaagaaggaggagaagcccaagaaggaggaggtgaagaaggaggtgaagaaggagatcaagaaggaggagaagaaggagcccaagaaggaggtgaagaaggagaccccacccaaggaggtgaagaaggaggtgaagaaggaggagaagaaggaggtgaagaaggaggagaaggagcccaagaaggagatcaagaagctgcccaaggatgccaagaagagcagcacccccctgtctgaggccaagaagccagctgccctgaagcccaaggtgcccaagaaggaggagagcgtgaagaaggacagcgtggccgccggcaagcccaaggagaagggcaagatcaaggtgatcaagaaggagggcaaggctgctgaggccgtggccgctgctgtgggcactggagccaccacagctgctgtgatggctgctgctggcattgctgccatcggccctgccaaggagctggaggccgagaggagcctgatgagcagccctgaggacctgaccaaggactttgaggagctgaaggccgaggaggtggatgtgaccaaggacatcaagccccagctggagctgattgaagatgaggagaagctgaaggagacagagcctgtggaggcctacgtgatccagaaggagcgggaggtgaccaagggccctgctgagagcccagatgagggcatcaccaccacagaaggagagggggagtgtgagcagaccccagaggagctggagcctgtggagaagcagggcgtggatgacatcgagaagtttgaagatgagggcgccggctttgaggagagcagcgagactggagactatgaggagaaggccgagacagaggaggccgaggagcctgaggaggatggagaggagcacgtgtgtgtgtctgccagcaagcacagccccacagaagatgaggagagcgccaaggccgaggctgatgcctacatccgggagaagcgggagagcgtggccagcggagatgacagagctgaggaggacatggatgaggccatcgagaagggggaggccgagcagagcgaggaggaggctgatgaggaggacaaggcagaagatgcccgggaggaggagtatgagcctgagaagatggaggccgaggactatgtgatggctgtggtggacaaggctgctgaggccggcggcgctgaggagcagtatggcttcctgaccacccccaccaagcagctgggcgcccagagccctggccgggagcccgccagcagcatccatgatgagaccctgcccggcggcagcgagagcgaggccacagccagtgatgaggagaaccgggaggaccagcctgaggagttcaccgccaccagcggctacacccagagcaccatcgagatcagcagcgagcccacccccatggatgagatgagcaccccaagagatgtgatgtctgatgagaccaacaatgaggagacagagagccccagccaggagtttgtgaacatcaccaagtatgagagcagcctgtacagccaggagtacagcaagccagcagatgtgacccccctgaatggcttcagcgagggcagcaagacagatgccacagatggcaaggactacaatgccagcgccagcaccatcagcccccccagctccatggaggaggacaagttcagccgcagcgccctgagagatgcctactgcagcgaggtgaaggccagcaccaccctggacatcaaggacagcatctctgctgtgagcagcgagaaggtgagccccagcaagagccccagcctgagccccagcccccccagccccctggagaagacccccctgggggagaggtctgtgaacttcagcctgaccccaaatgagatcaaggtgtctgctgaggccgaggtggcccctgtgtccccagaggtgacccaggaggtggtggaggagcactgtgccagccctgaggacaagaccctggaggtggtgagccccagccagagcgtgacaggcagcgctggccacaccccctactaccagagccccacagatgagaagagcagccacctgcccacagaggtgattgagaagcccccagctgtgcctgtgtcctttgagttcagtgatgccaaggatgaaaatgaaagagcctctgtgagccccatggatgagcctgtgcctgattctgagagccccatcgagaaggtgctgagccccctgcggagccccccactcatcggcagcgagagcgcctatgagagcttcctgtctgcagatgacaaggccagcggcagaggagctgagagcccctttgaggagaagagcggcaagcagggcagcccagaccaggtgtcccctgtgtctgagatgaccagcaccagcctgtaccaggacaagcaggagggcaagagcacagactttgcccccatcaaggaggactttggccaggagaagaagacagatgatgtggaggccatgagcagccagcctgccctggccctggatgagaggaagctgggagatgtgagccccacccagattgatgtgtcccagtttggcagcttcaaggaggacaccaagatgagcatcagcgagggcaccgtgtctgacaagagcgccacccctgtggatgaaggagtggccgaggacacctacagccacatggagggcgtggcctctgtgtccacagcctctgtggccaccagcagcttccctgagcccaccacagatgatgtgagccccagcctgcacgccgaggtgggcagcccccacagcacagaggtggatgacagcctgtctgtgtctgtggtgcagacccccaccaccttccaggagacagagatgagccccagcaaggaggagtgcccccggcccatgagcatcagccccccagacttcagccccaagacagccaagagcaggacccctgtgcaggaccacaggtctgagcagagctccatgagcattgaatttggccaggagagccctgagcagagcctggccatggacttcagccggcagagcccagaccaccccaccgtgggcgctggggtgctgcacatcacagaaaatggccccacagaggtggactacagccccagcgacatgcaggacagcagcctgagccacaagatcccccccatggaggagcccagctacacccaggacaatgacctgtctgagctgatctctgtgtcccaggtggaggccagccccagcaccagcagcgcccacacccccagccagatcgccagccccctgcaggaggacaccctgagtgatgtggccccaccccgggacatgagcctgtatgccagcctgaccagcgagaaggtgcagagcctggagggggagaagctgagccccaagagtgacatcagccccctgaccccccgggagagcagccccctgtacagccccaccttcagtgacagcaccagcgctgtgaaggagaagacagccacctgccacagcagcagcagcccccccattgatgctgccagcgctgagccctacggcttccgggcctctgtgctgtttgacaccatgcagcaccacctggccctgaacagagacctgagcaccccaggcctggagaaggacagcggcggcaagacccctggggacttctcctatgcctaccagaagccagaggagaccaccaggagcccagatgaagaagattatgactatgagagctatgagaagaccaccaggaccagtgatgtgggcggctactactatgagaagattgaaagaaccaccaagagccccagcgacagcggctacagctatgagaccatcggcaagaccaccaagaccccagaagatggagactacagctatgagatcatcgagaagaccaccaggaccccagaggagggcggctacagctatgacatcagcgagaagaccaccagccccccagaggtgtctggctacagctatgagaagacagagaggagccggcggctgctggatgacatcagcaatggctatgatgacagtgaagatggcggccacaccctgggggaccccagctacagctatgagaccacagagaagatcaccagcttccctgagagcgagggctacagctatgagaccagcaccaagaccaccaggaccccagacaccagcacctactgctatgaaacagctgagaagatcaccaggaccccccaggccagcacctacagctatgagaccagtgacctgtgctacacagctgagaagaagagccccagcgaggcccggcaggatgtggacctgtgcctggtgagcagctgtgagtacaagcaccccaagacagagctgagccccagcttcatcaaccccaaccccctggagtggtttgccagcgaggagcccacagaggagagcgagaagcccctgacccagagcggcggggcccctcctcctcctgggggcaagcagcagggccggcagtgtgatgagaccccacccacctctgtgtctgagagcgcccccagccagacagacagtgatgtgcccccagagacagaggagtgccccagcatcacagcagatgccaacatcgacagtgaagatgagagcgagaccatccccacagacaagacagtgacctacaagcacatggaccccccaccagcccctgtgcaggacaggagccccagccccaggcacccagatgtgtccatggtggaccctgaggccctggccatcgagcagaacctgggcaaggccctgaagaaggacctgaaggagaagaccaagaccaagaagccaggcaccaagaccaagagcagcagccctgtgaagaagagtgatggcaagagcaagcccctggccgccagccccaagccagctggcctgaaggagagcagtgacaaggtgtcccgggtggccagccccaagaagaaggagagcgtggagaaggccgccaagcccaccaccaccccagaggtgaaggccgcccggggggaggagaaggacaaggagaccaagaatgctgccaatgccagcgccagcaagagcgccaagacagccacagctggccctggcaccaccaagaccaccaagagcagcgctgtgcccccaggcctgcctgtgtacctggacctgtgctacatccccaaccacagcaacagcaagaatgtggatgtggagttcttcaagagggtgcgcagcagctactacgtggtgtctggaaatgaccctgctgctgaggagcccagcagagctgtgctggatgccctgctggagggcaaggcccagtggggcagcaacatgcaggtgaccctcatccccacccatgacagcgaggtgatgagggagtggtaccaggagacccatgagaagcagcaggacctgaacatcatggtgctggccagcagcagcacagtggtgatgcaggatgagagcttccctgcctgcaagattgagctgtag

SEQ ID NO: 20470 - DNA, 432 bp, Artificial Sequence
  Description of Artificial Sequence: Synthetic coding sequence
atgcagcaccggggcttcctgctgctgaccctgctggccctgctggccctgaccagcgctgtggccaagaagaaggacaaggtgaagaagggcggccctggctctgaatgtgccgagtgggcctggggcccctgcacccccagcagcaaggactgtggggtgggcttccgggagggcacctgtggggcccagacccagaggatccgctgccgggtgccctgcaactggaagaaggagtttggagctgactgcaagtacaagtttgagaactggggcgcctgtgatggcggcaccggcaccaaggtgcggcagggcaccctgaagaaggcccgctacaatgcccagtgccaggagaccatccgggtgaccaagccctgcacccccaagaccaaggccaaggccaaggccaagaagggcaagggcaaggactag

SEQ ID NO: 20471 - DNA, 432 bp, Artificial Sequence; identical to SEQ ID NO: 20470
  Description of Artificial Sequence: Synthetic coding sequence

SEQ ID NO: 20472 - DNA, 432 bp, Artificial Sequence; identical to SEQ ID NO: 20470
  Description of Artificial Sequence: Synthetic coding sequence

SEQ ID NO: 20473 - DNA, 459 bp, Artificial Sequence
  Description of Artificial Sequence: Synthetic coding sequence
atgcagcaccggggcttcctgctgctgaccctgctggccctgctggccctgaccagcgctgtggccaagaagaaggaggagggcgccctgcagtgcagcgtgcctggggaccaccccaggcaccaggccctgcacccccaggaccagagcaagggccagagccaggagcgggagggcaagggcctggatgccaagccaggctgccagggcgcccctggggtgacctggggcctggcccacgccctgcccctgcccggcccccgctgtgacccccctgtgcccagcgtgtgcagcctggccctgatcaaccacgccctgccctgccccagccacagccctgccccacccctgagcgcccagagcggggagggccagggcatcctgggcagcctgagcctgccccagagcaatgtgagcccccgggcccgcttctgcagcagcccccagttccactactag

SEQ ID NO: 20474 - DNA, 432 bp, Artificial Sequence; identical to SEQ ID NO: 20470
  Description of Artificial Sequence: Synthetic coding sequence

SEQ ID NO: 20475 - DNA, 432 bp, Artificial Sequence; identical to SEQ ID NO: 20470
  Description of Artificial Sequence: Synthetic coding sequence

SEQ ID NO: 20476 - DNA, 432 bp, Artificial Sequence; identical to SEQ ID NO: 20470
  Description of Artificial Sequence: Synthetic coding sequence

SEQ ID NO: 20477 - DNA, 150 bp, Artificial Sequence
  Description of Artificial Sequence: Synthetic coding sequence
atgcagcaccggggcttcctgctgctgaccctgctggccctgctggccctgaccagcgctgtggccaagaagaaggacaaggtgaagaagggcggccctggctctgaatgtgccgagtgggcctggggcccctgcacccccagcagctag

SEQ ID NO: 20478 - DNA, 396 bp, Artificial Sequence
  Description of Artificial Sequence: Synthetic coding sequence
atgcagcaccggggcttcctgctgctgaccctgctggccctgctggccctgaccagcgctgtggccaagaagaaggacaaggtgaagaagggcggccctggctctgaatgtgccgagtgggcctggggcccctgcacccccagcagcaaggactgtggggtgggcttccgggagggcacctgtggggcccagacccagaggatccgctgccgggtgccctgcaactggaagaaggagtttggagctgactgcaagtacaagtttgagaactggggcgcctgtgatggcggcaccggcaccaaggtgcggcagggcaccctgaagaaggcccgctacaatgcccagtgccaggagaccatccgggtgaccaagccctgcacccccaagaccaagtag

SEQ ID NO: 20479 - DNA, 264 bp, Artificial Sequence
  Description of Artificial Sequence: Synthetic coding sequence
atgcagcaccggggcttcctgctgctgaccctgctggccctgctggccctgaccagcgctgtggccaagaagaaggctgactgcaagtacaagtttgagaactggggcgcctgtgatggcggcaccggcaccaaggtgcggcagggcaccctgaagaaggcccgctacaatgcccagtgccaggagaccatccgggtgaccaagccctgcacccccaagaccaaggccaaggccaaggccaagaagggcaagggcaaggactag

SEQ ID NO: 20480 - DNA, 2715 bp, Artificial Sequence
  Description of Artificial Sequence: Synthetic coding sequence
atggccgagagcagcgagagcttcaccatggccagcagccctgcccagaggagaagaggaaatgaccccctgaccagcagccctggccgcagcagcagaagaacagatgccctgaccagcagccctggccgggacctgcccccatttgaagatgaaagtgagggcctgctgggcacagagggccccctggaggaggaggaggatggagaggagctgattggagatggcatggagcgggactaccgggccatccctgagctggatgcctatgaggccgagggcctggccctggatgatgaagatgtggaggagctgacagccagccagcgggaggccgctgagcgggccatgaggcagagggaccgggaggccggccggggcctgggccgcatgaggcggggcctgctgtatgacagtgatgaggaggatgaggagaggcctgccaggaagaggcggcaggtggagcgggccacagaagatggagaagaagatgaggagatgattgagagcattgagaacctggaggacctgaagggccacagcgtgcgggagtgggtgtccatggccggcccccggctggagatccaccaccgcttcaagaacttcctgcggacccacgtggacagccacggccacaacgtgttcaaggagcgcatcagtgacatgtgcaaggaaaatcgggagagcctggtggtgaactatgaggacctggccgcccgggagcacgtgctggcctacttcctgcctgaggccccagctgagctgctgcagatctttgatgaggccgccctggaggtggtgctggccatgtaccccaagtatgaccgcatcaccaaccacatccacgtgcgcatcagccacctgcccctggtggaggagctgcggagcctgcggcagctgcacctgaaccagctgatccgcaccagcggcgtggtgaccagctgcaccggggtgctgccccagctgtccatggtgaagtacaactgcaacaagtgcaactttgtgctgggccccttctgccagagccagaaccaggaggtgaagccaggcagctgcccagagtgccagagcgctggcccctttgaggtgaacatggaggagaccatctaccagaactaccagaggatccgcatccaggagagccctgggaaggtggccgccggccgcctgcccaggagcaaggatgccatcctgctggccgacctggtggacagctgcaagccaggagatgaaattgagctgaccggcatctaccacaacaactatgatggcagcctgaacacagccaacggcttccctgtgtttgccaccgtcatcctggccaaccacgtggccaagaaggacaacaaggtggccgtgggggagctgacagatgaagatgtgaagatgatcaccagcctgagcaaggaccagcagattggagagaagatctttgccagcatcgcccccagcatctacggccacgaggacatcaagaggggcctggccctggccctgtttggaggagagcccaagaaccctgggggcaagcacaaggtgcggggggacatcaacgtgctgctgtgtggggaccctggaacagccaagagccagttcctgaagtacatcgagaaggtgagcagccgggccatcttcaccaccggccagggcgccagcgctgtgggcctgacagcctacgtgcagaggcaccctgtgtcccgggagtggaccctggaggccggggccctggtgctggccgaccggggcgtgtgcctgattgatgaatttgacaagatgaatgaccaggacaggaccagcatccacgaggccatggagcagcagagcatcagcatcagcaaggccggcatcgtgaccagcctgcaggcccgctgcaccgtgattgctgctgccaaccccatcggcggccgctatgaccccagcctgaccttctctgaaaatgtggacctgacagagcccatcatcagcagatttgacatcctgtgtgtggtgcgggacacagtggaccctgtgcaggatgagatgctggccaggtttgtggtgggcagccacgtgcgccaccaccccagcaacaaggaggaggagggcctggccaacggcagcgctgctgagcccgccatgcccaacacctacggcgtggagcccctgccccaggaggtgctgaagaagtacatcatctatgccaaggagcgggtgcaccccaagctgaaccagatggaccaggacaaggtggccaagatgtacagcgacctgaggaaggagagcatggccaccggcagcatccccatcaccgtgcgccacattgaatccatgatccgcatggccgaggcccacgcccgcatccacctgcgggactatgtgattgaagatgatgtgaacatggccatccgggtgatgctggagagcttcatcgacacccagaagttctctgtgatgaggtccatgaggaagacctttgcccgctacctgtccttcagaagagacaacaatgagctgctgctcttcatcctgaagcagctggtggccgagcaggtgacctaccagaggaacagatttggagcccagcaggacaccatcgaggtgcctgagaaggacctggtggacaaggcccggcagatcaacatccacaacctgagcgccttctatgattctgagctgttcaggatgaacaagttcagccatgacctgaagaggaagatgatcctgcagcagttctag

SEQ ID NO: 20481 - DNA, 2427 bp, Artificial Sequence
  Description of Artificial Sequence: Synthetic coding sequence
atggccgagagcagcgagagcttcaccatggccagcagccctgcccagaggagaagaggaaatgaccccctgaccagcagccctggctggggcctgggccgcatgaggcggggcctgctgtatgacagtgatgaggaggatgaggagaggcctgccaggaagaggcggcaggtggagcgggccacagaagatggagaagaagatgaggagatgattgagagcattgagaacctggaggacctgaagggccacagcgtgcgggagtgggtgtccatggccggcccccggctggagatccaccaccgcttcaagaacttcctgcggacccacgtggacagccacggccacaacgtgttcaaggagcgcatcagtgacatgtgcaaggaaaatcgggagagcctggtggtgaactatgaggacctggccgcccgggagcacgtgctggcctacttcctgcctgaggccccagctgagctgctgcagatctttgatgaggccgccctggaggtggtgctggccatgtaccccaagtatgaccgcatcaccaaccacatccacgtgcgcatcagccacctgcccctggtggaggagctgcggagcctgcggcagctgcacctgaaccagctgatccgcaccagcggcgtggtgaccagctgcaccggggtgctgccccagctgtccatggtgaagtacaactgcaacaagtgcaactttgtgctgggccccttctgccagagccagaaccaggaggtgaagccaggcagctgcccagagtgccagagcgctggcccctttgaggtgaacatggaggagaccatctaccagaactaccagaggatccgcatccaggagagccctgggaaggtggccgccggccgcctgcccaggagcaaggatgccatcctgctggccgacctggtggacagctgcaagccaggagatgaaattgagctgaccggcatctaccacaacaactatgatggcagcctgaacacagccaacggcttccctgtgtttgccaccgtcatcctggccaaccacgtggccaagaaggacaacaaggtggccgtgggggagctgacagatgaagatgtgaagatgatcaccagcctgagcaaggaccagcagattggagagaagatctttgccagcatcgcccccagcatctacggccacgaggacatcaagaggggcctggccctggccctgtttggaggagagcccaagaaccctgggggcaagcacaaggtgcggggggacatcaacgtgctgctgtgtggggaccctggaacagccaagagccagttcctgaagtacatcgagaaggtgagcagccgggccatcttcaccaccggccagggcgccagcgctgtgggcctgacagcctacgtgcagaggcaccctgtgtcccgggagtggaccctggaggccggggccctggtgctggccgaccggggcgtgtgcctgattgatgaatttgacaagatgaatgaccaggacaggaccagcatccacgaggccatggagcagcagagcatcagcatcagcaaggccggcatcgtgaccagcctgcaggcccgctgcaccgtgattgctgctgccaaccccatcggcggccgctatgaccccagcctgaccttctctgaaaatgtggacctgacagagcccatcatcagcagatttgacatcctgtgtgtggtgcgggacacagtggaccctgtgcaggatgagatgctggccaggtttgtggtgggcagccacgtgcgccaccaccccagcaacaaggaggaggagggcctggccaacggcagcgctgctgagcccgccatgcccaacacctacggcgtggagcccctgccccaggaggtgctgaagaagtacatcatctatgccaaggagcgggtgcaccccaagctgaaccagatggaccaggacaaggtggccaagatgtacagcgacctgaggaaggagagcatggccaccggcagcatccccatcaccgtgcgccacattgaatccatgatccgcatggccgaggcccacgcccgcatccacctgcgggactatgtgattgaagatgatgtgaacatggccatccgggtgatgctggagagcttcatcgacacccagaagttctctgtgatgaggtccatgaggaagacctttgcccgctacctgtccttcagaagagacaacaatgagctgctgctcttcatcctgaagcagctggtggccgagcaggtgacctaccagaggaacagatttggagcccagcaggacaccatcgaggtgcctgagaaggacctggtggacaaggcccggcagatcaacatccacaacctgagcgccttctatgattctgagctgttcaggatgaacaagttcagccatgacctgaagaggaagatgatcctgcagcagttctag

SEQ ID NO: 20482 - DNA, 2865 bp, Artificial Sequence
  Description of Artificial Sequence: Synthetic coding sequence
atggccgagagcagcgagagcttcaccatggccagcagccctgcccagaggagaagaggaaatgaccccctgaccagcagccctggccgcagcagcagaagaacagatgccctgaccagcagccctggccgggacctgcccccatttgaagatgaaagtgagggcctgctgggcacagagggccccctggaggaggaggaggatggagaggagctgattggagatggcatggagcgggactaccgggccatccctgagctggatgcctatgaggccgagggcctggccctggatgatgaagatgtggaggagctgacagccagccagcgggaggccggccggggcctgctgtatgacagtgatgaagaagatgaggagaggcctgccaggaagaggcggcaggtggagcgggccacagaagatggagaggaggatgaggagatgattgagagcattgagaacctggaggacctgaagggccacagcgtgcgggagtgggtgtccatggccggcccccggctggagatccaccaccgcttcaagaacttcctgcggacccacgtggacagccacggccacaacgtgttcaaggagcgcatcagtgacatgtgcaaggagaaccgggagagcctggtggtgaactatgaggacctggccgcccgggagcacgtgctggcctacttcctgcctgaggccccagctgagctgctgcagatctttgatgaagctgccctggaggtggtgctggccatgtaccccaagtatgaccgcatcaccaaccacatccacgtgcgcatcagccacctgcccctggtggaggagctgcggagcctgcggcagctgcacctgaaccagctgatccgcaccagcggcgtggtgaccagctgcacaggagtgctgccccagctgtccatggtgaagtacaactgcaacaagtgcaactttgtgctgggccccttctgccagagccagaaccaggaggtgaagccaggcagctgcccagagtgccagagcgctggcccctttgaggtgaacatggaggagaccatctaccagaactaccagaggatccgcatccaggagagccctgggaaggtggccgccggccgcctgcccaggagcaaggatgccatcctgctggccgacctggtggacagctgcaagccaggagatgaaattgagctgaccggcatctaccacaacaactatgatggcagcctgaacacagccaacggcttccctgtgtttgccaccgtcatcctggccaaccacgtggccaagaaggacaacaaggtggccgtgggggagctgacagatgaagatgtgaagatgatcaccagcctgagcaaggaccagcagatcggggagaaggagagcagcagaaatgccagcctggccgaggccggcatcggggccatccccagccagctgctggccatcgagcccagcctgcggcgctctggagtgcccatcggggaggtgggcgtgtcccagaggcaggaggcccggagcttcagcagcgccaacacccactggttcctggaggacctgctgggccccagctgccgggacaccatgatctttgccagcatcgcccccagcatctacggccacgaggacatcaagaggggcctggccctggccctgtttggaggagagcccaagaaccctgggggcaagcacaaggtgcggggggacatcaacgtgctgctgtgtggggaccctggaacagccaagagccagttcctgaagtacatcgagaaggtgagcagccgggccatcttcaccaccggccagggcgccagcgctgtgggcctgacagcctacgtgcagaggcaccctgtgtcccgggagtggaccctggaggccggggccctggtgctggccgaccggggcgtgtgcctgattgatgaatttgacaagatgaatgaccaggacaggaccagcatccacgaggccatggagcagcagagcatcagcatcagcaaggccggcatcgtgaccagcctgcaggcccgctgcaccgtgattgctgctgccaaccccatcggcggccgctatgaccccagcctgaccttctctgaaaatgtggacctgacagagcccatcatcagcagatttgacatcctgtgtgtggtgcgggacacagtggaccctgtgcaggatgagatgctggccaggtttgtggtgggcagccacgtgcgccaccaccccagcaacaaggaggaggagggcctggccaacggcagcgctgctgagcccgccatgcccaacacctacggcgtggagcccctgccccaggaggtgctgaagaagtacatcatctatgccaaggagcgggtgcaccccaagctgaaccagatggaccaggacaaggtggccaagatgtacagcgacctgaggaaggagagcatggccaccggcagcatccccatcaccgtgcgccacattgaatccatgatccgcatggccgaggcccacgcccgcatccacctgcgggactatgtgattgaagatgatgtgaacatggccatccgggtgatgctggagagcttcatcgacacccagaagttctctgtgatgaggtccatgaggaagacctttgcccgctacctgtccttcagaagagacaacaatgagctgctgctcttcatcctgaagcagctggtggccgagcaggtgacctaccagaggaacagatttggagcccagcaggacaccatcgaggtgcctgagaaggacctggtggacaaggcccggcagatcaacatccacaacctgagcgccttctatgattctgagctgttcaggatgaacaagttcagccatgacctgaagaggaagatgatcctgcagcagttctag

SEQ ID NO: 20483 - DNA, 753 bp, Artificial Sequence
  Description of Artificial Sequence: Synthetic coding sequence
atggccctgcgggccggcctggtgctgggcttccacaccctgatgaccctgctgagcccccaggaggccggggccaccaaggctgaccacatgggcagctatggccctgccttctaccagagctatggagccagcggccagttcacccatgaatttgatgaggagcagctgttctctgtggacctgaagaagtctgaggccgtgtggaggctgcctgagtttggagactttgccaggtttgacccccagggcggcctggccggcattgctgccatcaaggcccacctggacatcctggtggagaggagcaacagaagccgggccatcaacgtgcccccccgggtgacagtgctgcccaagagccgggtggagctgggccagcccaacatcctgatctgcatcgtggacaacatcttcccccctgtgatcaacatcacctggctgagaaatggccagacagtgacagaaggagtggcccagaccagcttctacagccagcctgaccacctgttcaggaagttccactacctgccctttgtgcccagcgcagaagatgtgtatgactgccaggtggagcactggggcctggatgcccccctgctgcggcactgggagctgcaggtgcccatccccccaccagatgccatggagaccctggtgtgtgccctgggcctggccatcggcctggtgggcttcctggtgggcaccgtgctgatcatcatgggcacctacgtgtcctctgtgcccaggtag

SEQ ID NO: 20484 - DNA, 993 bp, Artificial Sequence
  Description of Artificial Sequence: Synthetic coding sequence
atgcaccgctaccgggcccctggagagcaggatggagatgccatgcccctgggcagcgctgtggacatcctggccacagatgaccccaacttcagccaggaggaccagcaggacacccagatctatgagaagcatgacaacctgctgcacggcaccaagaagaagaaggagaagatggtgtctgctgccttcatgaagaagtacatccacgtggccaagatcatcaagcctgtgctgacccaggagagcgccacctacatcgccgaggagtacagccggctgcggagccaggacagcatgagcagtgacacagcccggaccagccctgtgacagcccggaccctggagaccctcatccggctggccacagcccacgccaaggccaggatgagcaagacagtggacctgcaggatgctgaggaggccgtggagctggtgcagtatgcctacttcaagaaggtgctggagaaggagaagaagaggaagaagagaagtgaagatgaaagtgaaacagaagatgaggaggagaagagccaggaggaccaggagcagaagaggaagaggaggaagacccggcagccagatgccaaggatggagacagctatgacccctatgacttcagtgacacagaggaggagatgccccaggtgcacacccccaagacagctgacagccaggagaccaaggagagccagaaggtggagctgtctgagagcagagatggcatcagcccctgctgccccggctggagctggaccccaggcctgaagcagagcttctacctgagcctgcccaagggctgggactaccgccacaagcccctgtgcctgtttgacctgatcctcttcaatgactgccgggtgtccatggtggagggcatccagggcggccccctgggctgtgtgcccggcagcagctgtgctgtgaacagacatgagagcccccaccgcatccaccagcccggccagaggcgggccctgctcttctcctag

SEQ ID NO: 20485 - DNA, 2289 bp, Artificial Sequence
  Description of Artificial Sequence: Synthetic coding sequence
atgtggagctgtggccgcctgcgggagatcacctggacctcctggaccacccggctgctgaacaatgcctttgaggagctggtggccttccagagggccctgaaggactttgtggccagcattgatgccacctacgccaagcagtatgaggagttctacgtgggcctggagggcagctttggcagcaagcacgtgagccccaggaccctgaccagctgcttcctgagctgtgtggtgtgtgtggagggcatcgtgaccaagtgcagcctggtgcggcccaaggtggtgcgctctgtgcactactgcccagccaccaagaagaccattgaaagacgctacagcgacctgaccaccctggtggccttccccagcagctctgtgtaccccaccaaggatgaggagaacaaccccctggagacagaatatggcctgtctgtgtacaaggaccaccagaccatcaccatccaggagatgcctgagaaggccccagctggccagctgcccaggtctgtggatgtgatcctggatgatgacctggtggacaaggccaagccaggggacagagtgcaggtggtgggcacctaccgctgcctgcccgggaagaagggcggctacaccagcggcaccttcagaacagtgctgattgcctgcaatgtgaagcagatgagcaaggatgcccagcccagcttcagcgcagaagatattgccaagatcaagaagttcagcaagaccaggagcaaggacatctttgaccagctggccaagagcctggcccccagcatccacggccatgactatgtgaagaaggccatcctgtgcctgctgctgggcggcgtggagcgggacctggagaatggcagccacatccggggggacatcaacatcctgctgattggagaccccagcgtggccaagagccagctgctgcgctacgtgctgtgcacagccccccgggccatccccaccaccggccggggcagcagcggcgtgggcctgacagctgctgtgaccacagaccaggagaccggggagcggcggctggaggccggggccatggtgctggccgaccggggcgtggtgtgcattgatgaatttgacaagatgtctgacatggacagaacagccatccacgaggtgatggagcagggccgggtgaccatcgccaaggccggcatccacgcccggctgaatgcccgctgcagcgtgctggccgccgccaaccctgtgtatggccgctatgaccagtacaagacccccatggagaacatcggcctgcaggacagcctgctgagcagatttgacctgctcttcatcatgctggaccagatggaccctgagcaggaccgggagatcagtgaccacgtgctgaggatgcaccgctaccgggcccctggagagcaggatggagatgccatgcccctgggcagcgctgtggacatcctggccacagatgaccccaacttcagccaggaggaccagcaggacacccagatctatgagaagcatgacaacctgctgcacggcaccaagaagaagaaggagaagatggtgtctgctgccttcatgaagaagtacatccacgtggccaagatcatcaagcctgtgctgacccaggagagcgccacctacatcgccgaggagtacagccggctgcggagccaggacagcatgagcagtgacacagcccggaccagccctgtgacagcccggaccctggagaccctcatccggctggccacagcccacgccaaggccaggatgagcaagacagtggacctgcaggatgctgaggaggccgtggagctggtgcagtatgcctacttcaagaaggtgctggagaaggagaagaagaggaagaagagaagtgaagatgagagcgagacagaagatgaggaggagaagagccaggaggaccaggagcagaagaggaagaggaggaagacccggcagccagatgccaaggatggagacagctatgacccctatgacttcagtgacacagaggaggagatgccccaggtgcacacccccaagacagctgacagccaggagaccaaggagagccagaaggtggagctgtctgagagccggctgaaggccttcaaggtggccctgctggatgtgttccgggaggcccacgcccagagcatcggcatgaaccggctgacagagagcatcaacagagacagcgaggagcccttcagctctgtggagatccaggccgccctgagcaagatgcaggatgacaaccaggtgatggtgtctgagggcatcatcttcctgatctag

SEQ ID NO: 20486 - DNA, 987 bp, Artificial Sequence
  Description of Artificial Sequence: Synthetic coding sequence
cgctaccgggcccctggagagcaggatggagatgccatgcccctgggcagcgctgtggacatcctggccacagatgaccccaacttcagccaggaggaccagcaggacacccagatctatgagaagcatgacaacctgctgcacggcaccaagaagaagaaggagaagatggtgtctgctgccttcatgaagaagtacatccacgtggccaagatcatcaagcctgtgctgacccaggagagcgccacctacatcgccgaggagtacagccggctgcggagccaggacagcatgagcagtgacacagcccggaccagccctgtgacagcccggaccctggagaccctcatccggctggccacagcccacgccaaggccaggatgagcaagacagtggacctgcaggatgctgaggaggccgtggagctggtgcagtatgcctacttcaagaaggtgctggagaaggagaagaagaggaagaagagaagtgaagatgaaagtgaaacagaagatgaggaggagaagagccaggaggaccaggagcagaagaggaagaggaggaagacccggcagccagatgccaaggatggagacagctatgacccctatgacttcagtgacacagaggaggagatgccccaggtgcacacccccaagacagctgacagccaggagaccaaggagagccagaaggtggagctgtctgagagcagagatggcatcagcccctgctgccccggctggagctggaccccaggcctgaagcagagcttctacctgagcctgcccaagggctgggactaccgccacaagcccctgtgcctgtttgacctgatcctcttcaatgactgccgggtgtccatggtggagggcatccagggcggccccctgggctgtgtgcccggcagcagctgtgctgtgaacagacatgagagcccccaccgcatccaccagcccggccagaggcgggccctgctcttctcctag

SEQ ID NO: 20487 - DNA, 2562 bp, Artificial Sequence
  Description of Artificial Sequence: Synthetic coding sequence
atgctgcccaggagcccccccctgccccggggcaacctgtggtggagggaggagtttggcagcttccgggccggcgtggagagctcctgggagcccccccgggactttggaggcggcagcagcctggccgccggcatggccggcaccgtggtgctggatgatgtggagctgcgggaggcccagagggactacctggacttcctggatgatgaggaggaccagggcatctaccagagcaaggtgcgggagctgatcagtgacaaccagtaccgcctgattgtgaatgtgaatgacctgcggaggaagaatgagaagagggccaaccggctgctgaacaatgcctttgaggagctggtggccttccagagggccctgaaggactttgtggccagcattgatgccacctacgccaagcagtatgaggagttctacgtgggcctggagggcagctttggcagcaagcacgtgagccccaggaccctgaccagctgcttcctgagctgtgtggtgtgtgtggagggcatcgtgaccaagtgcagcctggtgcggcccaaggtggtgcgctctgtgcactactgcccagccaccaagaagaccatcgagcggcgctacagcgacctgaccaccctggtggccttccccagcagctctgtgtaccccaccaaggatgaggagaacaaccccctggagacagaatatggcctgtctgtgtacaaggaccaccagaccatcaccatccaggagatgcctgagaaggccccagctggccagctgcccaggtctgtggatgtgatcctggatgatgacctggtggacaaggccaagccaggggacagagtgcaggtggtgggcacctaccgctgcctgcccgggaagaagggcggctacaccagcggcaccttcagaacagtgctgattgcctgcaatgtgaagcagatgagcaaggatgcccagcccagcttctctgctgaggacatcgccaagatcaagaagttcagcaagaccaggagcaaggacatctttgaccagctggccaagagcctggcccccagcatccacggccatgactatgtgaagaaggccatcctgtgcctgctgctgggcggcgtggagcgggacctggagaatggcagccacatccggggggacatcaacatcctgctgattggagaccccagcgtggccaagagccagctgctgcgctacgtgctgtgcacagccccccgggccatccccaccaccggccggggcagcagtggagtgggcctgacagctgctgtgaccacagaccaggagactggagagcggcggctggaggccggggccatggtgctggccgacagaggagtggtgtgcattgatgaatttgacaagatgtctgacatggacagaacagccatccacgaggtgatggagcagggccgggtgaccatcgccaaggccggcatccacgcccggctgaatgcccgctgcagcgtgctggccgccgccaaccctgtgtatggccgctatgaccagtacaagacccccatggagaacatcggcctgcaggacagcctgctgagcagatttgacctgctcttcatcatgctggaccagatggaccctgagcaggaccgggagatcagtgaccacgtgctgaggatgcaccgctaccgggcccctggagagcaggatggagatgccatgcccctgggcagcgctgtggacatcctggccacagatgaccccaacttcagccaggaggaccagcaggacacccagatctatgagaagcatgacaacctgctgcacggcaccaagaagaagaaggagaagatggtgtctgctgccttcatgaagaagtacatccacgtggccaagatcatcaagcctgtgctgacccaggagagcgccacctacatcgccgaggagtacagccggctgcggagccaggacagcatgagcagtgacacagcccggaccagccctgtgacagcccggaccctggagaccctcatccggctggccacagcccacgccaaggccaggatgagcaagacagtggacctgcaggatgctgaggaggccgtggagctggtgcagtatgcctacttcaagaaggtgctggagaaggagaagaagaggaagaagagaagtgaagatgaaagtgaaacagaagatgaggaggagaagagccaggaggaccaggagcagaagaggaagaggaggaagacccggcagccagatgccaaggatggagacagctatgacccctatgacttcagtgacacagaggaggagatgccccaggtgcacacccccaagacagctgacagccaggagaccaaggagagccagaaggtggagctgtctgagagccggctgaaggccttcaaggtggccctgctggatgtgttccgggaggcccacgcccagagcatcggcatgaaccggctgacagagagcatcaacagagattctgaggagcccttcagctctgtggagatccaggccgccctgagcaagatgcaggatgacaaccaggtgatggtgtctgagggcatcatcttcctgatctag

SEQ ID NO: 20488 - DNA, 2592 bp, Artificial Sequence
  Description of Artificial Sequence: Synthetic coding sequence
atgagcagccctgccagcacccccagccggcggggcagccggcggggccgggccaccccagcccagacccccaggagtgaagatgcccggagcagccccagccagaggagaagaggagaggacagcaccagcactggagagctgcagcccatgcccaccagccctggggtggacctgcagagccctgctgcccaggatgtgctcttcagcagccccccccagatgcacagcagcgccatccccctggactttgatgtgagcagccccctgacctacggcacccccagcagccgggtggagggcacccccaggtctggagtgcggggcacccctgtgcggcagaggccagacctgggcagcgcccagaagggcctgcaggtggacctgcagagtgatggagctgctgctgaagatattgtggccagcgagcagagcctgggccagaagctggtgatctggggcacagatgtgaatgtggccgcctgcaaggagaacttccagcgcttcctgcagcgcttcatcgaccccctggccaaggaggaggagaatgtgggcatcgacatcacagagcccctgtacatgcagaggctgggggagatcaacgtgattggagagcccttcctgaatgtgaactgtgagcacatcaagagctttgacaagaacctgtaccggcagctgatctcctacccccaggaggtgatccccacctttgacatggctgtgaatgagatcttctttgaccgctacccagacagcatcctggagcaccagatccaggtgcggcccttcaatgccctgaagaccaagaacatgaggaacctgaacccagaagatattgaccagctgatcaccatcagcggcatggtgatccgcaccagccagctgatccctgagatgcaggaggccttcttccagtgccaggtgtgtgcccacaccaccagggtggagatggaccggggcagaattgctgagcccagcgtgtgtggccgctgccacaccacccacagcatggccctgatccacaacagaagcctcttcagtgacaagcagatgatcaagctgcaggagagccctgaggacatgcctgctggccagaccccccacacagtcatcctgtttgcccacaatgacctggtggacaaggtgcagcccggggacagagtgaatgtgacaggcatctacagagctgtgcccatccgggtgaacccccgggtgtccaatgtgaagtctgtgtacaagacccacattgatgtgatccactacaggaagacagatgccaagaggctgcacggcctggatgaggaggccgagcagaagctgttcagcgagaagagggtggagctgctgaaggagctgagcaggaagccagacatctatgagcggctggccagcgccctggcccccagcatctatgaacatgaggacatcaagaagggcatcctgctgcagctgtttggaggcaccaggaaggacttcagccacacaggccggggcaagttccgggcagagatcaacatcctgctgtgtggggaccccggcaccagcaagagccagctgctgcagtatgtgtacaacctggtgccccggggccagtacaccagcggcaagggcagcagcgctgtgggcctgacagcctacgtgatgaaggaccctgagacccggcagctggtgctgcagacaggagccctggtgctgagtgacaatggcatctgctgcattgatgaatttgacaagatgaatgaaagcaccaggtctgtgctgcacgaggtgatggagcagcagaccctgagcatcgccaaggccggcatcatctgccagctgaatgcccggacctctgtgctggccgccgccaaccccatcgagagccagtggaaccccaagaagaccaccatcgagaacatccagctgccccacaccctgctgagcagatttgacctgatcttcctgctgctggacccccaggatgaggcctatgaccggcggctggcccaccacctggtggccctgtactaccagagcgaggagcaggccgaggaggagctgctggacatggctgtgctgaaggactacatcgcctatgcccacagcaccatcatgccccggctgtctgaggaggccagccaggccctgattgaggcctacgtggacatgaggaagattggcagcagccggggcatggtgtctgcctacccccggcagctggagagcctcatccggctggccgaggcccacgccaaggtgcggctgagcaacaaggtggaggccattgatgtggaggaggccaagaggctgcaccgggaggccctgaagcagagcgccacagaccccaggacaggcatcgtggacatcagcatcctgaccaccggcatgtctgccaccagcaggaagaggaaggaggagctggccgaggccctgaagaagctgatcctgagcaagggcaagaccccagccctgaagtaccagcagctgtttgaggacatccggggccagagcgacatcgccatcaccaaggacatgtttgaggaggccctgcgggccctggctgatgatgacttcctgactgtgacaggcaagacagtgcggctgctgtag

SEQ ID NO: 20489 - DNA, 2472 bp, Artificial Sequence
  Description of Artificial Sequence: Synthetic coding sequence
atgcctggccacctgcccctgagagatgtggaggcccgcatccccccaccccggggcagctgcagccgctgccagccccggctggagtggacctgccgggccctgctgcggaggacctgctgcttccctgccctgcccaagtgcatcctgcagctgagcctgctgaccctgatgctggagggcacccccaggtctggagtgcggggcacccctgtgcggcagaggccagacctgggcagcgcccagaagggcctgcaggtggacctgcagagtgatggagctgctgctgaagatattgtggccagcgagcagagcctgggccagaagctggtgatctggggcacagatgtgaatgtggccgcctgcaaggagaacttccagcgcttcctgcagcgcttcatcgaccccctggccaaggaggaggagaatgtgggcatcgacatcacagagcccctgtacatgcagaggctgggggagatcaacgtgattggagagcccttcctgaatgtgaactgtgagcacatcaagagctttgacaagaacctgtaccggcagctgatctcctacccccaggaggtgatccccacctttgacatggctgtgaatgagatcttctttgaccgctacccagacagcatcctggagcaccagatccaggtgcggcccttcaatgccctgaagaccaagaacatgaggaacctgaacccagaagatattgaccagctgatcaccatcagcggcatggtgatccgcaccagccagctgatccctgagatgcaggaggccttcttccagtgccaggtgtgtgcccacaccaccagggtggagatggaccggggcagaattgctgagcccagcgtgtgtggccgctgccacaccacccacagcatggccctgatccacaacagaagcctcttcagtgacaagcagatgatcaagctgcaggagagccctgaggacatgcctgctggccagaccccccacacagtcatcctgtttgcccacaatgacctggtggacaaggtgcagcccggggacagagtgaatgtgacaggcatctacagagctgtgcccatccgggtgaacccccgggtgtccaatgtgaagtctgtgtacaagacccacattgatgtgatccactacaggaagacagatgccaagaggctgcacggcctggatgaggaggccgagcagaagctgttcagcgagaagagggtggagctgctgaaggagctgagcaggaagccagacatctatgagcggctggccagcgccctggcccccagcatctatgaacatgaggacatcaagaagggcatcctgctgcagctgtttggaggcaccaggaaggacttcagccacacaggccggggcaagttccgggcagagatcaacatcctgctgtgtggggaccccggcaccagcaagagccagctgctgcagtatgtgtacaacctggtgccccggggccagtacaccagcggcaagggcagcagcgctgtgggcctgacagcctacgtgatgaaggaccctgagacccggcagctggtgctgcagacaggagccctggtgctgagtgacaatggcatctgctgcattgatgaatttgacaagatgaatgaaagcaccaggtctgtgctgcacgaggtgatggagcagcagaccctgagcatcgccaaggccggcatcatctgccagctgaatgcccggacctctgtgctggccgccgccaaccccatcgagagccagtggaaccccaagaagaccaccatcgagaacatccagctgccccacaccctgctgagcagatttgacctgatcttcctgctgctggacccccaggatgaggcctatgaccggcggctggcccaccacctggtggccctgtactaccagagcgaggagcaggccgaggaggagctgctggacatggctgtgctgaaggactacatcgcctatgcccacagcaccatcatgccccggctgtctgaggaggccagccaggccctgattgaggcctacgtggacatgaggaagattggcagcagccggggcatggtgtctgcctacccccggcagctggagagcctcatccggctggccgaggcccacgccaaggtgcggctgagcaacaaggtggaggccattgatgtggaggaggccaagaggctgcaccgggaggccctgaagcagagcgccacagaccccaggacaggcatcgtggacatcagcatcctgaccaccggcatgtctgccaccagcaggaagaggaaggaggagctggccgaggccctgaagaagctgatcctgagcaagggcaagaccccagccctgaagtaccagcagctgtttgaggacatccggggccagagcgacatcgccatcaccaaggacatgtttgaggaggccctgcgggccctggctgatgatgacttcctgactgtgacaggcaagacagtgcggctgctgtag

SEQ ID NO: 20490 - DNA, 2592 bp, Artificial Sequence; identical to SEQ ID NO: 20488
  Description of Artificial Sequence: Synthetic coding sequence

SEQ ID NO: 20491 - DNA, 855 bp, Artificial Sequence
  Description of Artificial Sequence: Synthetic coding sequence
atggccccccggctgtgcagcatctctgtgacagcccggcggctgctgggcggccctggccccagggctggagatgtggccagcgctgctgctgcccgcttctacagcaaggacaatgaaggctcctggttccgcagcctgtttgtgcacaaggtggaccccaggaaggatgcccacagcaccctgctgagcaagaaggagaccagcaacctgtacaagatccagttccacaacgtgaagccagagtacctggatgcctacaacagcctgacagaagctgtgctgcccaagctgcacctggatgaggactacccctgcagcctggtgggcaactggaacacctggtacggggagcaggaccaggccgtgcacctgtggaggttcagcggcggctacccagccctgatggactgcatgaacaagctgaagaacaacaaggagtacctggagttccggcgggagaggagccagatgctgctgagcagaagaaaccagctgctgctggagttctccttctggaatgagccccagcccaggatgggccccaacatctatgagctgcggacctacaagctgaagccaggcaccatgattgagtggggcaacaactgggcccgggccatcaagtaccggcaggagaaccaggaggccgtgggcggcttcttcagccagattggagagctgtatgtggtgcaccacctgtgggcctacaaggacctgcagagccgggaggagaccagaaatgctgcctggaggaagaggggctgggatgaaaatgtgtactacacagtgcccctggtgcgccacatggagagccgcatcatgatccccctgaagatcagccccctgcagtag

SEQ ID NO: 20492 - DNA, 2076 bp, Artificial Sequence
  Description of Artificial Sequence: Synthetic coding sequence
atgagcggctttgatgatcctggcatcttctacagcgacagctttggaggagatgcccaggctgatgagggccaggccaggaagagccagctgcagaggcgcttcaaggagttcctgcggcagtacagagtgggcacagacagaacaggcttcaccttcaagtacagagatgagctgaagaggcactacaacctgggggagtactggattgaggtggagatggaggacctggccagctttgatgaggacctggccgactacctgtacaagcagcctgctgagcacctgcagctgagtgacatgatgagccacctggtgaagatccctggcatcatcatcgccgccagcgctgtgcgggccaaggccacccgcatcagcatccagtgccgcagctgcaggaacaccctgaccaacatcgccatgaggcctggcctggagggctacgccctgcccaggaagtgcaacacagaccaggccggccggcccaagtgccccctggacccctacttcatcatgccagacaagtgcaagtgtgtggacttccagaccctgaagctgcaggagctgcctgatgctgtgccccatggagagatgcccaggcacatgcagctgtactgtgaccgctacctgtgtgacaaggtggtgcccggcaacagagtgaccatcatgggcatctacagcatcaagaagtttggcctgaccaccagccggggccgggacagagtgggcgtgggcatccgcagcagctacatccgggtgctgggcatccaggtggacacagatggcagcggccgcagctttgctggagctgtgagcccccaggaggaggaggagttccggcggctggccgccctgcccaacgtgtatgaagtcatcagcaagagcatcgcccccagcatctttggaggaacagacatgaagaaggccatcgcctgcctgctgtttggaggcagcaggaagaggctgcctgatggcctgacccggcggggggacatcaacctgctgatgctgggggaccccggcacagccaagagccagctgctgaagtttgtggagaagtgcagccccatcggcgtgtacaccagcggcaagggcagcagcgctgctggcctgacagcctctgtgatgagggaccccagcagcaggaacttcatcatggagggcggggccatggtgctggctgatggaggagtggtgtgcattgatgaatttgacaagatgagagaagatgacagagtggccatccacgaggccatggagcagcagaccatcagcatcgccaaggccggcatcaccaccaccctgaacagccgctgcagcgtgctggccgccgccaacagcgtgtttggccgctgggatgagaccaagggggaggacaacatcgacttcatgcccaccatcctgagcagatttgacatgatcttcatcgtgaaggatgagcacaatgaggagagagatgtgatgctggccaagcacgtgatcaccctgcacgtgtctgccctgacccagacccaggccgtggagggggagattgacctggccaagctgaagaagttcatcgcctactgccgggtgaagtgtggcccccggctgtctgctgaggccgctgagaagctgaagaaccgctacatcatcatgaggtctggggcccggcagcacgagcgggacagcgacagaagaagcagcatccccatcaccgtgcggcagctggaggccatcgtgagaattgctgaggccctgagcaagatgaagctgcagccctttgccacagaagcagatgtggaggaggccctgcggctcttccaggtgtccaccctggatgctgccctgagcggcaccctgtctggagtggagggcttcaccagccaggaggaccaggagatgctgagccgcatcgagaagcagctgaagagaagatttgccatcggcagccaggtgtctgagcacagcatcatcaaggacttcaccaagcagaagtacccagagcacgccatccacaaggtgctgcagctgatgctgcggcggggggagatccagcacaggatgcagaggaaggtgctgtaccgcctgaagtag

SEQ ID NO: 20493 - DNA, 696 bp, Artificial Sequence
  Description of Artificial Sequence: Synthetic coding sequence
atgagcggctttgatgatcctggcatcttctacagcgacagctttggaggagatgcccaggctgatgagggccaggccaggaagagccagctgcagaggcgcttcaaggagttcctgcggcagtacagagtgggcacagacagaacaggcttcaccttcaagtacagcctggcccccagcctcatcgagcacctgctgcctgcccgctactgcagcggctgctgggccgccgccctgaagctggacctggccccagccagcagagatgagctgaagaggcactacaacctgggggagtactggattgaggtggagatggaggacctggccagctttgatgaggacctggccgactacctgtacaagcagcctgctgagcacctgcagctgctggaggaggccgccaaggaggtggctgatgaggtgacccggccccggcccagcggggaggaggtgctgcaggacatccaggtgatgctgaagagtgatgccagccccagcagcatccgcagcctgaagagtgacatgatgagccacctggtgaagatccctggcatcatcatcgccgccagcgctgtgcgggccaaggccacccgcatcagcatccagtgccgcagctgcaggaacaccctgaccaacatcgccatgaggcctggcctggagggctacgccctgcccaggaagtgcaacacctag

SEQ ID NO: 20494 - DNA, 1125 bp, Artificial Sequence
  Description of Artificial Sequence: Synthetic coding sequence
atgaacagcagcggcatcaccacctggggcagcacaggcctgcgctggcgctggaggacccggccccggcccagcggggaggaggtgctgcaggacatccaggtgatgctgaagagtgatgccagccccagcagcatccgcagcctgaagagtgacatgatgagccacctggtgaagatccctggcatcatcatcgccgccagcgctgtgcgggccaaggccacccgcatcagcatccagtgccgcagctgcaggaacaccctgaccaacatcgccatgaggcctggcctggagggctacgccctgcccaggaagtgcaacacagaccaggccggccggcccaagtgccccctggacccctacttcatcatgccagacaagtgcaagtgtgtggacttccagaccctgaagctgcaggagctgcctgatgctgtgccccatggagagatgcccaggcacatgcagctgtactgtgaccgctacctgtgtgacaaggtggtgcccggcaacagagtgaccatcatgggcatctacagcatcaagaagtttggcctgaccaccagccggggccgggacagagtgggcgtgggcatccgcagcagctacatccgggtgctgggcatccaggtggacacagatggcagcggccgcagctttgctggagctgtgagcccccaggaggaggaggagttccggcggctggccgccctgcccaacgtgtatgaagtcatcagcaagagcatcgcccccagcatctttggaggaacagacatgaagaaggccatcgcctgcctgctgtttggaggcagcaggaagaggctgcctgatggcctgacccggcggggggacatcaacctgctgatgctgggggaccccggcacagccaagagccagctgctgaagtttgtggagaagtgcagccccatcggcgtgtacaccagcggcaagggcagcagcgctgctggcctgacagcctctgtgatgagggaccccagcagcaggaacttcatcatggagggcggggccatggtgctggctgatggaggagtggtgtgcattgatgaatttgacaagcaccgggaggccgcccaggcccccctgtgccactggctgcccggggtgtag

SEQ ID NO: 20495 - DNA, 1788 bp, Artificial Sequence
  Description of Artificial Sequence: Synthetic coding sequence
atgttctacttccggggctgcggccgctgggtggccgtgtccttcaccaagcagcagttccccctggcccggctgagcagtgacagcgctgcccccaggaccccccactttgatgtgattgtcatcggcggcggccatgctggaacagaagctgccacagctgctgcccgctgtggcagcaggaccctgctgctgacccaccgggtggacaccatcggccagatgagctgcaaccccagctttggaggcatcggcaagggccacctgatgagggaggtggatgccctggatggcctgtgcagccgcatctgtgaccagagcggcgtgcactacaaggtgctgaacagaaggaagggccctgctgtgtggggcctgcgggcccagattgacaggaagctgtacaagcagaacatgcagaaggagatcctgaacacccccctgctgactgtgcaggagggcgctgtggaggacctgatcctgacagagcctgagcctgagcacacaggcaagtgccgggtgtctggagtggtgctgcctgaggaccagctgccctgctacctgacccacaccaacccccgggtggatgaaattgtgctgaagaacctgcacctgaacagccacgtgaaggagaccacccggggcccccgctactgccccagcattgagagcaaggtgctgcgcttccccaaccggctgcaccaggtgtggctggagcctgagggcatggacagcgacctgatctacccccagggcctgtccatgaccctgcctgctgagctgcaggagaagatgatcacctgcatccggggcctggagaaggccaaggtgatccagcccggctatggagtgcagtatgactacctggacccccggcagatcacccccagcctggagacccacctggtgcagaggctcttctttgctggccagatcaatggcaccaccggctatgaggaggccgccgcccagggcgtgattgctggcatcaatgccagcctgcgggtgtccaggaagcccccatttgtggtgtccaggacagagggctacatcggcgtgctgattgatgacctgaccaccctgggcaccagcgagccctacaggatgttcaccagccgggtggagttccggctgagcctgcggccagacaatgctgacagccggctgaccctgcggggctacaaggatgctggctgtgtgtcccagcagagatatgaaagagcctgctggatgaagagcagcctggaggagggcatctctgtgctgaagagcattgagttcctgagcagcaagtggaagaagctgatccctgaggccagcatcagcaccagccgcagcctgcctgtgcgggccctggatgtgctgaagtatgaggaggtggacatggacagcctggccaaggctgtgcctgagcccctgaagaagtacaccaagtgccgggagctggccgagcggctgaagattgaggccacctatgaatctgtgctcttccaccagctgcaggagatcaagggcgtgcagcaggatgaggccctgcagctgcccaaggacctggactacctgaccatcagagatgtgtccctgagccatgaggtgcgggagaagctgcacttcagccggccccagaccatcggggccgccagccgcatccctggggtgaccccagctgccatcatcaacctgctgcgctttgtgaagaccacccagaggcggcagagcgccatgaatgaaagcagcaagacagaccagtacctgtgtgatgctgaccggctgcaggagcgggagctgtag

SEQ ID NO: 20496 - DNA, 2154 bp, Artificial Sequence
  Description of Artificial Sequence: Synthetic coding sequence
atgttctacttccggggctgcggccgctgggtggccgtgtccttcaccaagcagcagttccccctggcccggctgagcagtgacagcgctgcccccaggaccccccactttgatgtgattgtcatcggcggcggccatgctggaacagaagctgccacagctgctgcccgctgtggcagcaggaccctgctgctgacccaccgggtggacaccatcggccagatgagctgcaaccccagctttggaggcatcggcaagggccacctgatgagggaggtggatgccctggatggcctgtgcagccgcatctgtgaccagagcggcgtgcactacaaggtgctgaacagaaggaagggccctgctgtgtggggcctgcgggcccagattgacaggaagctgtacaagcagaacatgcagaaggagatcctgaacacccccctgctgactgtgcaggagggcgctgtggaggacctgatcctgacagagcctgagcctgagcacacaggcaagtgccgggtgtctggagtggtgctggtggatggcagcacagtgtatgcagagagcgtcatcctgaccaccggcaccttcctgcggggcatgattgtgattggcctggagacccaccctgctggccgcctgggggaccagcccagcatcggcctggcccagaccctggagaagctgggctttgtggtgggccgcctgaagacaggcaccccaccaagaattgccaaggagagcatcaacttcagcatcctgaacaagcacatcccagacaaccccagcatccccttctccttcaccaatgaaacagtgtggatcaagccagaggaccagctgccctgctacctgacccacaccaacccccgggtggatgagatcgtgctgaagaacctgcacctgaacagccacgtgaaggagaccacccggggcccccgctactgccccagcattgagagcaaggtgctgcgcttccccaaccggctgcaccaggtgtggctggagcctgagggcatggacagcgacctgatctacccccagggcctgtccatgaccctgcctgctgagctgcaggagaagatgatcacctgcatccggggcctggagaaggccaaggtgatccagccagatggagtgctgctgctgctgcccaggatggagtgcaatggagccatcagcgcccaccacaacctgcccctgcccggctatggagtgcagtatgactacctggacccccggcagatcacccccagcctggagacccacctggtgcagaggctcttctttgctggccagatcaatggcaccaccggctatgaggaggccgccgcccagggcgtgattgctggcatcaatgccagcctgcgggtgtccaggaagcccccatttgtggtgtccaggacagagggctacatcggcgtgctgattgatgacctgaccaccctgggcaccagcgagccctacaggatgttcaccagccgggtggagttccggctgagcctgcggccagacaatgctgacagccggctgaccctgcggggctacaaggatgctggctgtgtgtcccagcagagatatgaaagagcctgctggatgaagagcagcctggaggagggcatctctgtgctgaagagcattgagttcctgagcagcaagtggaagaagctgatccctgaggccagcatcagcaccagccgcagcctgcctgtgcgggccctggatgtgctgaagtatgaggaggtggacatggacagcctggccaaggctgtgcctgagcccctgaagaagtacaccaagtgccgggagctggccgagcggctgaagattgaggccacctatgaatctgtgctcttccaccagctgcaggagatcaagggcgtgcagcaggatgaggccctgcagctgcccaaggacctggactacctgaccatcagagatgtgtccctgagccatgaggtgcgggagaagctgcacttcagccggccccagaccatcggggccgccagccgcatccctggggtgaccccagctgccatcatcaacctgctgcgctttgtgaagaccacccagaggcggcagagcgccatgaatgaaagcagcaagacagaccagtacctgtgtgatgctgaccggctgcaggagcgggagctgtag

SEQ ID NO: 20497 - DNA, 1932 bp, Artificial Sequence
  Description of Artificial Sequence: Synthetic coding sequence
atgagctgcaaccccagctttggaggcatcggcaagggccacctgatgagggaggtggatgccctggatggcctgtgcagccgcatctgtgaccagagcggcgtgcactacaaggtgctgaacagaaggaagggccctgctgtgtggggcctgcgggcccagattgacaggaagctgtacaagcagaacatgcagaaggagatcctgaacacccccctgctgactgtgcaggagggcgctgtggaggacctgatcctgacagagcctgagcctgagcacacaggcaagtgccgggtgtctggagtggtgctggtggatggcagcacagtgtatgcagagagcgtcatcctgaccaccggcaccttcctgcggggcatgattgtgattggcctggagacccaccctgctggccgcctgggggaccagcccagcatcggcctggcccagaccctggagaagctgggctttgtggtgggccgcctgaagacaggcaccccaccaagaattgccaaggagagcatcaacttcagcatcctgaacaagcacatcccagacaaccccagcatccccttctccttcaccaatgaaacagtgtggatcaagccagaggaccagctgccctgctacctgacccacaccaacccccgggtggatgagatcgtgctgaagaacctgcacctgaacagccacgtgaaggagaccacccggggcccccgctactgccccagcattgagagcaaggtgctgcgcttccccaaccggctgcaccaggtgtggctggagcctgagggcatggacagcgacctgatctacccccagggcctgtccatgaccctgcctgctgagctgcaggagaagatgatcacctgcatccggggcctggagaaggccaaggtgatccagccagatggagtgctgctgctgctgcccaggatggagtgcaatggagccatcagcgcccaccacaacctgcccctgcccggctatggagtgcagtatgactacctggacccccggcagatcacccccagcctggagacccacctggtgcagaggctcttctttgctggccagatcaatggcaccaccggctatgaggaggccgccgcccagggcgtgattgctggcatcaatgccagcctgcgggtgtccaggaagcccccatttgtggtgtccaggacagagggctacatcggcgtgctgattgatgacctgaccaccctgggcaccagcgagccctacaggatgttcaccagccgggtggagttccggctgagcctgcggccagacaatgctgacagccggctgaccctgcggggctacaaggatgctggctgtgtgtcccagcagagatatgaaagagcctgctggatgaagagcagcctggaggagggcatctctgtgctgaagagcattgagttcctgagcagcaagtggaagaagctgatccctgaggccagcatcagcaccagccgcagcctgcctgtgcgggccctggatgtgctgaagtatgaggaggtggacatggacagcctggccaaggctgtgcctgagcccctgaagaagtacaccaagtgccgggagctggccgagcggctgaagattgaggccacctatgaatctgtgctcttccaccagctgcaggagatcaagggcgtgcagcaggatgaggccctgcagctgcccaaggacctggactacctgaccatcagagatgtgtccctgagccatgaggtgcgggagaagctgcacttcagccggccccagaccatcggggccgccagccgcatccctggggtgaccccagctgccatcatcaacctgctgcgctttgtgaagaccacccagaggcggcagagcgccatgaatgaaagcagcaagacagaccagtacctgtgtgatgctgaccggctgcaggagcgggagctgtag

SEQ ID NO: 20498 - DNA, 2199 bp, Artificial Sequence
  Description of Artificial Sequence: Synthetic coding sequence
atgttctacttccggggctgcggccgctgggtggccgtgtccttcaccaagcagcagttccccctggcccggctgagcagtgacagcgctgcccccaggaccccccactttgatgtgattgtcatcggcggcggccatgctggaacagaagctgccacagctgctgcccgctgtggcagcaggaccctgctgctgacccaccgggtggacaccatcggccagatgagctgcaaccccagctttggaggcatcggcaagggccacctgatgagggaggtggatgccctggatggcctgtgcagccgcatctgtgaccagagcggcgtgcactacaaggtgctgaacagaaggaagggccctgctgtgtggggcctgcgggcccagattgacaggaagctgtacaagcagaacatgcagaaggagatcctgaacacccccctgctgactgtgcaggagggcgctgtggaggacctgatcctgacagagcctgagcctgagcacacaggcaagtgccgggtgtctggagtggtgctggtggatggcagcacagtgtatgcagagagcgtcatcctgaccaccggcaccttcctgcggggcatgattgtgattggcctggagacccaccctgctggccgcctgggggaccagcccagcatcggcctggcccagaccctggagaagctgggctttgtggtgggccgcctgaagacaggcaccccaccaagaattgccaaggagagcatcaacttcagcatcctgaacaagcacatcccagacaaccccagcatccccttctccttcaccaatgaaacagtgtggatcaagccagaggaccagctgccctgctacctgacccacaccaacccccgggtggatgagatcgtgctgaagaacctgcacctgaacagccacgtgaaggagaccacccggggcccccgctactgccccagcattgagagcaaggtgctgcgcttccccaaccggctgcaccaggtgtggctggagcctgagggcatggacagcgacctgatctacccccagggcctgtccatgaccctgcctgctgagctgcaggagaagatgatcacctgcatccggggcctggagaaggccaaggtgatccagcccggctacggcgtgcagtatgactacctggacccccggcagatcacccccagcctggagacccacctggtgcagaggctcttctttgctggccagatcaatggcaccaccggctatgaggaggccgccgcccagacagagtgctgcagcgtggcccggctggagtgcagcgacatgatcagccagctgcaggccatcctgctgccccagcccagcctggtggccggcacagctggcatgcaccacaacacccagggcgtgattgctggcatcaatgccagcctgcgggtgtccaggaagcccccatttgtggtgtccaggacagagggctacatcggcgtgctgattgatgacctgaccaccctgggcaccagcgagccctacaggatgttcaccagccgggtggagttccggctgagcctgcggccagacaatgctgacagccggctgaccctgcggggctacaaggatgctggctgtgtgtcccagcagagatatgagcgggcctgctggatgaagagcagcctggaggagggcatctctgtgctgaagagcattgagttcctgagcagcaagtggaagaagctgatccctgaggccagcatcagcaccagccgcagcctgcctgtgcgggccctggatgtgctgaagtatgaggaggtggacatggacagcctggccaaggctgtgcctgagcccctgaagaagtacaccaagtgccgggagctggccgagcggctgaagattgaggccacctatgagagcgtgctcttccaccagctgcaggagatcaagggcgtgcagcaggatgaggccctgcagctgcccaaggacctggactacctgaccatcagagatgtgtccctgagccatgaggtgcgggagaagctgcacttcagccggccccagaccatcggggccgccagccgcatccctggggtgaccccagctgccatcatcaacctgctgcgctttgtgaagaccacccagaggcggcagagcgccatgaatgaaagcagcaagacagaccagtacctgtgtgatgctgaccggctgcaggagcgggagctgtag

SEQ ID NO: 20499 - DNA, 2079 bp, Artificial Sequence
  Description of Artificial Sequence: Synthetic coding sequence
atgttctacttccggggctgcggccgctgggtggccgtgtccttcaccaagcagcagttccccctggcccggctgagcagtgacagcgctgcccccaggaccccccactttgatgtgattgtcatcggcggcggccatgctggaacagaagctgccacagctgctgcccgctgtggcagcaggaccctgctgctgacccaccgggtggacaccatcggccagatgagctgcaaccccagctttggaggcatcggcaagggccacctgatgagggaggtggatgccctggatggcctgtgcagccgcatctgtgaccagagcggcgtgcactacaaggtgctgaacagaaggaagggccctgctgtgtggggcctgcgggcccagattgacaggaagctgtacaagcagaacatgcagaaggagatcctgaacacccccctgctgactgtgcaggagggcgctgtggaggacctgatcctgacagagcctgagcctgagcacacaggcaagtgccgggtgtctggagtggtgctggtggatggcagcacagtgtatgcagagagcgtcatcctgaccaccggcaccttcctgcggggcatgattgtgattggcctggagacccaccctgctggccgcctgggggaccagcccagcatcggcctggcccagaccctggagaagctgggctttgtggtgggccgcctgaagacaggcaccccaccaagaattgccaaggagagcatcaacttcagcatcctgaacaagcacatcccagacaaccccagcatccccttctccttcaccaatgaaacagtgtggatcaagccagaggaccagctgccctgctacctgacccacaccaacccccgggtggatgagatcgtgctgaagaacctgcacctgaacagccacgtgaaggagaccacccggggcccccgctactgccccagcattgagagcaaggtgctgcgcttccccaaccggctgcaccaggtgtggctggagcctgagggcatggacagcgacctgatctacccccagggcctgtccatgaccctgcctgctgagctgcaggagaagatgatcacctgcatccggggcctggagaaggccaaggtgatccagcccggctacggcgtgcagtatgactacctggacccccggcagatcacccccagcctggagacccacctggtgcagaggctcttctttgctggccagatcaatggcaccaccggctatgaggaggccgccgcccagggcgtgattgctggcatcaatgccagcctgcgggtgtccaggaagcccccatttgtggtgtccaggacagagggctacatcggcgtgctgattgatgacctgaccaccctgggcaccagcgagccctacaggatgttcaccagccgggtggagttccggctgagcctgcggccagacaatgctgacagccggctgaccctgcggggctacaaggatgctggctgtgtgtcccagcagagatatgagcgggcctgctggatgaagagcagcctggaggagggcatctctgtgctgaagagcattgagttcctgagcagcaagtggaagaagctgatccctgaggccagcatcagcaccagccgcagcctgcctgtgcgggccctggatgtgctgaagtatgaggaggtggacatggacagcctggccaaggctgtgcctgagcccctgaagaagtacaccaagtgccgggagctggccgagcggctgaagattgaggccacctatgagagcgtgctcttccaccagctgcaggagatcaagggcgtgcagcaggatgaggccctgcagctgcccaaggacctggactacctgaccatcagagatgtgtccctgagccatgaggtgcgggagaagctgcacttcagccggccccagaccatcggggccgccagccgcatccctggggtgaccccagctgccatcatcaacctgctgcgctttgtgaagaccacccagaggcggcagagcgccatgaatgaaagcagcaagacagaccagtacctgtgtgatgctgaccggctgcaggagcgggagctgtag

SEQ ID NO: 20500 - DNA, 381 bp, Artificial Sequence
  Description of Artificial Sequence: Synthetic coding sequence
atgagcattggagtgcccatcaaggtgctgcatgaagctgagggccacatcgtgacctgtgagaccaacacaggagaggtgtaccggggcaagctgattgaagctgaggacaacatgaactgccagatgagcaacatcaccgtgacctacagagatggccgggtggcccagctggagcaggtgtacatccggggcagcaagatccgcttcctgatcctgcctgacatgctgaagaatgcccccatgctgaagtccatgaagaacaagaaccagggcagcggggccggccggggcaaggccgccatcctgaaggcccaggtggccgcccggggccggggccggggcatgggccggggcaacatcttccagaagagaagatag

SEQ ID NO: 20501 - DNA, 1083 bp, Artificial Sequence
  Description of Artificial Sequence: Synthetic coding sequence
atggctgctgctgctgctgctggagctggccctgagatggtgcggggccaggtgtttgatgtgggcccccgctacaccaacctgagctacatcggggagggcgcctacggcatggtgtgcagcgcctatgacaacgtgaacaaggtgcgggtggccatcaagaagatcagcccctttgagcaccagacctactgccagaggaccctgcgggagatcaagatcctgctgcgcttcagacatgagaacatcatcggcatcaatgacatcatccgggcccccaccatcgagcagatgaaggatgtgtacatcgtgcaggacctgatggagacagacctgtacaagctgctgaagacccagcacctgagcaatgaccacatctgctacttcctgtaccagatcctgcggggcctgaagtacatccacagcgccaacgtgctgcaccgggacctgaagcccagcaacctgctgctgaacaccacctgtgacctgaagatctgtgactttggcctggcccgggtggccgaccctgaccatgaccacacaggcttcctgacagaatatgtggccacccgctggtaccgggcccctgagatcatgctgaacagcaagggctacaccaagagcattgacatctggagcgtgggctgcatcctggccgagatgctgagcaaccggcccatcttccctgggaagcactacctggaccagctgaaccacatcctgggcatcctgggcagccccagccaggaggacctgaactgcatcatcaacctgaaggccaggaactacctgctgagcctgccccacaagaacaaggtgccctggaacagactcttccccaatgctgacagcaaggccctggacctgctggacaagatgctgaccttcaacccccacaagagaattgaggtggagcaggccctggcccacccctacctggagcagtactatgaccccagtgatgagcccatcgccgaggcccccttcaagtttgacatggagctggatgacctgcccaaggagaagctgaaggagctgatctttgaggagacagcccgcttccagcccggctaccgctcctag

SEQ ID NO: 20502 - DNA, 1047 bp, Artificial Sequence
  Description of Artificial Sequence: Synthetic coding sequence
atggtgcggggccaggtgtttgatgtgggcccccgctacaccaacctgagctacatcggggagggcgcctacggcatggtgtgcagcgcctatgacaacgtgaacaaggtgcgggtggccatcaagaagatcagcccctttgagcaccagacctactgccagaggaccctgcgggagatcaagatcctgctgcgcttcagacatgagaacatcatcggcatcaatgacatcatccgggcccccaccatcgagcagatgaaggatgtgtacatcgtgcaggacctgatggagacagacctgtacaagctgctgaagacccagcacctgagcaatgaccacatctgctacttcctgtaccagatcctgcggggcctgaagtacatccacagcgccaacgtgctgcaccgggacctgaagcccagcaacctgctgctgaacaccacctgtgacctgaagatctgtgactttggcctggcccgggtggccgaccctgaccatgaccacacaggcttcctgacagaatatgtggccacccgctggtaccgggcccctgagatcatgctgaacagcaagggctacaccaagagcattgacatctggagcgtgggctgcatcctggccgagatgctgagcaaccggcccatcttccctgggaagcactacctggaccagctgaaccacatcctgggcatcctgggcagccccagccaggaggacctgaactgcatcatcaacctgaaggccaggaactacctgctgagcctgccccacaagaacaaggtgccctggaacagactcttccccaatgctgacagcaaggccctggacctgctggacaagatgctgaccttcaacccccacaagagaattgaggtggagcaggccctggcccacccctacctggagcagtactatgaccccagtgatgagcccatcgccgaggcccccttcaagtttgacatggagctggatgacctgcccaaggagaagctgaaggagctgatctttgaggagacagcccgcttccagcccggctaccgctcctag

SEQ ID NO: 20503 - DNA, 951 bp, Artificial Sequence
  Description of Artificial Sequence: Synthetic coding sequence
atggctgctgctgctgctgctggagctggccctgagatggtgcggggccaggtgtttgatgtgggcccccgctacaccaacctgagctacatcggggagggcgcctacggcatggtgtgcagcgcctatgacaacgtgaacaaggtgcgggtggccatcaagaagatcagcccctttgagcaccagacctactgccagaggaccctgcgggagatcaagatcctgctgcgcttcagacatgagaacatcatcggcatcaatgacatcatccgggcccccaccatcgagcagatgaaggatgtgtacatcgtgcaggacctgatggagacagacctgtacaagctgctgaagacccagcacctgagcaatgaccacatctgctacttcctgtaccagatcctgcggggcctgaagtacatccacagcgccaacgtgctgcaccgggacctgaagcccagcaacctgctgctgaacaccacctgtgacctgaagatctgtgactttggcctggcccgggtggccgaccctgaccatgaccacacaggcttcctgacagaatatgtggccacccgctggtaccgggcccctgagatcatgctgaacagcaagggctacaccaagagcattgacatctggagcgtgggctgcatcctggccgagatgctgagcaaccggcccatcttccctgggaagcactacctggaccagctgaaccacatcctggccctggacctgctggacaagatgctgaccttcaacccccacaagagaattgaggtggagcaggccctggcccacccctacctggagcagtactatgaccccagtgatgagcccatcgccgaggcccccttcaagtttgacatggagctggatgacctgcccaaggagaagctgaaggagctgatctttgaggagacagcccgcttccagcccggctaccgctcctag

SEQ ID NO: 20504 - DNA, 1095 bp, Artificial Sequence
  Description of Artificial Sequence: Synthetic coding sequence
atgagcggcccccgggccggcttctaccggcaggagctgaacaagacagtgtgggaggtgccccagaggctgcagggcctgcggcctgtgggcagcggggcctacggctctgtgtgcagcgcctatgatgcccggctgcggcagaaggtggccgtgaagaagctgagccggcccttccagagcctcatccacgcccggaggacctaccgggagctgcggctgctgaagcacctgaagcatgaaaatgtcatcggcctgctggatgtgttcaccccagccaccagcattgaggacttcagcgaggtgtacctggtgaccaccctgatgggcgctgacctgaacaacatcgtgaagtgccaggccctgagtgatgagcacgtgcagttcctggtgtaccagctgctgcggggcctgaagtacatccacagcgctggcatcatccaccgggacctgaagcccagcaatgtggccgtgaatgaagactgtgagctgcgcatcctggactttggcctggcccggcaggctgatgaggagatgacaggctacgtggccacccgctggtaccgggcccctgagatcatgctgaactggatgcactacaaccagacagtggacatctggagcgtgggctgcatcatggccgagctgctgcagggcaaggccctcttccctggcagtgactacatcgaccagctgaagaggatcatggaggtggtgggcacccccagccctgaggtgctggccaagatcagcagcgagcacgcccggacctacatccagagcctgccccccatgccccagaaggacctgagcagcatcttccggggggccaaccccctggccatcgacctgctgggccgcatgctggtgctggacagcgaccagagggtgtctgctgctgaggccctggcccacgcctacttcagccagtaccatgaccctgaagatgagcctgaggccgagccctatgatgagagcgtggaggccaaggagaggaccctggaggagtggaaggagctgacctaccaggaggtgctgtccttcaagcccccagagccccccaagcccccaggcagcctggagattgagcagtag

SEQ ID NO: 20505 - DNA, 1095 bp, Artificial Sequence; identical to SEQ ID NO: 20504
  Description of Artificial Sequence: Synthetic coding sequence

SEQ ID NO: 20506 - DNA, 642 bp, Artificial Sequence
  Description of Artificial Sequence: Synthetic coding sequence
atgggcgctgacctgaacaacatcgtgaagtgccaggccctgagtgatgagcacgtgcagttcctggtgtaccagctgctgcggggcctgaagtacatccacagcgctggcatcatccaccgggacctgaagcccagcaatgtggccgtgaatgaagactgtgagctgcgcatcctggactttggcctggcccggcaggctgatgaggagatgacaggctacgtggccacccgctggtaccgggcccctgagatcatgctgaactggatgcactacaaccagacaggagctgggggccggccctggggagatgagggccagggcccccggctggccctggactggctgtgcatgcctggcctgcggggccaggcccggagccccaggatgtgggacccccacagcaaggtggccctgcagaggcccctggagcatgatggctgctggccacccctggccgtgcagctgtggaccagcccctgcctgggcggcctgggcatggccgaggagggcgtgtgccccagctggggcctggatgtgacagtgggcctgctggaggagggccggggcgtgggcaccctgatggaggtgcccagccccagccacagcggctacctggtgcggggcctgcaccacggctag

SEQ ID NO: 20507 - DNA, 1149 bp, Artificial Sequence
  Description of Artificial Sequence: Synthetic coding sequence
atggactttggcctggccctgctgctggccggcctgctgggcctgctgctgggccagagcctgcaggtgaagcccctgcaggtggagcccccagagcctgtggtggccgtggccctgggcgccagccggcagctgacctgccgcctggcctgtgccgacagaggagcctctgtgcagtggaggggcctggacaccagcctgggcgctgtgcagagcgacaccggccgctctgtgctgactgtgagaaatgccagcctgtctgctgctggcaccagggtgtgtgtgggcagctgtggcggccgcaccttccagcacacagtgcagctgctggtgtatgccttcccagaccagctgactgtgtccccagctgccctggtgcctggggaccctgaggtggcctgcacagcccacaaggtgacccctgtggaccccaatgccctgtccttcagcctgctggtgggcggccaggagctggagggcgcccaggccctgggccctgaggtgcaggaggaggaggaggagccccagggagatgaagatgtgctcttccgggtgacagagcgctggaggctgccccccctgggcacccctgtgcccccagccctgtactgccaggccaccatgaggctgcccggcctggagctgagccaccggcaggccatccctgtgctgcacagccccaccagccctgagcccccagacaccaccagccctgagagcccagacaccaccagccctgagagcccagacaccaccagccaggagcccccagacaccaccagccctgagcccccagacaagaccagccctgagcccgccccccagcagggcagcacccacacccccaggagccctggcagcaccaggaccaggaggcctgagatcagccaggccggccccacccagggcgaggtgatccccaccggcagcagcaagccagctggggaccagctgcctgctgccctgtggaccagcagcgctgtgctgggcctgctgctgctggccctgcccacctaccacctgtggaagcgctgccgccacctggccgaggatgacacccaccccccagccagcctgcggctgctgccccaggtgtctgcctgggccggcctgcggggcaccggccaggtgggcatcagccccagctag

SEQ ID NO: 20508 - DNA, 1074 bp, Artificial Sequence
  Description of Artificial Sequence: Synthetic coding sequence
atgagcagccccccaccagcccggagcggcttctaccggcaggaggtgaccaagacagcctgggaggtgcgggctgtgtacagagacctgcagcctgtgggcagcggggcctacggggctgtgtgcagcgctgtggatggccgcactggagccaaggtggccatcaagaagctgtaccggcccttccagagcgagctgtttgccaagagggcctaccgggagctgcggctgctgaagcacatgagacatgaaaatgtgattggcctgctggatgtgttcaccccagatgagaccctggatgacttcacagacttctacctggtgatgcccttcatgggcacagacctgggcaagctgatgaagcatgagaagctgggagaagatcgcatccagttcctggtgtaccagatgctgaagggcctgcgggacctgaagccaggcaacctggccgtgaatgaagactgtgagctgaagatcctggactttggcctggcccggcaggccgacagcgagatgacaggctacgtggtgacccgctggtaccgggcccctgaggtgatcctgaactggatgagatacacccagacagtggacatctggagcgtgggctgcatcatggccgagatgatcaccgggaagaccctcttcaagggcagtgaccacctggaccagctgaaggagatcatgaaggtgacaggcaccccacctgctgagtttgtgcagaggctgcagagtgatgaggccaagaactacatgaagggcctgcctgagctggagaagaaggactttgccagcatcctgaccaatgccagccccctggccgtgaacctgctggagaagatgctggtgctggatgctgagcagagggtgacagctggggaggccctggcccacccctactttgagagcctgcatgacacagaagatgagccccaggtgcagaagtatgatgacagctttgatgatgtggacaggaccctggatgagtggaagagggtgacctacaaggaggtgctgtccttcaagccaccccggcagctgggcgcccgggtgtccaaggagacccccctgtag

SEQ ID NO: 20509 - DNA, 837 bp, Artificial Sequence
  Description of Artificial Sequence: Synthetic coding sequence
atggccctgctgcctgtgctcttcctggtgacagtgctgctgcccagcctgcctgctgagggcaaggaccctgccttcaccgccctgctgaccacccagctgcaggtgcagcgggagatcgtgaacaagcacaatgagctgaggaaggctgtgtccccaccagccagcaacatgctgaagatggagtggagccgggaggtgaccaccaatgcccagcgctgggccaacaagtgcaccctgcagcacagcgaccctgaggacaggaagaccagcacccgctgtggggagaacctgtacatgagcagtgaccccacctcctggagcagcgccatccagagctggtatgatgagatcctggactttgtgtatggagtgggccccaagagccccaatgctgtggtgggccactacacccagctggtgtggtacagcacctaccaggtgggctgcggcatcgcctactgccccaaccaggacagcctgaagtactactacgtgtgccagtactgcccagccatgaagacctacctgaacaagcgggagggcatcaacgtgtggaagtgcttcctgcggctgcggcacttccagctgctgcggggggagcagctgctgaccttcagcggcaacaacatgaacaggaagaacaccccctaccagcagggcaccccctgtgccggctgcccagatgactgtgacaagggcctgtgcaccaacagctgccagtaccaggacctgctgagcaactgtgacagcctgaagaacacagctggctgtgagcacgagctgctgaaggagaagtgcaaggccacctgcctgtgtgagaacaagatctactag

SEQ ID NO: 20510 - DNA, 459 bp, Artificial Sequence
  Description of Artificial Sequence: Synthetic coding sequence
atgcagcatgaaaatgtgattggcctgctggatgtgttcaccccagccagcagcctgaggaacttctatgacttctacctggtgatgcccttcatgcagacagacctgcagaagatcatgggcatggagttcagcgaggagaagatccagtacctggtgtaccagatgctgaagggcctgaagtacatccacagcgctggggtggtgcaccgggacctgaagccaggcaacctggccgtgaatgaagactgtgagctgaagatcctggactttggcctggcccggcatgctgatgctgagatgacaggctacgtggtgacccgctggtaccgggcccctgaggtgatcctgtcctggatgcactacaaccagacaggccagatcctgcaccctgtgcctgccacagacccccaggagggcttccacagcgctgtgcccaccggccagcccccaggatag

SEQ ID NO: 20511 - DNA, 1068 bp, Artificial Sequence
  Description of Artificial Sequence: Synthetic coding sequence
atgagcctcatcaggaagaagggcttctacaagcaggatgtgaacaagacagcctgggagctgcccaagacctacgtgagccccacccacgtgggcagcggggcctacggctctgtgtgcagcgccatcgacaagaggtctggagagaaggtggccatcaagaagctgagccggcccttccagagcgagatctttgccaagagggcctaccgggagctgctgctgctgaagcacatgcagcatgaaaatgtgattggcctgctggatgtgttcaccccagccagcagcctgaggaacttctatgacttctacctggtgatgcccttcatgcagacagacctgcagaagatcatgggcatggagttcagcgaggagaagatccagtacctggtgtaccagatgctgaagggcctgaaggacctgaagccaggcaacctggccgtgaatgaagactgtgagctgaagatcctggactttggcctggcccggcatgctgatgctgagatgacaggctacgtggtgacccgctggtaccgggcccctgaggtgatcctgtcctggatgcactacaaccagacagtggacatctggagcgtgggctgcatcatggccgagatgctgaccgggaagaccctcttcaagggcaaggactacctggaccagctgacccagatcctgaaggtgactggagtgcccggcacagaatttgtgcagaagctgaatgacaaggccgccaagagctacatccagagcctgccccagacccccaggaaggacttcacccagctgttcccccgggccagcccccaggccgctgacctgctggagaagatgctggagctggatgtggacaagaggctgacagctgcccaggccctgacccaccccttctttgagcccttccgggaccctgaggaggagacagaggcccagcagccctttgatgacagcctggagcacgagaagctgactgtggatgagtggaagcagcacatctacaaggagatcgtgaacttcagccccatcgccaggaaggacagcagaagaagaagtggcatgaagctgtag

SEQ ID NO: 20512 - DNA, 774 bp, Artificial Sequence
  Description of Artificial Sequence: Synthetic coding sequence
atgagcctcatcaggaagaagggcttctacaagcaggatgtgaacaagacagcctgggagctgcccaagacctacgtgagccccacccacgtgggcagcggggcctacggctctgtgtgcagcgccatcgacaagaggtctggagagaaggtggccatcaagaagctgagccggcccttccagagcgagatctttgccaagagggcctaccgggagctgctgctgctgaagcacatgcagcatgaaaatgtgattggcctgctggatgtgttcaccccagccagcagcctgaggaacttctatgacttctacctggtgatgcccttcatgcagacagacctgcagaagatcatgggcatggagttcagcgaggagaagatccagtacctggtgtaccagatgctgaagggcctgaagtacatccacagcgctggggtggtgcaccgggacctgaagccaggcaacctggccgtgaatgaagactgtgagctgaagatcctggactttggcctggcccggcatgctgatgctgagatgacaggctacgtggtgacccgctggtaccgggcccctgaggtgatcctgtcctggatgcactacaaccagacaggccagatcctgcaccctgtgcctgccacagacccccaggagggcttccacagcgctgtgcccaccggccagcccccaggctgcggccctgctggggaggatgctggggcccggcggggccaggccccagatggccgggccggcccccaccccagcctgctgtag

SEQ ID NO: 20513 - DNA, 933 bp, Artificial Sequence
  Description of Artificial Sequence: Synthetic coding sequence
atgagcctcatcaggaagaagggcttctacaagcaggatgtgaacaagacagcctgggagctgcccaagacctacgtgagccccacccacgtgggcagcggggcctacggctctgtgtgcagcgccatcgacaagaggtctggagagaaggtggccatcaagaagctgagccggcccttccagagcgagatctttgccaagagggcctaccgggagctgctgctgctgaagcacatgcagcatgaaaatgtgattggcctgctggatgtgttcaccccagccagcagcctgaggaacttctatgacttctacctggtgatgcccttcatgcagacagacctgcagaagatcatgggcatggagttcagcgaggagaagatccagtacctggtgtaccagatgctgaagggcctgaagtacatccacagcgctggggtggtgcaccgggacctgaagccaggcaacctggccgtgaatgaagactgtgagctgaagatcctggactttggcctggcccggcatgctgatgctgagatgacaggctacgtggtgacccgctggtaccgggcccctgaggtgatcctgtcctggatgcactacaaccagacagtggacatctggagcgtgggctgcatcatggccgagatgctgaccgggaagaccctcttcaagggcaaggactacctgctggagaagatgctggagctggatgtggacaagaggctgacagctgcccaggccctgacccaccccttctttgagcccttccgggaccctgaggaggagacagaggcccagcagccctttgatgacagcctggagcacgagaagctgactgtggatgagtggaagcagcacatctacaaggagatcgtgaacttcagccccatcgccaggaaggacagcagaagaagaagtggcatgaagctgtag

SEQ ID NO: 20514 - DNA, 1629 bp, Artificial Sequence
  Description of Artificial Sequence: Synthetic coding sequence
atgcccctgagagatgagaccctgcgggaggtgtgggccagtgacagcggccacgaggaggagagcctgagccctgaggccccccggcggcccaagcagaggcctgccccagcccagaggctgaggaagaagaggacagaggcccctgagagcccctgccccaccggcagcaagcccaggaagccaggggccggccgcacaggccggccccgggaggagcccagcccagaccctgcccaggcccgggccccccagacagtgtatgcccgcttcctgcgggaccctgaggccaagaagagggacccccgggagaccttcctggtggcccgggccccagatgctgaagatgaggaggaggaggaggaggaggatgaggaggatgaggaggaggaggccgaggagaagaaggagaagatcctgctgccccccaagaagcccctgcgggagaagagcagcgctgacctgaaggagcggcgggccaaggcccagggccccaggggggacctgggcagcccagaccccccacccaagcccctgcgggtgaggaacaaggaggccccagctggggagggcaccaagatgaggaagaccaagaagaagggcagcggggaggccgacaaggaccccagcggcagccctgccagcgccaggaagagccctgctgccatgttcctggtgggggagggcagcccagacaagaaggccctgaagaagaagggcacccccaagggggccaggaaggaggaggaggaggaggaggaggccgccaccgtcatcaagaagagcaaccagaagggcaaggccaagggcaagggcaagaagaaggccaaggaggagcgggcccccagcccccctgtggaggtggatgagccccgggagtttgtgctgcggcctgccccccagggccgcacagtgcgctgccgcctgacccgggacaagaagggcatggaccggggcatgtaccccagctacttcctgcacctggacacagagaagaaggtgttcctgctggccggcaggaagaggaagaggagcaagacagccaactacctgatcagcattgaccccaccaacctgagccggggcggggagaacttcatcggcaagctgcggagcaacctgctgggcaaccgcttcaccgtgtttgacaatggccagaacccccagaggggctacagcaccaacgtggccagcctgcggcaggagctggccgctgtgatctatgagaccaacgtgctgggcttccggggccccaggaggatgaccgtcatcatccctggcatgtctgcagaaaatgaaagagtgcccatccggcccagaaatgccagtgatggcctgctggtgcgctggcagaacaagaccctggagagcctgattgagctgcacaacaagccccctgtgtggaatgatgacagcggcagctacaccctgaacttccagggccgggtgacccaggcctctgtgaagaacttccagatcgtgcatgctgatgatcctgactacatcgtgctgcagtttggccgggtggctgaagatgccttcaccctggactaccgctaccccctgtgtgccctgcaggcctttgccatcgccctgagcagctttgatggcaagctggcctgtgagtag

SEQ ID NO: 20515 - DNA, 1083 bp, Artificial Sequence
  Description of Artificial Sequence: Synthetic coding sequence
atgagccaggagcggcccaccttctaccggcaggagctgaacaagaccatctgggaggtgcctgagcgctaccagaacctgagccctgtgggcagcggggcctacggctctgtgtgtgccgcctttgacaccaagacaggcctgcgggtggccgtgaagaagctgagccggcccttccagagcatcatccacgccaagaggacctaccgggagctgcggctgctgaagcacatgaagcatgaaaatgtcatcggcctgctggatgtgttcaccccagcccggagcctggaggagttcaatgatgtgtacctggtgacccacctgatgggcgctgacctgaacaacatcgtgaagtgccagaagctgacagatgaccacgtgcagttcctgatctaccagatcctgcggggcctgaagtacatccacagcgctgacatcatccaccgggacctgaagcccagcaacctggccgtgaatgaagactgtgagctgaagatcctggactttggcctggcccggcacacagatgatgagatgacaggctacgtggccacccgctggtaccgggcccctgagatcatgctgaactggatgcactacaaccagacagtggacatctggagcgtgggctgcatcatggccgagctgctgaccggccgcaccctcttccctggaacagaccacatcgaccagctgaagctgatcctgcggctggtgggcaccccaggagctgagctgctgaagaagatcagcagcgagagcgccaggaactacatccagagcctgacccagatgcccaagatgaactttgccaacgtgttcatcggggccaaccccctggccgtggacctgctggagaagatgctggtgctggacagcgacaagaggatcacagctgcccaggccctggcccacgcctactttgcccagtaccatgaccctgatgatgagcctgtggccgacccctatgaccagagctttgagagccgggacctgctgattgatgagtggaagagcctgacctatgatgaagtcatcagctttgtgcccccacccctggaccaggaggagatggagagctag

SEQ ID NO: 20516 - DNA, 924 bp, Artificial Sequence
  Description of Artificial Sequence: Synthetic coding sequence
atgagccaggagcggcccaccttctaccggcaggagctgaacaagaccatctgggaggtgcctgagcgctaccagaacctgagccctgtgggcagcggggcctacggctctgtgtgtgccgcctttgacaccaagacaggcctgcgggtggccgtgaagaagctgagccggcccttccagagcatcatccacgccaagaggacctaccgggagctgcggctgctgaagcacatgaagcatgaaaatgtcatcggcctgctggatgtgttcaccccagcccggagcctggaggagttcaatgatgtgtacctggtgacccacctgatgggcgctgacctgaacaacatcgtgaagtgccagaagctgacagatgaccacgtgcagttcctgatctaccagatcctgcggggcctgaagtacatccacagcgctgacatcatccaccgggacctgaagcccagcaacctggccgtgaatgaagactgtgagctgaagatcctggactttggcctggcccggcacacagatgatgagatgacaggctacgtggccacccgctggtaccgggcccctgagatcatgctgaactggatgcactacaaccagacagtggacatctggagcgtgggctgcatcatggccgagctgctgaccggccgcaccctcttccctggaacagaccacatcgaccagctgaagctgatcctgcggctggtgggcaccccaggagctgagctgctgaagaagatcagcagcgagagcctgagcacctgctggaggcgctgcctgtactggacccagatccgggagctgcagaggcccaagcccctgcacatgcccaccctgctgagcaccaccatcctgatgatgaaccagtggcccatcctgatgatcagccccctgaaggccggcaccagcctgtag

SEQ ID NO: 20517 - DNA, 852 bp, Artificial Sequence
  Description of Artificial Sequence: Synthetic coding sequence
atgaagcatgaaaatgtgattggcctgctggatgtgttcaccccagcccggagcctggaggagttcaatgatgtgtacctggtgacccacctgatgggcgctgacctgaacaacatcgtgaagtgccagaagctgacagatgaccacgtgcagttcctgatctaccagatcctgcggggcctgaagtacatccacagcgctgacatcatccaccgggacctgaagcccagcaacctggccgtgaatgaagactgtgagctgaagatcctggactttggcctggcccggcacacagatgatgagatgacaggctacgtggccacccgctggtaccgggcccctgagatcatgctgaactggatgcactacaaccagacagtggacatctggagcgtgggctgcatcatggccgagctgctgactggaagaaccctcttccctggaacagaccacatcgaccagctgaagctgatcctgcggctggtgggcaccccaggagctgagctgctgaagaagatcagcagcgagagcgccaggaactacatccagagcctgacccagatgcccaagatgaactttgccaacgtgttcatcggggccaaccccctggccgtggacctgctggagaagatgctggtgctggacagcgacaagaggatcacagctgcccaggccctggcccacgcctactttgcccagtaccatgaccctgatgatgagcctgtggccgacccctatgaccagagctttgagagccgggacctgctgattgatgagtggaagagcctgacctatgatgaggtgatcagctttgtgcccccacccctggaccaggaggagatggagagctag

SEQ ID NO: 20518 - DNA, 1140 bp, Artificial Sequence
  Description of Artificial Sequence: Synthetic coding sequence
atggctgctgctgctgcccagggcggcggcggcggggagcccaggagaacagaaggagtgggccctggggtgcctggagaggtggagatggtgaagggccagccctttgatgtgggcccccgctacacccagctgcagtacatcggggagggcgcctacggcatggtgagcagcgcctatgaccacgtgaggaagaccagggtggccatcaagaagatcagcccctttgagcaccagacctactgccagaggaccctgcgggagatccagatcctgctgcgcttcagacatgaaaatgtgattggcatccgggacatcctgcgggccagcaccctggaggccatgagagatgtgtacatcgtgcaggacctgatggagacagacctgtacaagctgctgaagagccagcagctgagcaatgaccacatctgctacttcctgtaccagatcctgcggggcctgaagtacatccacagcgccaacgtgctgcaccgggacctgaagcccagcaacctgctgatcaacaccacctgtgacctgaagatctgtgactttggcctggccagaattgctgaccctgagcatgaccacacaggcttcctgacagaatatgtggccacccgctggtaccgggcccctgagatcatgctgaacagcaagggctacaccaagagcattgacatctggagcgtgggctgcatcctggccgagatgctgagcaaccggcccatcttccctgggaagcactacctggaccagctgaaccacatcctgggcatcctgggcagccccagccaggaggacctgaactgcatcatcaacatgaaggccaggaactacctgcagagcctgcccagcaagaccaaggtggcctgggccaagctgttccccaagagtgacagcaaggccctggacctgctggacaggatgctgaccttcaaccccaacaagaggatcaccgtggaggaggccctggcccacccctacctggagcagtactatgaccccacagatgagcctgtggccgaggagcccttcacctttgccatggagctggatgacctgcccaaggagcggctgaaggagctgatcttccaggagacagcccgcttccagcccggggtgctggaggccccctag

SEQ ID NO: 20519 - DNA, 1008 bp, Artificial Sequence
  Description of Artificial Sequence: Synthetic coding sequence
atggctgctgctgctgcccagggcggcggcggcggggagcccaggagaacagaaggagtgggccctggggtgcctggagaggtggagatggtgaagggccagccctttgatgtgggcccccgctacacccagctgcagtacatcggggagggcgcctacggcatggtgagcagcgcctatgaccacgtgaggaagaccagggtggccatcaagaagatcagcccctttgagcaccagacctactgccagaggaccctgcgggagatccagatcctgctgcgcttcagacatgaaaatgtgattggcatccgggacatcctgcgggccagcaccctggaggccatgagagatgtgtacatcgtgcaggacctgatggagacagacctgtacaagctgctgaagagccagcagctgagcaatgaccacatctgctacttcctgtaccagatcctgcggggcctgaagtacatccacagcgccaacgtgctgcaccgggacctgaagcccagcaacctgctgatcaacaccacctgtgacctgaagatctgtgactttggcctggccagaattgctgaccctgagcatgaccacacaggcttcctgacagaatatgtggccacccgctggtaccgggcccctgagatcatgctgaacagcaagggctacaccaagagcattgacatctggagcgtgggctgcatcctggccgagatgctgagcaaccggcccatcttccctgggaagcactacctggaccagctgaaccacatcctggccctggacctgctggacaggatgctgaccttcaaccccaacaagaggatcaccgtggaggaggccctggcccacccctacctggagcagtactatgaccccacagatgagcctgtggccgaggagcccttcacctttgccatggagctggatgacctgcccaaggagcggctgaaggagctgatcttccaggagacagcccgcttccagcccggggtgctggaggccccctag

SEQ ID NO: 20520 - DNA, 936 bp, Artificial Sequence
  Description of Artificial Sequence: Synthetic coding sequence
atggtgaagggccagccctttgatgtgggcccccgctacacccagctgcagtacatcggggagggcgcctacggcatggtgtcctctgcctatgaccacgtgaggaagaccagggtggccatcaagaagatcagcccctttgagcaccagacctactgccagaggaccctgcgggagatccagatcctgctgcgcttcagacatgaaaatgtcatcggcatccgggacatcctgcgggccagcaccctggaggccatgagagatgtgtacatcgtgcaggacctgatggagacagacctgtacaagctgctgaagagccagcagctgagcaatgaccacatctgctacttcctgtaccagatcctgcggggcctgaagtacatccacagcgccaacgtgctgcaccgggacctgaagcccagcaacctgctgatcaacaccacctgtgacctgaagggctacaccaagagcattgacatctggagcgtgggctgcatcctggccgagatgctgagcaaccggcccatcttccctgggaagcactacctggaccagctgaaccacatcctgggcatcctgggcagccccagccaggaggacctgaactgcatcatcaacatgaaggccaggaactacctgcagagcctgcccagcaagaccaaggtggcctgggccaagctgttccccaagagtgacagcaaggccctggacctgctggacaggatgctgaccttcaaccccaacaagaggatcaccgtggaggaggccctggcccacccctacctggagcagtactatgaccccacagatgagcctgtggccgaggagcccttcacctttgccatggagctggatgacctgcccaaggagcggctgaaggagctgatcttccaggagacagcccgcttccagcccggggtgctggaggccccctag

SEQ ID NO: 20521 - DNA, 1008 bp, Artificial Sequence; identical to SEQ ID NO: 20519
  Description of Artificial Sequence: Synthetic coding sequence

SEQ ID NO: 20522 - DNA, 1074 bp, Artificial Sequence
  Description of Artificial Sequence: Synthetic coding sequence
atggctgctgctgctgcccagggcggcggcggcggggagcccaggagaacagaaggagtgggccctggggtgcctggagaggtggagatggtgaagggccagccctttgatgtgggcccccgctacacccagctgcagtacatcggggagggcgcctacggcatggtgagcagcgcctatgaccacgtgaggaagaccagggtggccatcaagaagatcagcccctttgagcaccagacctactgccagaggaccctgcgggagatccagatcctgctgcgcttcagacatgaaaatgtgattggcatccgggacatcctgcgggccagcaccctggaggccatgagagatgtgtacatcgtgcaggacctgatggagacagacctgtacaagctgctgaagagccagcagctgagcaatgaccacatctgctacttcctgtaccagatcctgcggggcctgaagtacatccacagcgccaacgtgctgcaccgggacctgaagcccagcaacctgctgatcaacaccacctgtgacctgaagatctgtgactttggcctggccagaattgctgaccctgagcatgaccacacaggcttcctgacagaatatgtggccacccgctggtaccgggcccctgagatcatgctgaacagcaagggctacaccaagagcattgacatctggagcgtgggctgcatcctggccgagatgctgagcaaccggcccatcttccctgggaagcactacctggaccagctgaaccacatcctgggcatcctgggcagccccagccaggaggacctgaactgcatcatcaacatgaaggccaggaactacctgcagagcctgcccagcaagaccaaggtggcctgggccaagctgttccccaagagtgacagcaaggccctggacctgctggacaggatgctgaccttcaaccccaacaagaggatcaccgtggaggaggccctggcccacccctacctggagcagtactatgaccccacagatgaggtgggccagagccctgctgctgtgggcctgggcgctggggagcagggcggcacctag

SEQ ID NO: 20523 - DNA, 798 bp, Artificial Sequence
  Description of Artificial Sequence: Synthetic coding sequence
atgagagatgtgtacatcgtgcaggacctgatggagacagacctgtacaagctgctgaagagccagcagctgagcaatgaccacatctgctacttcctgtaccagatcctgcggggcctgaagtacatccacagcgccaacgtgctgcaccgggacctgaagcccagcaacctgctgatcaacaccacctgtgacctgaagatctgtgactttggcctggccagaattgctgaccctgagcatgaccacacaggcttcctgacagaatatgtggccacccgctggtaccgggcccctgagatcatgctgaacagcaagggctacaccaagagcattgacatctggagcgtgggctgcatcctggccgagatgctgagcaaccggcccatcttccctgggaagcactacctggaccagctgaaccacatcctgggcatcctgggcagccccagccaggaggacctgaactgcatcatcaacatgaaggccaggaactacctgcagagcctgcccagcaagaccaaggtggcctgggccaagctgttccccaagagtgacagcaaggccctggacctgctggacaggatgctgaccttcaaccccaacaagaggatcaccgtggaggaggccctggcccacccctacctggagcagtactatgaccccacagatgagcctgtggccgaggagcccttcacctttgccatggagctggatgacctgcccaaggagcggctgaaggagctgatcttccaggagacagcccgcttccagcccggggtgctggaggccccctag

SEQ ID NO: 20524 - DNA, 1284 bp, Artificial Sequence
  Description of Artificial Sequence: Synthetic coding sequence
atgagccgcagcaagagggacaacaacttctacagcgtggagattggagacagcaccttcaccgtgctgaagcgctaccagaacctgaagcccatcggcagcggggcccagggcatcgtgtgtgccgcctatgatgccatcctggagagaaatgtggccatcaagaagctgagccggcccttccagaaccagacccacgccaagagggcctaccgggagctggtgctgatgaagtgtgtgaaccacaagaacatcatcggcctgctgaatgtgttcaccccccagaagagcctggaggagttccaggatgtgtacatcgtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacctgtggagcgtgggctgcatcatgggagagatggtgtgccacaagatcctcttccctggccgggactacatcgaccagtggaacaaggtgattgagcagctgggcaccccctgcccagagttcatgaagaagctgcagcccaccgtgaggacctacgtggagaaccggcccaagtatgccggctacagctttgagaagctgttcccagatgtgctcttccctgctgacagcgagcacaacaagctgaaggccagccaggcccgggacctgctgagcaagatgctggtgattgatgccagcaagaggatctctgtggatgaggccctgcagcacccctacatcaacgtgtggtatgaccccagcgaggccgaggcccccccacccaagatcccagacaagcagctggatgagcgggagcacaccatcgaggagtggaaggagctgatctacaaggaggtgatggacctggaggagaggaccaagaatggagtcatccggggccagcccagccccctgggcgccgccgtcatcaatggcagccagcaccccagcagcagcagctctgtgaatgatgtgtcctccatgagcacagaccccaccctggccagtgacacagacagcagcctggaggccgccgccggccccctgggctgctgcaggtag

SEQ ID NO: 20525 - DNA, 657 bp, Artificial Sequence
  Description of Artificial Sequence: Synthetic coding sequence
atgagccgcagcaagagggacaacaacttctacagcgtggagattggagacagcaccttcaccgtgctgaagcgctaccagaacctgaagcccatcggcagcggggcccagggcatcgtgtgtgccgcctatgatgccatcctggagagaaatgtggccatcaagaagctgagccggcccttccagaaccagacccacgccaagagggcctaccgggagctggtgctgatgaagtgtgtgaaccacaagaacatcatcggcctgctgaatgtgttcaccccccagaagagcctggaggagttccaggatgtgtacatcgtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatggaggccgcatgggcaagggcatcttcacccggctgcagtag

SEQ ID NO: 20526 - DNA, 1284 bp, Artificial Sequence
  Description of Artificial Sequence: Synthetic coding sequence
atgagccgcagcaagagggacaacaacttctacagcgtggagattggagacagcaccttcaccgtgctgaagcgctaccagaacctgaagcccatcggcagcggggcccagggcatcgtgtgtgccgcctatgatgccatcctggagagaaatgtggccatcaagaagctgagccggcccttccagaaccagacccacgccaagagggcctaccgggagctggtgctgatgaagtgtgtgaaccacaagaacatcatcggcctgctgaatgtgttcaccccccagaagagcctggaggagttccaggatgtgtacatcgtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatctggagcgtgggctgcatcatgggagagatgatcaagggcggcgtgctcttccctggaacagaccacatcgaccagtggaacaaggtgattgagcagctgggcaccccctgcccagagttcatgaagaagctgcagcccaccgtgaggacctacgtggagaaccggcccaagtatgccggctacagctttgagaagctgttcccagatgtgctcttccctgctgacagcgagcacaacaagctgaaggccagccaggcccgggacctgctgagcaagatgctggtgattgatgccagcaagaggatctctgtggatgaggccctgcagcacccctacatcaacgtgtggtatgaccccagcgaggccgaggcccccccacccaagatcccagacaagcagctggatgagcgggagcacaccatcgaggagtggaaggagctgatctacaaggaggtgatggacctggaggagaggaccaagaatggagtcatccggggccagcccagccccctgggcgccgccgtcatcaatggcagccagcaccccagcagcagcagctctgtgaatgatgtgtcctccatgagcacagaccccaccctggccagtgacacagacagcagcctggaggccgccgccggccccctgggctgctgcaggtag

SEQ ID NO: 20527 - DNA, 1155 bp, Artificial Sequence
  Description of Artificial Sequence: Synthetic coding sequence
atgagccgcagcaagagggacaacaacttctacagcgtggagattggagacagcaccttcaccgtgctgaagcgctaccagaacctgaagcccatcggcagcggggcccagggcatcgtgtgtgccgcctatgatgccatcctggagagaaatgtggccatcaagaagctgagccggcccttccagaaccagacccacgccaagagggcctaccgggagctggtgctgatgaagtgtgtgaaccacaagaacatcatcggcctgctgaatgtgttcaccccccagaagagcctggaggagttccaggatgtgtacatcgtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatctggagcgtgggctgcatcatgggagagatgatcaagggcggcgtgctcttccctggaacagaccacatcgaccagtggaacaaggtgattgagcagctgggcaccccctgcccagagttcatgaagaagctgcagcccaccgtgaggacctacgtggagaaccggcccaagtatgccggctacagctttgagaagctgttcccagatgtgctcttccctgctgacagcgagcacaacaagctgaaggccagccaggcccgggacctgctgagcaagatgctggtgattgatgccagcaagaggatctctgtggatgaggccctgcagcacccctacatcaacgtgtggtatgaccccagcgaggccgaggcccccccacccaagatcccagacaagcagctggatgagcgggagcacaccatcgaggagtggaaggagctgatctacaaggaggtgatggacctggaggagaggaccaagaatggagtcatccggggccagcccagccccctggcccaggtgcagcagtag

SEQ ID NO: 20528 - DNA, 1155 bp, Artificial Sequence
  Description of Artificial Sequence: Synthetic coding sequence
atgagccgcagcaagagggacaacaacttctacagcgtggagattggagacagcaccttcaccgtgctgaagcgctaccagaacctgaagcccatcggcagcggggcccagggcatcgtgtgtgccgcctatgatgccatcctggagagaaatgtggccatcaagaagctgagccggcccttccagaaccagacccacgccaagagggcctaccgggagctggtgctgatgaagtgtgtgaaccacaagaacatcatcggcctgctgaatgtgttcaccccccagaagagcctggaggagttccaggatgtgtacatcgtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacctgtggagcgtgggctgcatcatgggagagatggtgtgccacaagatcctcttccctggccgggactacatcgaccagtggaacaaggtgattgagcagctgggcaccccctgcccagagttcatgaagaagctgcagcccaccgtgaggacctacgtggagaaccggcccaagtatgccggctacagctttgagaagctgttcccagatgtgctcttccctgctgacagcgagcacaacaagctgaaggccagccaggcccgggacctgctgagcaagatgctggtgattgatgccagcaagaggatctctgtggatgaggccctgcagcacccctacatcaacgtgtggtatgaccccagcgaggccgaggcccccccacccaagatcccagacaagcagctggatgagcgggagcacaccatcgaggagtggaaggagctgatctacaaggaggtgatggacctggaggagaggaccaagaatggagtcatccggggccagcccagccccctggcccaggtgcagcagtag

SEQ ID NO: 20529 - DNA, 1284 bp, Artificial Sequence; identical to SEQ ID NO: 20524
  Description of Artificial Sequence: Synthetic coding sequence

SEQ ID NO: 20530 - DNA, 927 bp, Artificial Sequence
  Description of Artificial Sequence: Synthetic coding sequence
atgagccgcagcaagagggacaacaacttctacagcgtggagattggagacagcaccttcaccgtgctgaagcgctaccagaacctgaagcccatcggcagcggggcccagggcatcgtgtgtgccgcctatgatgccatcctggagagaaatgtggccatcaagaagctgagccggcccttccagaaccagacccacgccaagagggcctaccgggagctggtgctgatgaagtgtgtgaaccacaagaacatcatcggcctgctgaatgtgttcaccccccagaagagcctggaggagttccaggatgtgtacatcgtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgctgacagcgagcacaacaagctgaaggccagccaggcccgggacctgctgagcaagatgctggtgattgatgccagcaagaggatctctgtggatgaggccctgcagcacccctacatcaacgtgtggtatgaccccagcgaggccgaggcccccccacccaagatcccagacaagcagctggatgagcgggagcacaccatcgaggagtggaaggagctgatctacaaggaggtgatggacctggaggagaggaccaagaatggagtcatccggggccagcccagccccctggcccaggtgcagcagtag

SEQ ID NO: 20531 - DNA, 429 bp, Artificial Sequence
  Description of Artificial Sequence: Synthetic coding sequence
atgagccgcagcaagagggacaacaacttctacagcgtggagattggagacagcaccttcaccgtgctgaagcgctaccagaacctgaagcccatcggcagcggggcccagggcatcgtgtgtgccgcctatgatgccatcctggagagaaatgtggccatcaagaagctgagccggcccttccagaaccagacccacgccaagagggcctaccgggagctggtgctgatgaagtgtgtgaaccacaagaacatcatcggcctgctgaatgtgttcaccccccagaagagcctggaggagttccaggatgtgtacatcgtgatggagctgatggatgccaacctgtgccaggtgatccagatggagctggaccacgagaggatgagctacctgctgtaccagatgctgtgtggcatcaagcacctgtag

SEQ ID NO: 20532 - DNA, 294 bp, Artificial Sequence
  Description of Artificial Sequence: Synthetic coding sequence
atgatcatcggcctgctgaatgtgttcaccccccagaagagcctggaggagttccaggatgtgtacatcgtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttctag

SEQ ID NO: 20533 - DNA, 429 bp, Artificial Sequence; identical to SEQ ID NO: 20531
  Description of Artificial Sequence: Synthetic coding sequence

SEQ ID NO: 20534 - DNA, 1182 bp, Artificial Sequence
  Description of Artificial Sequence: Synthetic coding sequence
atgcccaagaagaagcccacccccatccagctgaacccagccccagatggcagcgctgtgaatggcaccagcagcgctgagaccaacctggaggccctgcagaagaagctggaggagctggagctggatgagcagcagaggaagaggctggaggccttcctgacccagaagcagaaggtgggggagctgaaggatgatgactttgagaagatcagcgagctgggcgctggaaatggaggagtggtgttcaaggtgagccacaagcccagcggcctggtgatggccaggaagctgatccacctggagatcaagccagccatccggaaccagatcatccgggagctgcaggtgctgcacgagtgcaacagcccctacatcgtgggcttctacggggccttctacagtgatggagagatcagcatctgcatggagcacatggatggcggcagcctggaccaggtgctgaagaaggccggccgcatccctgagcagatcctgggcaaggtgtccattgctgtgatcaagggcctgacctacctgcgggagaagcacaagatcatgcacagagatgtgaagcccagcaacatcctggtgaacagcagaggagagatcaagctgtgtgactttggagtgtctggccagctgattgacagcatggccaacagctttgtgggcaccaggagctacatgagccctgagcggctgcagggcacccactacagcgtgcagagcgacatctggagcatgggcctgagcctggtggagatggctgtgggccgctaccccatccccccaccagatgccaaggagctggagctgatgtttggctgccaggtggagggagatgctgctgagaccccaccccggcccaggaccccaggccggcccctgagcagctatggcatggacagccggccccccatggccatctttgagctgctggactacatcgtgaatgaacctccacccaagctgcccagcggggtcttcagcctggagttccaggactttgtgaacaagtgcctgatcaagaacccagctgagagagctgacctgaagcagctgatggtgcacgccttcatcaagagaagtgatgctgaggaggtggactttgctggctggctgtgcagcaccatcggcctgaaccagcccagcacccccacccacgccgccggcgtgtag

SEQ ID NO: 20535 - DNA, 1203 bp, Artificial Sequence
  Description of Artificial Sequence: Synthetic coding sequence
atgctggcccggaggaagcctgtgctgcctgccctgaccatcaaccccaccatcgccgagggccccagccccaccagcgagggcgccagcgaggccaacctggtggacctgcagaagaagctggaggagctggagctggatgagcagcagaagaagaggctggaggccttcctgacccagaaggccaaggtgggggagctgaaggatgatgactttgagcgcatcagcgagctgggcgctggaaatggaggagtggtgaccaaggtgcagcaccggcccagcggcctcatcatggccaggaagctgatccacctggagatcaagccagccatccggaaccagatcatccgggagctgcaggtgctgcacgagtgcaacagcccctacatcgtgggcttctacggggccttctacagtgatggagagatcagcatctgcatggagcacatggatggcggcagcctggaccaggtgctgaaggaggccaagagaattcctgaggagatcctgggcaaggtgtccattgctgtgctgcggggcctggcctacctgcgggagaagcaccagatcatgcacagagatgtgaagcccagcaacatcctggtgaacagcagaggagagatcaagctgtgtgactttggagtgtctggccagctgattgacagcatggccaacagctttgtgggcaccaggagctacatggcccctgagcggctgcagggcacccactacagcgtgcagagcgacatctggagcatgggcctgagcctggtggagctggccgtgggccgctaccccatccccccaccagatgccaaggagctggaggccatcttcggccggcctgtggtggatggagaggagggggagccccacagcatcagcccccggccccggcccccaggccggcctgtgtctggccacggcatggacagcaggcctgccatggccatctttgagctgctggactacatcgtgaatgaacctccacccaagctgcccaatggagtcttcaccccagacttccaggagtttgtgaacaagtgcctgatcaagaacccagctgagagagctgacctgaagatgctgaccaaccacaccttcatcaagaggtctgaggtggaggaggtggactttgctggctggctgtgcaagaccctgcggctgaaccagcccggcacccccaccaggacagctgtgtag

SEQ ID NO: 20536 - DNA, 1056 bp, Artificial Sequence
  Description of Artificial Sequence: Synthetic coding sequence
atgggcgtgcagggcaccctgatgagccgggaccagaccccccacctgctgagcatcctgggcaagagcaagaggaagaaggacctgcgcatcagctgcatgagcaagcccccagcccccaaccccaccccacccaggaacctggacagcaggaccttcatcaccatcggggacaggaactttgaggtggaggctgatgacctggtgaccatcagcgagctgggccgcggggcctatggagtggtggagaaggtgagacatgcccagagcggcaccatcatggctgtgaagaggatccgggccaccgtgaacagccaggagcagaagaggctgctgatggacctggacatcaacatgaggacagtggactgcttctacacagtgaccttctatggagccctcttccgggagggagatgtgtggatctgcatggagctgatggacaccagcctggacaagttctacaggaaggtgctggacaagaacatgaccatccctgaggacatcctgggggagattgctgtgtccatcgtgcgggccctggagcacctgcacagcaagctgagcgtcatccacagagatgtgaagcccagcaatgtgctgatcaacaaggagggccacgtgaagatgtgtgactttggcatcagcggctacctggtggacagcgtggccaagaccatggatgctggctgcaagccctacatggcccctgagcgcatcaaccctgagctgaaccagaagggctacaacgtgaagagtgatgtgtggagcctgggcatcaccatgattgagatggccatcctgcgcttcccctatgagagctggggcacccccttccagcagctgaagcaggtggtggaggagcccagcccccagctgcctgctgaccgcttcagccctgagtttgtggacttcaccgcccagtgcctgaggaagaacccagctgagaggatgagctacctggagctgatggagcaccccttcttcaccctgcacaagaccaagaagacagacattgctgcctttgtgaaggagatcctgggggaggacagctag

SEQ ID NO: 20537 - DNA, 1044 bp, Artificial Sequence
  Description of Artificial Sequence: Synthetic coding sequence
atggagagccctgccagcagccagcctgcctccatgccccagagcaagggcaagagcaagaggaagaaggacctgcgcatcagctgcatgagcaagcccccagcccccaaccccaccccacccaggaacctggacagcaggaccttcatcaccatcggggacaggaactttgaggtggaggctgatgacctggtgaccatcagcgagctgggccgcggggcctatggagtggtggagaaggtgagacatgcccagagcggcaccatcatggctgtgaagaggatccgggccaccgtgaacagccaggagcagaagaggctgctgatggacctggacatcaacatgaggacagtggactgcttctacacagtgaccttctatggagccctcttccgggagggagatgtgtggatctgcatggagctgatggacaccagcctggacaagttctacaggaaggtgctggacaagaacatgaccatccctgaggacatcctgggggagattgctgtgtccatcgtgcgggccctggagcacctgcacagcaagctgagcgtcatccacagagatgtgaagcccagcaatgtgctgatcaacaaggagggccacgtgaagatgtgtgactttggcatcagcggctacctggtggacagcgtggccaagaccatggatgctggctgcaagccctacatggcccctgagcgcatcaaccctgagctgaaccagaagggctacaacgtgaagagtgatgtgtggagcctgggcatcaccatgattgagatggccatcctgcgcttcccctatgagagctggggcacccccttccagcagctgaagcaggtggtggaggagcccagcccccagctgcctgctgaccgcttcagccctgagtttgtggacttcaccgcccagtgcctgaggaagaacccagctgagaggatgagctacctggagctgatggagcaccccttcttcaccctgcacaagaccaagaagacagacattgctgcctttgtgaaggagatcctgggggaggacagctag

SEQ ID NO: 20538 - DNA, 957 bp, Artificial Sequence
  Description of Artificial Sequence: Synthetic coding sequence
atgagcaagcccccagcccccaaccccaccccaccaagaaacctggacagcaggaccttcatcaccatcggggacaggaactttgaggtggaggctgatgacctggtgaccatcagcgagctgggccgcggggcctacggcgtggtggagaaggtgagacatgcccagagcggcaccatcatggctgtgaagaggatccgggccaccgtgaacagccaggagcagaagaggctgctgatggacctggacatcaacatgaggacagtggactgcttctacacagtgaccttctacggggccctcttccgggagggagatgtgtggatctgcatggagctgatggacaccagcctggacaagttctacaggaaggtgctggacaagaacatgaccatccctgaggacatcctgggggagattgctgtgtccatcgtgcgggccctggagcacctgcacagcaagctgagcgtcatccacagagatgtgaagcccagcaatgtgctgatcaacaaggagggccacgtgaagatgtgtgactttggcatcagcggctacctggtggacagcgtggccaagaccatggatgctggctgcaagccctacatggcccctgagcgcatcaaccctgagctgaaccagaagggctacaacgtgaagagtgatgtgtggagcctgggcatcaccatgattgagatggccatcctgcgcttcccctatgaatcctggggcacccccttccagcagctgaagcaggtggtggaggagcccagcccccagctgcctgctgaccgcttcagccctgagtttgtggacttcaccgcccagtgcctgaggaagaacccagctgagaggatgagctacctggagctgatggagcaccccttcttcaccctgcacaagaccaagaagacagacattgctgcctttgtgaaggagatcctgggggaggacagctag

SEQ ID NO: 20539 - DNA, 1113 bp, Artificial Sequence
  Description of Artificial Sequence: Synthetic coding sequence
atgctgagcaacagccagggccagagcccccctgtgcccttccctgccccagcccccccaccccagccccccaccccagccctgccccaccccccagcccagcccccacctcctccaccccagcagttcccccagttccacgtgaagagcggcctgcagatcaagaagaatgccatcattgatgactacaaggtgaccagccaggtgctgggcctgggcatcaatggcaaggtgctgcagatcttcaacaagaggacccaggagaagtttgccctgaagatgctgcaggactgccccaaggcccggcgggaggtggagctgcactggagggccagccagtgcccccacatcgtgcgcatcgtggatgtgtatgagaacctgtatgccggcaggaagtgcctgctgattgtgatggagtgcctggatggaggagagctgttcagccgcatccaggacagaggagaccaggccttcacagagcgggaggccagcgagatcatgaagagcatcggggaggccatccagtacctgcacagcatcaacatcgcccacagagatgtgaagccagagaacctgctgtacaccagcaagaggcccaatgccatcctgaagctgacagactttggatttgccaaggagaccaccagccacaacagcctgaccaccccctgctacaccccctactacgtggcccctgaggtgctgggccctgagaagtatgacaagagctgtgacatgtggagcctgggcgtcatcatgtacatcctgctgtgtggctacccacccttctacagcaaccacggcctggccatcagccctggcatgaagacccgcatccgcatgggccagtatgagttccccaaccctgagtggagcgaggtgtctgaggaggtgaagatgctgatccggaacctgctgaagacagagcccacccagaggatgaccatcacagagttcatgaaccacccctggatcatgcagagcaccaaggtgccccagacccccctgcacaccagccgggtgctgaaggaggacaaggagcgctgggaggatgtgaagggctgcctgcatgacaagaacagcgaccaggccacctggctgacccggctgtag

SEQ ID NO: 20540 - DNA, 1203 bp, Artificial Sequence
  Description of Artificial Sequence: Synthetic coding sequence
atgctgagcaacagccagggccagagcccccctgtgcccttccctgccccagcccccccaccccagccccccaccccagccctgccccaccccccagcccagcccccacctcctccaccccagcagttcccccagttccacgtgaagagcggcctgcagatcaagaagaatgccatcattgatgactacaaggtgaccagccaggtgctgggcctgggcatcaatggcaaggtgctgcagatcttcaacaagaggacccaggagaagtttgccctgaagatgctgcaggactgccccaaggcccggcgggaggtggagctgcactggagggccagccagtgcccccacatcgtgcgcatcgtggatgtgtatgagaacctgtatgccggcaggaagtgcctgctgattgtgatggagtgcctggatggaggagagctgttcagccgcatccaggacagaggagaccaggccttcacagagcgggaggccagcgagatcatgaagagcatcggggaggccatccagtacctgcacagcatcaacatcgcccacagagatgtgaagccagagaacctgctgtacaccagcaagaggcccaatgccatcctgaagctgacagactttggatttgccaaggagaccaccagccacaacagcctgaccaccccctgctacaccccctactacgtggcccctgaggtgctgggccctgagaagtatgacaagagctgtgacatgtggagcctgggcgtcatcatgtacatcctgctgtgtggctacccacccttctacagcaaccacggcctggccatcagccctggcatgaagacccgcatccgcatgggccagtatgagttccccaaccctgagtggagcgaggtgtctgaggaggtgaagatgctgatccggaacctgctgaagacagagcccacccagaggatgaccatcacagagttcatgaaccacccctggatcatgcagagcaccaaggtgccccagacccccctgcacaccagccgggtgctgaaggaggacaaggagcgctgggaggatgtgaaggaggagatgaccagcgccctggccaccatgagggtggactatgagcagatcaagatcaagaagattgaagatgccagcaaccccctgctgctgaagaggaggaagaaggcccgggccctggaggccgccgccctggcccactag

SEQ ID NO: 20541 - DNA, 1149 bp, Artificial Sequence
  Description of Artificial Sequence: Synthetic coding sequence
atggatggagaaacagctgaggagcagggcggccctgtgcccccacctgtggcccctgggggccctggcctgggcggggcccctgggggcagaagagagcccaagaagtatgctgtgacagatgactaccagctgagcaagcaggtgctgggcctgggcgtgaatggcaaggtgctggagtgcttccacagaagaacaggccagaagtgtgccctgaagctgctgtatgacagccccaaggcccggcaggaggtggaccaccactggcaggccagcggcggcccccacatcgtgtgcatcctggatgtgtatgagaacatgcaccacggcaagcgctgcctgctgatcatcatggagtgcatggagggcggggagctgttcagccgcatccaggagcggggggaccaggccttcacagagcgggaggccgctgagatcatgagggacatcggcacagccatccagttcctgcacagccacaacatcgcccacagagatgtgaagccagagaacctgctgtacaccagcaaggagaaggatgctgtgctgaagctgacagactttggatttgccaaggagaccacccagaatgccctgcagaccccctgctacaccccctactacgtggcccctgaggtgctgggccctgagaagtatgacaagagctgtgacatgtggagcctgggcgtcatcatgtacatcctgctgtgtggcttcccccccttctacagcaacacaggccaggccatcagccctggcatgaagaggcgcatccggctgggccagtatggcttccccaaccctgagtggagcgaggtgtctgaagatgccaagcagctgatccggctgctgctgaagacagaccccacagagcggctgaccatcacccagttcatgaaccacccctggatcaaccagagcatggtggtgccccagacccccctgcacacagcccgggtgctgcaggaggacaaggaccactgggatgaggtgaaggaggagatgaccagcgccctggccaccatgagggtggactatgaccaggtgaagatcaaggacctgaagaccagcaacaaccggctgctgaacaagaggaggaagaagcaggccggcagcagcagcgccagccagggctgcaacaaccagtag

SEQ ID NO: 20542 - DNA, 999 bp, Artificial Sequence
  Description of Artificial Sequence: Synthetic coding sequence
atggatggagaaacagctgaggagcagggcggccctgtgcccccacctgtggcccctgggggccctggcctgggcggggcccctgggggcagaagagagcccaagaagtatgctgtgacagatgactaccagctgagcaagcaggtgctgggcctgggcgtgaatggcaaggtgctggagtgcttccacagaagaacaggccagaagtgtgccctgaagctgctgtatgacagccccaaggcccggcaggaggtggaccaccactggcaggccagcggcggcccccacatcgtgtgcatcctggatgtgtatgagaacatgcaccacggcaagcgctgcctgctgatcatcatggagtgcatggagggcggggagctgttcagccgcatccaggagcggggggaccaggccttcacagagcgggaggccgctgagatcatgagggacatcggcacagccatccagttcctgcacagccacaacatcgcccacagagatgtgaagccagagaacctgctgtacaccagcaaggagaaggatgctgtgctgaagctgacagactttggatttgccaaggagaccacccagaatgccctgcagaccccctgctacaccccctactacgtggcccctgaggtgctgggccctgagaagtatgacaagagctgtgacatgtggagcctgggcgtcatcatgtacatcctgctgtgtggcttcccccccttctacagcaacacaggccaggccatcagccctggcatgaagaggcgcatccggctgggccagtatggcttccccaaccctgagtggagcgaggtgtctgaagatgccaagcagctgatccggctgctgctgaagacagaccccacagagcggctgaccatcacccagttcatgaaccacccctggatcaaccagagcatggtggtgccccagacccccctgcacacagcccgggtgctgcaggaggacaaggaccactgggatgaggtgaagtag

SEQ ID NO: 20543 - DNA, 1149 bp, Artificial Sequence; identical to SEQ ID NO: 20541
  Description of Artificial Sequence: Synthetic coding sequence

SEQ ID NO: 20544 - DNA, 360 bp, Artificial Sequence
  Description of Artificial Sequence: Synthetic coding sequence
atggatggagaaacagctgaggagcagggcggccctgtgcccccacctgtggcccctgggggccctggcctgggcggggcccctgggggcagaagagagcccaagaagtatgctgtgacagatgactaccagctgagcaagcaggtgctgggcctgggcgtgaatggcaaggtgctggagtgcttccacagaagaacaggccagaagtgtgccctgaagctgctgtatgacagccccaaggcccggcaggaggtggaccaccactggcaggccagcggcggcccccacatcgtgtgcatcctggatgtgtatgagaacatgcaccacggcaagcgctgcctgctgatcatcatggagtag

SEQ ID NO: 20545 - DNA, 1422 bp, Artificial Sequence
  Description of Artificial Sequence: Synthetic coding sequence
atgtctgaggagagtgacatggacaaggccatcaaggagaccagcatcctggaggagtacagcatcaactggacccagaagctgggcgccggcatcagcggccctgtgcgggtgtgtgtgaagaagagcacccaggagagatttgccctgaagatcctgctggaccggcccaaggccagaaatgaggtgcggctgcacatgatgtgtgccacccaccccaacatcgtgcagatcatcgaggtgtttgccaacagcgtgcagttcccccatgagagcagcccccgggcccggctgctgattgtgatggagatgatggagggcggggagctgttccaccgcatcagccagcaccgccacttcacagagaagcaggccagccaggtgaccaagcagatcgccctggccctgcggcactgccacctgctgaacatcgcccaccgggacctgaagccagagaacctgctcttcaaggacaacagcctggatgcccctgtgaagctgtgtgactttggatttgccaagattgaccagggcgacctgatgaccccccagttcaccccctactacgtggccccccaggtgctggaggcccagaggaggcaccagaaggagaagagcggcatcatccccaccagccccaccccctacacctacaacaagagctgtgacctgtggagcctgggcgtcatcatctacgtgatgctgtgtggctacccacccttctacagcaagcaccacagcaggaccatccccaaggacatgaggaggaagatcatgacaggcagctttgagttccctgaggaggagtggagccagatcagcgagatggccaaggatgtggtgaggaagctgctgaaggtgaagccagaggagcggctgaccattgaaggagtgctggaccacccctggctgaacagcacagaggccctggacaacgtgctgcccagcgcccagctgatgatggacaaggctgtggtggccggcatccagcaggcccacgccgagcagctggccaacatgaggatccaggacctgaaggtgtccctgaagcccctgcacagcgtgaacaaccccatcctgaggaagaggaagctgctgggcaccaagcccaaggacagcgtgtacatccatgaccatgaaaatggagctgaggacagcaatgtggccctggagaagctgagagatgtgattgcccagtgcatcctgccccaggccgggaaaggagaaaatgaagatgagaagctgaatgaggtgatgcaggaggcctggaagtacaaccgggagtgcaagctgctgcgggacaccctgcagagcttctcctggaatggccggggcttcacagacaaggtggaccggctgaagctggccgagatcgtgaagcaggtgattgaggagcagaccaccagccatgagagccagtag

SEQ ID NO: 20546 - DNA, 1416 bp, Artificial Sequence
  Description of Artificial Sequence: Synthetic coding sequence
atgtctgaggagagtgacatggacaaggccatcaaggagaccagcatcctggaggagtacagcatcaactggacccagaagctgggcgccggcatcagcggccctgtgcgggtgtgtgtgaagaagagcacccaggagagatttgccctgaagatcctgctggaccggcccaaggccagaaatgaggtgcggctgcacatgatgtgtgccacccaccccaacatcgtgcagatcatcgaggtgtttgccaacagcgtgcagttcccccatgagagcagcccccgggcccggctgctgattgtgatggagatgatggagggcggggagctgttccaccgcatcagccagcaccgccacttcacagagaagcaggccagccaggtgaccaagcagatcgccctggccctgcggcactgccacctgctgaacatcgcccaccgggacctgaagccagagaacctgctcttcaaggacaacagcctggatgcccctgtgaagctgtgtgactttggatttgccaagattgaccagggcgacctgatgaccccccagttcaccccctactacgtggccccccaggtgctggaggcccagaggaggcaccagaaggagaagagcggcatcatccccaccagccccaccccctacacctacaacaagagctgtgacctgtggagcctgggcgtcatcatctacgtgatgctgtgtggctacccacccttctacagcaagcaccacagcaggaccatccccaaggacatgaggaggaagatcatgacaggcagctttgagttccctgaggaggagtggagccagatcagcgagatggccaaggatgtggtgaggaagctgctgaaggtgaagccagaggagcggctgaccattgaaggagtgctggaccacccctggctgaacagcacagaggccctggacaacgtgctgcccagcgcccagctgatgatggacaaggctgtggtggccggcatccagcaggcccacgccgagcagctggccaacatgaggatccaggacctgaaggtgtccctgaagcccctgcacagcgtgaacaaccccatcctgaggaagaggaagctgctgggcaccaagcccaaggacagcgtgtacatccatgaccatgaaaatggagctgaggacagcaatgtggccctggagaagctgagagatgtgattgcccagtgcatcctgccccaggccggagaaaatgaagatgagaagctgaatgaggtgatgcaggaggcctggaagtacaaccgggagtgcaagctgctgcgggacaccctgcagagcttctcctggaatggccggggcttcacagacaaggtggaccggctgaagctggccgagatcgtgaagcaggtgattgaggagcagaccaccagccatgagagccagtag

SEQ ID NO: 20547 - DNA, 1416 bp, Artificial Sequence
  Description of Artificial Sequence: Synthetic coding sequence
atgtctgaggagagtgacatggacaaggccatcaaggagaccagcatcctggaggagtacagcatcaactggacccagaagctgggcgccggcatcagcggccctgtgcgggtgtgtgtgaagaagagcacccaggagagatttgccctgaagatcctgctggaccggcccaaggccagaaatgaggtgcggctgcacatgatgtgtgccacccaccccaacatcgtgcagatcatcgaggtgtttgccaacagcgtgcagttcccccatgagagcagcccccgggcccggctgctgattgtgatggagatgatggagggcggggagctgttccaccgcatcagccagcaccgccacttcacagagaagcaggccagccaggtgaccaagcaggccaccctggccctgcggcactgccacctgctgaacatcgcccaccgggacctgaagccagagaacctgctcttcaaggacaacagcctggatgcccctgtgaagctgtgtgactttggatttgccaagattgaccagggcgacctgatgaccccccagttcaccccctactacgtggccccccaggtgctggaggcccagaggaggcaccagaaggagaagagcggcatcatccccaccagccccaccccctacacctacaacaagagctgtgacctgtggagcctgggcgtcatcatctacgtgatgctgtgtggctacccacccttctacagcaagcaccacagcaggaccatccccaaggacatgaggaggaagatcatgacaggcagctttgagttccctgaggaggagtggagccagatcagcgagatggccaaggatgtggtgaggaagctgctgaaggtgaagccagaggagcggctgaccattgaaggagtgctggaccacccctggctgaacagcacagaggccctggacaacgtgctgcccagcgcccagctgatgatggacaaggctgtggtggccggcatccagcaggcccacgccgagcagctggccaacatgaggatccaggacctgaaggtgtccctgaagcccctgcacagcgtgaacaaccccatcctgaggaagaggaagctgctgggcaccaagcccaaggacagcgtgtacatccatgaccatgaaaatggagctgaggacagcaatgtggccctggagaagctgagagatgtgattgcccagtgcatcctgccccaggccggagaaaatgaagatgagaagctgaatgaggtgatgcaggaggcctggaagtacaaccgggagtgcaagctgctgcgggacaccctgcagagcttctcctggaatggccggggcttcacagacaaggtggaccggctgaagctggccgagatcgtgaagcaggtgattgaggagcagaccaccagccatgagagccagtag

SEQ ID NO: 20548 - DNA, 1422 bp, Artificial Sequence
  Description of Artificial Sequence: Synthetic coding sequence
atgtctgaggagagtgacatggacaaggccatcaaggagaccagcatcctggaggagtacagcatcaactggacccagaagctgggcgccggcatcagcggccctgtgcgggtgtgtgtgaagaagagcacccaggagagatttgccctgaagatcctgctggaccggcccaaggccagaaatgaggtgcggctgcacatgatgtgtgccacccaccccaacatcgtgcagatcatcgaggtgtttgccaacagcgtgcagttcccccatgagagcagcccccgggcccggctgctgattgtgatggagatgatggagggcggggagctgttccaccgcatcagccagcaccgccacttcacagagaagcaggccagccaggtgaccaagcaggccaccctggccctgcggcactgccacctgctgaacatcgcccaccgggacctgaagccagagaacctgctcttcaaggacaacagcctggatgcccctgtgaagctgtgtgactttggatttgccaagattgaccagggcgacctgatgaccccccagttcaccccctactacgtggccccccaggtgctggaggcccagaggaggcaccagaaggagaagagcggcatcatccccaccagccccaccccctacacctacaacaagagctgtgacctgtggagcctgggcgtcatcatctacgtgatgctgtgtggctacccacccttctacagcaagcaccacagcaggaccatccccaaggacatgaggaggaagatcatgacaggcagctttgagttccctgaggaggagtggagccagatcagcgagatggccaaggatgtggtgaggaagctgctgaaggtgaagccagaggagcggctgaccattgaaggagtgctggaccacccctggctgaacagcacagaggccctggacaacgtgctgcccagcgcccagctgatgatggacaaggctgtggtggccggcatccagcaggcccacgccgagcagctggccaacatgaggatccaggacctgaaggtgtccctgaagcccctgcacagcgtgaacaaccccatcctgaggaagaggaagctgctgggcaccaagcccaaggacagcgtgtacatccatgaccatgaaaatggagctgaggacagcaatgtggccctggagaagctgagagatgtgattgcccagtgcatcctgccccaggccgggaaaggagaaaatgaagatgagaagctgaatgaggtgatgcaggaggcctggaagtacaaccgggagtgcaagctgctgcgggacaccctgcagagcttctcctggaatggccggggcttcacagacaaggtggaccggctgaagctggccgagatcgtgaagcaggtgattgaggagcagaccaccagccatgagagccagtag

SEQ ID NO: 20549 - DNA, 2799 bp, Artificial Sequence
  Description of Artificial Sequence: Synthetic coding sequence
atggctgctgctgctgctgtggaggccgccgcccccatgggcgccctgtggggcctggtgcatgactttgtggtgggccagcaggagggccctgctgaccaggtggccgcagatgtgaagagcggcaactacacagtgctgcaggtggtggaggccctgggcagcagcctggagaaccctgagcccaggacccgggcccgggccatccagctgctgagccaggtgctgctgcactgccacaccctgctgctggagaaggaggtggtgcacctgatcctcttctatgagaaccggctgaaggaccaccacctggtgatccccagcgtgctgcagggcctgaaggccctgagcctgtgtgtggccctgcccccaggcctggccgtgtctgtgctgaaggccatcttccaggaggtgcacgtgcagagcctgccccaggtggacagacacacagtgtacaacatcatcaccaacttcatgaggacccgggaggaggagctgaagagcctgggcgctgacttcaccttcggcttcatccaggtgatggatggagagaaggaccccaggaacctgctggtggccttccgcatcgtgcatgacctgatcagccgggactacagcctgggcccctttgtggaggagctgtttgaggtgaccagctgctacttccccatcgacttcaccccacctccaaatgacccccacggcatccagagagaagatctcatcctgagcctgcgggctgtgctggccagcacccccaggtttgctgagttcctgctgcccctgctgattgagaaggtggacagcgaggtgctgagcgccaagctggacagcctgcagaccctgaatgcctgctgtgctgtgtatggccagaaggagctgaaggacttcctgcccagcctgtgggccagcatccggcgggagagcagccagaggaggaccatcctggagatgctgctgggcttcctgaagctgcagcagaagtggagctatgaggacaaggaccagaggcccctgaatggcttcaaggaccagctgtgcagcctggtgttcatggccctgacagaccccagcacccagctgcagctggtgggcatccgcaccctgactgtgctgggcgcccagcctgacctgctgtcctatgaggacctggagctggccgtgggccacctgtaccgcctgtccttcctgaaggaggacagccagagctgccgggtggccgccctggaggccagcggcaccctggccgccctgtaccctgtggccttcagcagccacctggtgcccaagctggccgaggagctgcgggtgggggagagcaacctgaccaatggagatgagcccacccagtgcagccgccacctgtgctgcctgcaggccctgtctgctgtgtccacccaccccagcatcgtgaaggagaccctgcccctgctgctgcagcacctgtggcaggtgaacagaggcaacatggtggcccagagcagtgatgtgattgctgtgtgccagagcctgcggcagatggccgagaagtgccagcaggaccctgagagctgctggtacttccaccagacagccatcccctgcctgctggccctggccgtgcaggcctccatgcctgagaaggagcccagcgtgctgaggaaggtgctgctggaggatgaggtgctggccgccatggtgtctgtgattggaacagccaccacccacctgagccctgagctggccgcccagagcgtgacccacatcgtgcccctcttcctggatggaaatgtgtccttcctgcctgagaacagcttccccagccgcttccagcccttccaggacggcagcagcggccagaggcggctgattgccctgctgatggcctttgtgtgcagcctgcccagaaatgtggagatcccccagctgaaccagctgatgagggagctgctggagctgagctgctgccacagctgccccttcagcagcacagctgctgccaagtgctttgctggcctgctgaacaagcaccctgctggccagcagctggatgagttcctgcagctggccgtggacaaggtggaggccggcctgggcagcggcccctgccgcagccaggccttcaccctgctgctgtgggtgaccaaggccctggtgctgcgctaccaccccctgagcagctgcctgacagcccggctgatgggcctgctgagtgaccctgagctgggccctgctgctgctgatggcttcagcctgctgatgtctgactgcacagatgtgctgaccagggctggccacgccgaggtgcgcatcatgttccggcagcgcttcttcacagacaacgtgcctgccctggtgcagggcttccacgccgccccccaggatgtgaagcccaactacctgaagggcctgagccacgtgctgaaccggctgcccaagcctgtgctgctgcctgagctgcccaccctgctgagcctgctgctggaggccctgagctgcccagactgtgtggtgcagctgagcaccctgagctgcctgcagcccctgctgctggaggccccccaggtgatgagcctgcacgtggacaccctggtgaccaagttcctgaacctgagcagcagccccagcatggctgtgagaattgctgccctgcagtgcatgcacgccctgacccggctgcccacccctgtgctgctgccctacaagccccaggtgatccgggccctggccaagcccctggatgacaagaagaggctggtgaggaaggaggccgtgtctgcccggggggagtggttcctgctgggcagccctggcagctag

SEQ ID NO: 20550 - DNA, 1092 bp, Artificial Sequence
  Description of Artificial Sequence: Synthetic coding sequence
atgctgctgggcttcctgaagctgcagcagaagtggagctatgaggacaaggaccagaggcccctgaatggcttcaaggaccagctgtgcagcctggtgttcatggccctgacagaccccagcacccagctgcagctggtgggcatccgcaccctgactgtgctgggcgcccagcctgacctgctgtcctatgaggacctggagctggccgtgggccacctgtaccgcctgtccttcctgaaggaggacagccagagctgccgggtggccgccctggaggccagcggcaccctggccgccctgtaccctgtggccttcagcagccacctggtgcccaagctggccgaggagctgcgggtgggggagagcaacctgaccaatggagatgagcccacccagtgcagccgccacctgtgctgcctgcaggccctgtctgctgtgtccacccaccccagcatcgtgaaggagaccctgcccctgctgctgcagcacctgtggcaggtgaacagaggcaacatggtggcccagagcagtgatgtgattgctgtgtgccagagcctgcggcagatggccgagaagtgccagcaggaccctgagagctgctggtacttccaccagacagccatcccctgcctgctggccctggccgtgcaggcctccatgcctgagaaggagcccagcgtgctgaggaaggtgctgctggaggatgaggtgctggccgccatggtgtctgtcatcggcacagccaccacccacctgagccctgagctggccgcccagagcgtgacccacatcgtgcccctcttcctggatggaaatgtgtccttcctgcctgaaaattccttccccagccgcttccagcccttccaggacggcagcagcggccagaggaggctcatcgccctgctgatggcctttgtgtgcagcctgcccagaaatgtggagatcccccagctgaaccagctgatgagggagctgctggagctgagctgcacagctgcccccttcctgccccccctgctgcccagcgccctgcaggacagcagcaccagcaccctgcagggcagctcctggatgaacagctacagctag

SEQ ID NO: 20551 - DNA, 1128 bp, Artificial Sequence
  Description of Artificial Sequence: Synthetic coding sequence
atgaagctggtgtggcccagcgccaagctgctgcaggccgctgctggggccagcgcccgggcctgtgacagcgtgaccagcaatgtgctgcccctgctgctggagcagttccacaagcacagccagagcagccagaggaggaccatcctggagatgctgctgggcttcctgaagctgcagcagaagtggagctatgaggacaaggaccagaggcccctgaatggcttcaaggaccagctgtgcagcctggtgttcatggccctgacagaccccagcacccagctgcagctggtgggcatccgcaccctgactgtgctgggcgcccagcctgacctgctgtcctatgaggacctggagctggccgtgggccacctgtaccgcctgtccttcctgaaggaggacagccagagctgccgggtggccgccctggaggccagcggcaccctggccgccctgtaccctgtggccttcagcagccacctggtgcccaagctggccgaggagctgcgggtgggggagagcaacctgaccaatggagatgagcccacccagtgcagccgccacctgtgctgcctgcaggccctgtctgctgtgtccacccaccccagcatcgtgaaggagaccctgcccctgctgctgcagcacctgtggcaggtgaacagaggcaacatggtggcccagagcagtgatgtgattgctgtgtgccagagcctgcggcagatggccgagaagtgccagcaggaccctgagagctgctggtacttccaccagacagccatcccctgcctgctggccctggccgtgcaggcctccatgcctgagaaggagcccagcgtgctgaggaaggtgctgctggaggatgaggtgctggccgccatggtgtctgtgattggaacagccaccacccacctgagccctgagctggccgcccagagcgtgacccacatcgtgcccctcttcctggatggaaatgtgtccttcctgcctgagaacagcttccccagccgcttccagcccttccaggtgacagatggcagcagcggccagaggcggctgattgccctgctgatggcctttgtgtgcagcctgcccagaaatggcagctcctggatgaacagctacagctag

SEQ ID NO: 20552 - DNA, 1128 bp, Artificial Sequence; identical to SEQ ID NO: 20551
  Description of Artificial Sequence: Synthetic coding sequence

SEQ ID NO: 20553 - DNA, 2964 bp, Artificial Sequence
  Description of Artificial Sequence: Synthetic coding sequence
atggctgctgctgctgctgtggaggccgccgcccccatgggcgccctgtggggcctggtgcatgactttgtggtgggccagcaggagggccctgctgaccaggtggccgcagatgtgaagagcggcaactacacagtgctgcaggtggtggaggccctgggcagcagcctggagaaccctgagcccaggacccgggcccgggccatccagctgctgagccaggtgctgctgcactgccacaccctgctgctggagaaggaggtggtgcacctgatcctcttctatgagaaccggctgaaggaccaccacctggtgatccccagcgtgctgcagggcctgaaggccctgagcctgtgtgtggccctgcccccaggcctggccgtgtctgtgctgaaggccatcttccaggaggtgcacgtgcagagcctgccccaggtggacagacacacagtgtacaacatcatcaccaacttcatgaggacccgggaggagggcccctttgtggaggagctgtttgaggtgaccagctgctacttccccatcgacttcaccccacctccaaatgacccccacggcatccagcgggaggacctgatcctgagcctgcgggctgtgctggccagcacccccaggtttgctgagttcctgctgcccctgctgattgagaaggtggacagcgaggtgctgagcgccaagctggacagcctgcagaccctgaatgcctgctgtgctgtgtatggccagaaggagctgaaggacttcctgcccagcctgtgggccagcatcagaagagaggtgttccagacagccagcgagcgggtggaggccgagggcctggccgccctgcacagcctgacagcctgcctgagccgctctgtgctgcgggcagatgctgaggacctgctggacagcttcctgagcaacatcctgcaggactgccgccaccacctgtgtgagccagacatgaagctggtgtggcccagcgccaagctgctgcaggccgccgccggggccagcgcccgggcctgtgacagcgtgaccagcaatgtgctgcccctgctgctggagcagttccacaagcacagccagagcagccagaggaggaccatcctggagatgctgctgggcttcctgaagctgcagcagaagtggagctatgaggacaaggaccagaggcccctgaatggcttcaaggaccagctgtgcagcctggtgttcatggccctgacagaccccagcacccagctgcagctggtgggcatccgcaccctgactgtgctgggcgcccagcctgacctgctgtcctatgaggacctggagctggccgtgggccacctgtaccgcctgtccttcctgaaggaggacagccagagctgccgggtggccgccctggaggccagcggcaccctggccgccctgtaccctgtggccttcagcagccacctggtgcccaagctggccgaggagctgcgggtgggggagagcaacctgaccaatggagatgagcccacccagtgcagccgccacctgtgctgcctgcaggccctgtctgctgtgtccacccaccccagcatcgtgaaggagaccctgcccctgctgctgcagcacctgtggcaggtgaacagaggcaacatggtggcccagagcagtgatgtgattgctgtgtgccagagcctgcggcagatggccgagaagtgccagcaggaccctgagagctgctggtacttccaccagacagccatcccctgcctgctggccctggccgtgcaggcctccatgcctgagaaggagcccagcgtgctgaggaaggtgctgctggaggatgaggtgctggccgccatggtgtctgtcatcggcacagccaccacccacctgagccctgagctggccgcccagagcgtgacccacatcgtgcccctcttcctggatggaaatgtgtccttcctgcctgaaaattccttccccagccgcttccagcccttccaggacggcagcagcggccagaggaggctcatcgccctgctgatggcctttgtgtgcagcctgcccagaaatgtggagatcccccagctgaaccagctgatgagggagctgctggagctgagctgctgccacagctgccccttcagcagcacagctgctgccaagtgctttgctggcctgctgaacaagcaccctgctggccagcagctggatgagttcctgcagctggccgtggacaaggtggaggccggcctgggcagcggcccctgccgcagccaggccttcaccctgctgctgtgggtgaccaaggccctggtgctgcgctaccaccccctgagcagctgcctgacagcccggctgatgggcctgctgagtgaccctgagctgggccctgctgctgctgatggcttcagcctgctgatgtctgactgcacagatgtgctgacccgggccggccatgctgaggtgcgcatcatgttccggcagcgcttcttcacagacaacgtgcctgccctggtgcagggcttccacgccgccccccaggatgtgaagcccaactacctgaagggcctgagccacgtgctgaaccggctgcccaagcctgtgctgctgcctgagctgcccaccctgctgagcctgctgctggaggccctgagctgcccagactgtgtggtgcagctgagcaccctgagctgcctgcagcccctgctgctggaggccccccaggtgatgagcctgcacgtggacaccctggtgaccaagttcctgaacctgagcagcagccccagcatggctgtgagaattgctgccctgcagtgcatgcacgccctgacccggctgcccacccctgtgctgctgccctacaagccccaggtgatccgggccctggccaagcccctggatgacaagaagaggctggtgaggaaggaggccgtgtctgcccggggggagtggttcctgctgggcagccctggcagctag

SEQ ID NO: 20554 - DNA, 3093 bp, Artificial Sequence
  Description of Artificial Sequence: Synthetic coding sequence
atggctgctgctgctgctgtggaggccgccgcccccatgggcgccctgtggggcctggtgcatgactttgtggtgggccagcaggagggccctgctgaccaggtggccgcagatgtgaagagcggcaactacacagtgctgcaggtggtggaggccctgggcagcagcctggagaaccctgagcccaggacccgggcccgggccatccagctgctgagccaggtgctgctgcactgccacaccctgctgctggagaaggaggtggtgcacctgatcctcttctatgagaaccggctgaaggaccaccacctggtgatccccagcgtgctgcagggcctgaaggccctgagcctgtgtgtggccctgcccccaggcctggccgtgtctgtgctgaaggccatcttccaggaggtgcacgtgcagagcctgccccaggtggacagacacacagtgtacaacatcatcaccaacttcatgaggacccgggaggaggagctgaagagcctgggcgctgacttcaccttcggcttcatccaggtgatggatggagagaaggaccccaggaacctgctggtggccttccgcatcgtgcatgacctgatcagccgggactacagcctgggcccctttgtggaggagctgtttgaggtgaccagctgctacttccccatcgacttcaccccacctccaaatgacccccacggcatccagagagaagatctcatcctgagcctgcgggctgtgctggccagcacccccaggtttgctgagttcctgctgcccctgctgattgagaaggtggacagcgaggtgctgagcgccaagctggacagcctgcagaccctgaatgcctgctgtgctgtgtatggccagaaggagctgaaggacttcctgcccagcctgtgggccagcatccggcgggaggtgttccagacagccagcgagcgggtggaggccgagggcctggccgccctgcacagcctgacagcctgcctgagccgctctgtgctgcgggcagatgctgaggacctgctggacagcttcctgagcaacatcctgcaggactgccgccaccacctgtgtgagccagacatgaagctggtgtggcccagcgccaagctgctgcaggccgctgctggggccagcgcccgggcctgtgacagcgtgaccagcaatgtgctgcccctgctgctggagcagttccacaagcacagccagagcagccagaggaggaccatcctggagatgctgctgggcttcctgaagctgcagcagaagtggagctatgaggacaaggaccagaggcccctgaatggcttcaaggaccagctgtgcagcctggtgttcatggccctgacagaccccagcacccagctgcagctggtgggcatccgcaccctgactgtgctgggcgcccagcctgacctgctgtcctatgaggacctggagctggccgtgggccacctgtaccgcctgtccttcctgaaggaggacagccagagctgccgggtggccgccctggaggccagcggcaccctggccgccctgtaccctgtggccttcagcagccacctggtgcccaagctggccgaggagctgcgggtgggggagagcaacctgaccaatggagatgagcccacccagtgcagccgccacctgtgctgcctgcaggccctgtctgctgtgtccacccaccccagcatcgtgaaggagaccctgcccctgctgctgcagcacctgtggcaggtgaacagaggcaacatggtggcccagagcagtgatgtgattgctgtgtgccagagcctgcggcagatggccgagaagtgccagcaggaccctgagagctgctggtacttccaccagacagccatcccctgcctgctggccctggccgtgcaggcctccatgcctgagaaggagcccagcgtgctgaggaaggtgctgctggaggatgaggtgctggccgccatggtgtctgtgattggaacagccaccacccacctgagccctgagctggccgcccagagcgtgacccacatcgtgcccctcttcctggatggaaatgtgtccttcctgcctgagaacagcttccccagccgcttccagcccttccaggacggcagcagcggccagaggcggctgattgccctgctgatggcctttgtgtgcagcctgcccagaaatgtggagatcccccagctgaaccagctgatgagggagctgctggagctgagctgctgccacagctgccccttcagcagcacagctgctgccaagtgctttgctggcctgctgaacaagcaccctgctggccagcagctggatgagttcctgcagctggccgtggacaaggtggaggccggcctgggcagcggcccctgccgcagccaggccttcaccctgctgctgtgggtgaccaaggccctggtgctgcgctaccaccccctgagcagctgcctgacagcccggctgatgggcctgctgagtgaccctgagctgggccctgctgctgctgatggcttcagcctgctgatgtctgactgcacagatgtgctgaccagggctggccacgccgaggtgcgcatcatgttccggcagcgcttcttcacagacaacgtgcctgccctggtgcagggcttccacgccgccccccaggatgtgaagcccaactacctgaagggcctgagccacgtgctgaaccggctgcccaagcctgtgctgctgcctgagctgcccaccctgctgagcctgctgctggaggccctgagctgcccagactgtgtggtgcagctgagcaccctgagctgcctgcagcccctgctgctggaggccccccaggtgatgagcctgcacgtggacaccctggtgaccaagttcctgaacctgagcagcagccccagcatggctgtgagaattgctgccctgcagtgcatgcacgccctgacccggctgcccacccctgtgctgctgccctacaagccccaggtgatccgggccctggccaagcccctggatgacaagaagaggctggtgaggaaggaggccgtgtctgcccggggggagtggttcctgctgggcagccctggcagctag

SEQ ID NO: 20555 - DNA, 3030 bp, Artificial Sequence
  Description of Artificial Sequence: Synthetic coding sequence
atggctgctgctgctgctgtggaggccgccgcccccatgggcgccctgtggggcctggtgcatgactttgtggtgggccagcaggagggccctgctgaccaggtggccgccagcagcctggagaaccctgagcccaggacccgggcccgggccatccagctgctgagccaggtgctgctgcactgccacaccctgctgctggagaaggaggtggtgcacctgatcctcttctatgaaaatcggctgaaggaccaccacctggtgatccccagcgtgctgcagggcctgaaggccctgagcctgtgtgtggccctgcccccaggcctggccgtgtctgtgctgaaggccatcttccaggaggtgcacgtgcaggtggacagacacacagtgtacaacatcatcaccaacttcatgaggacccgggaggaggagctgaagagcctgggcgctgacttcaccttcggcttcatccaggtgatggatggagagaaggaccccaggaacctgctggtggccttcagaattgtgcatgacctgatcagccgggactacagcctgggcccctttgtggaggagctgtttgaggtgaccagctgctacttccccatcgacttcaccccacctccaaatgacccccacggcatccagcgggaggacctgatcctgagcctgcgggctgtgctggccagcacccccaggtttgctgagttcctgctgcccctgctgattgagaaggtggacagcgaggtgctgagcgccaagctggacagcctgcagaccctgaatgcctgctgtgctgtgtatggccagaaggagctgaaggacttcctgcccagcctgtgggccagcatcagaagagaggtgttccagacagccagcgagcgggtggaggccgagggcctggccgccctgcacagcctgacagcctgcctgagccgctctgtgctgcgggcagatgctgaggacctgctggacagcttcctgagcaacatcctgcaggactgccgccaccacctgtgtgagccagacatgaagctggtgtggcccagcgccaagctgctgcaggccgccgccggggccagcgcccgggcctgtgacagcgtgaccagcaatgtgctgcccctgctgctggagcagttccacaagcacagccagagcagccagaggaggaccatcctggagatgctgctgggcttcctgaagctgcagcagaagtggagctatgaggacaaggaccagaggcccctgaatggcttcaaggaccagctgtgcagcctggtgttcatggccctgacagaccccagcacccagctgcagctggtgggcatccgcaccctgactgtgctgggcgcccagcctgacctgctgtcctatgaggacctggagctggccgtgggccacctgtaccgcctgtccttcctgaaggaggacagccagagctgccgggtggccgccctggaggccagcggcaccctggccgccctgtaccctgtggccttcagcagccacctggtgcccaagctggccgaggagctgcgggtgggggagagcaacctgaccaatggagatgagcccacccagtgcagccgccacctgtgctgcctgcaggccctgtctgctgtgtccacccaccccagcatcgtgaaggagaccctgcccctgctgctgcagcacctgtggcaggtgaacagaggcaacatggtggcccagagcagtgatgtgattgctgtgtgccagagcctgcggcagatggccgagaagtgccagcaggaccctgagagctgctggtacttccaccagacagccatcccctgcctgctggccctggccgtgcaggcctccatgcctgagaaggagcccagcgtgctgaggaaggtgctgctggaggatgaggtgctggccgccatggtgtctgtcatcggcacagccaccacccacctgagccctgagctggccgcccagagcgtgacccacatcgtgcccctcttcctggatggaaatgtgtccttcctgcctgaaaattccttccccagccgcttccagcccttccaggacggcagcagcggccagaggaggctcatcgccctgctgatggcctttgtgtgcagcctgcccagaaatgtggagatcccccagctgaaccagctgatgagggagctgctggagctgagctgctgccacagctgccccttcagcagcacagctgctgccaagtgctttgctggcctgctgaacaagcaccctgctggccagcagctggatgagttcctgcagctggccgtggacaaggtggaggccggcctgggcagcggcccctgccgcagccaggccttcaccctgctgctgtgggtgaccaaggccctggtgctgcgctaccaccccctgagcagctgcctgacagcccggctgatgggcctgctgagtgaccctgagctgggccctgctgctgctgatggcttcagcctgctgatgtctgactgcacagatgtgctgacccgggccggccatgctgaggtgcgcatcatgttccggcagcgcttcttcacagacaacgtgcctgccctggtgcagggcttccacgccgccccccaggatgtgaagcccaactacctgaagggcctgagccacgtgctgaaccggctgcccaagcctgtgctgctgcctgagctgcccaccctgctgagcctgctgctggaggccctgagctgcccagactgtgtggtgcagctgagcaccctgagctgcctgcagcccctgctgctggaggccccccaggtgatgagcctgcacgtggacaccctggtgaccaagttcctgaacctgagcagcagccccagcatggctgtgagaattgctgccctgcagtgcatgcacgccctgacccggctgcccacccctgtgctgctgccctacaagccccaggtgatccgggccctggccaagcccctggatgacaagaagaggctggtgaggaaggaggccgtgtctgcccggggggagtggttcctgctgggcagccctggcagctag

SEQ ID NO: 20556 - DNA, 3093 bp, Artificial Sequence; identical to SEQ ID NO: 20554
  Description of Artificial Sequence: Synthetic coding sequence

SEQ ID NO: 20557 - DNA, 1734 bp, Artificial Sequence
  Description of Artificial Sequence: Synthetic coding sequence
atgcccaagaccatctctgtgcgggtgaccaccatggatgctgagctggagtttgccatccagcccaacaccaccgggaagcagctgtttgaccaggtggtgaagaccatcggcctgcgggaggtgtggttcttcggcctgcagtaccaggacaccaagggcttcagcacctggctgaagctgaacaagaaggtgacagcccaggatgtgaggaaggagagccccctgctcttcaagttccgggccaagttctacccagaagatgtgtctgaggagctgatccaggacatcacccagaggctcttcttcctgcaggtgaaggagggcatcctgaatgatgacatctactgccccccagagacagctgtgctgctggccagctatgctgtgcagagcaagtacggggacttcaacaaggaggtgcacaagagcggctacctggccggggacaagctgctgccccagagggtgctggagcagcacaagctgaacaaggaccagtgggaggagcgcatccaggtgtggcatgaggagcaccggggcatgctgagagaagatgctgtgctggagtacctgaagatcgcccaggacctggagatgtatggagtgaactacttcagcatcaagaacaagaagggcagcgagctgtggctgggcgtggatgccctgggcctgaacatctatgagcagaatgaccggctgacccccaagattggcttcccctggagcgagatccggaacatctccttcaatgacaagaagtttgtgatcaagcccatcgacaagaaggccccagactttgtgttctacgccccccggctgcgcatcaacaagaggatcctggccctgtgcatgggcaaccacgagctgtacatgagaagaaggaagccagacaccatcgaggtgcagcagatgaaggcccaggcccgggaggagaagcaccagaagcagatggagcgggccatgctggagaatgagaagaagaagcgggagatggccgagaaggagaaggagaagattgaaagagagaaggaggagctgatggagcggctgaagcagatcgaggagcagaccaagaaggcccagcaggagctggaggagcagacccggcgggccctggagctggagcaggagaggaagagggcccagagcgaggccgagaagctggccaaggagcggcaggaggccgaggaggccaaggaggccctgctgcaggccagccgggaccagaagaagacccaggagcagctggccctggagatggccgagctgacagcccgcatcagccagctggagatggcccggcagaagaaggagagcgaggccgtggagtggcagcagaaggcccagatggtgcaggaggacctggagaagaccagggctgagctgaagacagccatgagcacccctcatgtggccgagccagcagaaaatgagcaggatgagcaggatgaaaatggagctgaggccagcgctgacctgcgggcagatgccatggccaaggacagaagtgaggaggagaggaccacagaggccgagaagaatgaaagagtgcagaagcacctgaaggccctgaccagcgagctggccaatgccagagatgagagcaagaagacagccaatgacatgattcatgctgagaacatgaggctgggccgggacaagtacaagaccctgcggcagatccggcagggcaacaccaagcagagaattgatgaatttgagagcatgtag

SEQ ID NO: 20558 - DNA, 717 bp, Artificial Sequence
  Description of Artificial Sequence: Synthetic coding sequence
atgaggttcaagaaccgcttccagcgcttcatgaaccaccgggccccagccaacggccgctacaagcccacctgctatgagcacgccgccaactgctacacccacgccttcctgattgtgcctgccatcgtgggcagcgccctgctgcaccggctgagtgatgactgctgggagaagatcacagcctggatctacggcatgggcctgtgtgccctcttcatcgtgtccacagtgttccacatcgtgtcctggaagaagagccacctgaggacagtggagcactgcttccacatgtgtgacaggatggtgatctacttcttcatcgccgccagctatgccccctggctgaacctgcgggagctgggccccctggccagccacatgcgctggttcatctggctgatggctgctgggggcaccatctacgtgttcctgtaccacgagaagtacaaggtggtggagctgttcttctacctgaccatgggcttctccccagccctggtggtgacctccatgaacaacacagatggcctgcaggagctggcctgtggcggcctcatctactgcctgggcgtggtgttcttcaagagtgatggcatcatcccctttgcccacgccatctggcacctgtttgtggccacagctgctgctgtgcactactatgccatctggaagtacctgtaccgcagccccacagacttcatgaggcacctgtag

SEQ ID NO: 20559 - DNA, 2127 bp, Artificial Sequence
  Description of Artificial Sequence: Synthetic coding sequence
atgagcacagcagatgccctggatgatgagaacaccttcaagatcctggtggccacagacatccacctgggcttcatggagaaggatgctgtgagaggaaatgacacctttgtgaccctggatgagatcctgcggctggcccaggagaatgaggtggacttcatcctgctgggcggggacctcttccacgagaacaagcccagcaggaagaccctgcacacctgcctggagctgctgaggaagtactgcatgggagacaggcctgtgcagtttgagatcctgagtgaccagagcgtgaactttggcttcagcaagttcccctgggtgaactaccaggacggcaacctgaacatcagcatccctgtgttcagcatccacggcaaccatgatgaccccactggagcagatgccctgtgtgccctggacatcctgagctgtgccggctttgtgaaccacttcggccgctccatgtctgtggagaagattgacatcagccctgtgctgctgcagaagggcagcaccaagatcgccctgtatggcctgggcagcatcccagatgagcggctgtacaggatgtttgtgaacaagaaggtgaccatgctgcggcccaaggaggatgaaaattcctggttcaacctcttcgtcatccaccagaacagaagcaagcacggcagcaccaacttcatccctgagcagttcctggatgacttcatcgacctggtgatctggggccatgaacatgagtgcaagatcgcccccaccaagaatgagcagcagctgttctacatcagccagcccggcagctctgtggtgaccagcctgagccctggagaggccgtgaagaagcacgtgggcctgctgcgcatcaagggcaggaagatgaacatgcacaagatccccctgcacacagtgcggcagttcttcatggaggacatcgtgctggccaaccacccagacatcttcaacccagacaaccccaaggtgacccaggccatccagagcttctgcctggagaagattgaggagatgctggagaatgctgagcgggagcggctgggcaacagccaccagcctgagaagcccctggtgcggctgcgggtggactacagcggcggctttgagcccttctctgtgctgcgcttcagccagaagtttgtggacagagtggccaaccccaaggacatcatccacttcttccgccaccgggagcagaaggagaagacaggagaggagatcaactttgggaagctgatcaccaagcccagcgagggcaccaccctgcgggtggaggacctggtgaagcagtacttccagacagctgagaagaatgtgcagctgagcctgctgacagagcggggcatgggagaggccgtgcaggagtttgtggacaaggaggagaaggatgccatcgaggagctggtgaagtaccagctggagaagacccagcgcttcctgaaggagcggcacattgatgccctggaggacaagattgatgaggaggtgcggcgcttccgggagacccggcagaagaacaccaatgaagaagatgatgaggtgcgggaggccatgacccgggcccgggccctgcggagccagagcgaggagagcgccagcgccttcagcgcagatgacctgatgagcattgacctggccgagcagatggccaatgacagtgatgacagcatctctgctgccaccaacaagggccggggccggggccggggccggcggggcggccggggccagaacagcgccagccggggcggcagccagaggggccgggctgacaccggcctggagaccagcaccaggagcaggaacagcaagacagctgtgtctgccagcaggaacatgagcatcattgatgccttcaagagcacccggcagcagcccagcagaaatgtgaccaccaagaactacagcgaggtgattgaggtggatgaaagtgatgtggaggaggacatcttccccaccaccagcaagacagaccagcgctggagcagcaccagcagcagcaagatcatgagccagagccaggtgtccaagggcgtggactttgagagcagtgaagatgatgatgatgaccccttcatgaacaccagcagcctgcggaggaacagaagatag

SEQ ID NO: 20560 - DNA, 2043 bp, Artificial Sequence
  Description of Artificial Sequence: Synthetic coding sequence
atgagcacagcagatgccctggatgatgagaacaccttcaagatcctggtggccacagacatccacctgggcttcatggagaaggatgctgtgagaggaaatgacacctttgtgaccctggatgagatcctgcggctggcccaggagaatgaggtggacttcatcctgctgggcggggacctcttccacgagaacaagcccagcaggaagaccctgcacacctgcctggagctgctgaggaagtactgcatgggagacaggcctgtgcagtttgagatcctgagtgaccagagcgtgaactttggcttcagcaagttcccctgggtgaactaccaggacggcaacctgaacatcagcatccctgtgttcagcatccacggcaaccatgatgaccccactggagcagatgccctgtgtgccctggacatcctgagctgtgccggctttgtgaaccacttcggccgctccatgtctgtggagaagattgacatcagccctgtgctgctgcagaagggcagcaccaagatcgccctgtatggcctgggcagcatcccagatgagcggctgtacaggatgtttgtgaacaagaaggtgaccatgctgcggcccaaggaggatgaaaattcctggttcaacctcttcgtcatccaccagaacagaagcaagcacggcagcaccaacttcatccctgagcagttcctggatgacttcatcgacctggtgatctggggccatgaacatgagtgcaagatcgcccccaccaagaatgagcagcagctgttctacatcagccagcccggcagctctgtggtgaccagcctgagccctggagaggccgtgaagaagcacgtgggcctgctgcgcatcaagggcaggaagatgaacatgcacaagatccccctgcacacagtgcggcagttcttcatggaggacatcgtgctggccaaccacccagacatcttcaacccagacaaccccaaggtgacccaggccatccagagcttctgcctggagaagattgaggagatgctggagaatgctgagcgggagcggctgggcaacagccaccagcctgagaagcccctggtgcggctgcgggtggactacagcggcggctttgagcccttctctgtgctgcgcttcagccagaagtttgtggacagagtggccaaccccaaggacatcatccacttcttccgccaccgggagcagaaggagaagacaggagaggagatcaactttgggaagctgatcaccaagcccagcgagggcaccaccctgcgggtggaggacctggtgaagcagtacttccagacagctgagaagaatgtgcagctgagcctgctgacagagcggggcatgggagaggccgtgcaggagtttgtggacaaggaggagaaggatgccatcgaggagctggtgaagtaccagctggagaagacccagcgcttcctgaaggagcggcacattgatgccctggaggacaagattgatgaggaggtgcggcgcttccgggagacccggcagaagaacaccaatgaagaagatgatgaggtgcgggaggccatgacccgggcccgggccctgcggagccagagcgaggagagcgccagcgccttcagcgcagatgacctgatgagcattgacctggccgagcagatggccaatgacagtgatgacagcatctctgctgccaccaacaagggccggggccggggccggggccggcggggcggccggggccagaacagcgccagccggggcggcagccagaggggccgggccttcaagagcacccggcagcagcccagcagaaatgtgaccaccaagaactacagcgaggtgattgaggtggatgaaagtgatgtggaggaggacatcttccccaccaccagcaagacagaccagcgctggagcagcaccagcagcagcaagatcatgagccagagccaggtgtccaagggcgtggactttgagagcagtgaagatgatgatgatgaccccttcatgaacaccagcagcctgcggaggaacagaagatag

SEQ ID NO: 20561 - DNA, 2124 bp, Artificial Sequence
  Description of Artificial Sequence: Synthetic coding sequence
atgagcacagcagatgccctggatgatgagaacaccttcaagatcctggtggccacagacatccacctgggcttcatggagaaggatgctgtgagaggaaatgacacctttgtgaccctggatgagatcctgcggctggcccaggagaatgaggtggacttcatcctgctgggcggggacctcttccacgagaacaagcccagcaggaagaccctgcacacctgcctggagctgctgaggaagtactgcatgggagacaggcctgtgcagtttgagatcctgagtgaccagagcgtgaactttggcttcagcaagttcccctgggtgaactaccaggacggcaacctgaacatcagcatccctgtgttcagcatccacggcaaccatgatgaccccactggagcagatgccctgtgtgccctggacatcctgagctgtgccggctttgtgaaccacttcggccgctccatgtctgtggagaagattgacatcagccctgtgctgctgcagaagggcagcaccaagatcgccctgtatggcctgggcagcatcccagatgagcggctgtacaggatgtttgtgaacaagaaggtgaccatgctgcggcccaaggaggatgaaaattcctggttcaacctcttcgtcatccaccagaacagaagcaagcacggcagcaccaacttcatccctgagcagttcctggatgacttcatcgacctggtgatctggggccatgaacatgagtgcaagatcgcccccaccaagaatgagcagcagctgttctacatcagccagcccggcagctctgtggtgaccagcctgagccctggagaggccgtgaagaagcacgtgggcctgctgcgcatcaagggcaggaagatgaacatgcacaagatccccctgcacacagtgcggcagttcttcatggaggacatcgtgctggccaaccacccagacatcttcaacccagacaaccccaaggtgacccaggccatccagagcttctgcctggagaagattgaggagatgctggagaatgctgagcgggagcggctgggcaacagccaccagcctgagaagcccctggtgcggctgcgggtggactacagcggcggctttgagcccttctctgtgctgcgcttcagccagaagtttgtggacagagtggccaaccccaaggacatcatccacttcttccgccaccgggagcagaaggagaagacaggagaggagatcaactttgggaagctgatcaccaagcccagcgagggcaccaccctgcgggtggaggacctggtgaagcagtacttccagacagctgagaagaatgtgcagctgagcctgctgacagagcggggcatgggagaggccgtgcaggagtttgtggacaaggaggagaaggatgccatcgaggagctggtgaagtaccagctggagaagacccagcgcttcctgaaggagcggcacattgatgccctggaggacaagattgatgaggaggtgcggcgcttccgggagacccggcagaagaacaccaatgaagaagatgatgaggtgcgggaggccatgacccgggcccgggccctgcggagccagagcgaggagagcgccagcgccttcagcgcagatgacctgatgagcattgacctggccgagcagatggccaatgacagtgatgacagcatctctgctgccaccaacaagggccggggccggggccggggccggcggggcggccggggccagaacagcgccagccggggcggcagccagaggggccgggacaccggcctggagaccagcaccaggagcaggaacagcaagacagctgtgtctgccagcaggaacatgagcatcattgatgccttcaagagcacccggcagcagcccagcagaaatgtgaccaccaagaactacagcgaggtgattgaggtggatgaaagtgatgtggaggaggacatcttccccaccaccagcaagacagaccagcgctggagcagcaccagcagcagcaagatcatgagccagagccaggtgtccaaaggagtggactttgagagcagtgaagatgatgatgatgaccccttcatgaacaccagcagcctgcggaggaacagaagatag

SEQ ID NO: 20562 - DNA, 2136 bp, Artificial Sequence
  Description of Artificial Sequence: Synthetic coding sequence
atgaacagaaacatcagccaccagaagggagatgatgagaacaccttcaagatcctggtggccacagacatccacctgggcttcatggagaaggatgctgtgagaggaaatgacacctttgtgaccctggatgagatcctgcggctggcccaggagaatgaggtggacttcatcctgctgggcggggacctcttccacgagaacaagcccagcaggaagaccctgcacacctgcctggagctgctgaggaagtactgcatgggagacaggcctgtgcagtttgagatcctgagtgaccagagcgtgaactttggcttcagcaagttcccctgggtgaactaccaggacggcaacctgaacatcagcatccctgtgttcagcatccacggcaaccatgatgaccccaccggggctgatgccctgtgtgccctggacatcctgagctgtgccggctttgtgaaccacttcggccgctccatgtctgtggagaagattgacatcagccctgtgctgctgcagaagggcagcaccaagatcgccctgtatggcctgggcagcatcccagatgagcggctgtacaggatgtttgtgaacaagaaggtgaccatgctgcggcccaaggaggatgagaacagctggttcaacctgtttgtgatccaccagaacagaagcaagcacggcagcaccaacttcatccctgagcagttcctggatgacttcatcgacctggtgatctggggccacgagcacgagtgcaagatcgcccccaccaagaatgagcagcagctgttctacatcagccagcccggcagctctgtggtgaccagcctgagccctggagaggccgtgaagaagcacgtgggcctgctgcgcatcaagggcaggaagatgaacatgcacaagatccccctgcacacagtgcggcagttcttcatggaggacatcgtgctggccaaccacccagacatcttcaacccagacaaccccaaggtgacccaggccatccagagcttctgcctggagaagattgaggagatgctggagaatgctgagcgggagcggctgggcaacagccaccagcctgagaagcccctggtgcggctgcgggtggactacagcggcggctttgagcccttctctgtgctgcgcttcagccagaagtttgtggacagagtggccaaccccaaggacatcatccacttcttccgccaccgggagcagaaggagaagacaggagaggagatcaactttgggaagctgatcaccaagcccagcgagggcaccaccctgcgggtggaggacctggtgaagcagtacttccagacagctgagaagaatgtgcagctgagcctgctgacagagcggggcatgggagaggccgtgcaggagtttgtggacaaggaggagaaggatgccatcgaggagctggtgaagtaccagctggagaagacccagcgcttcctgaaggagcggcacattgatgccctggaggacaagattgatgaggaggtgcggcgcttccgggagacccggcagaagaacaccaatgaggaggatgatgaggtgcgggaggccatgacccgggcccgggccctgcggagccagagcgaggagagcgccagcgccttcagcgcagatgacctgatgagcattgacctggccgagcagatggccaatgacagtgatgacagcatctctgctgccaccaacaagggccggggccggggccggggcagaagaggaggccggggccagaacagcgccagcagaggaggcagccagaggggccgggctgacaccggcctggagaccagcaccaggagcaggaacagcaagacagctgtgtctgccagcaggaacatgagcatcattgatgccttcaagagcacccggcagcagcccagcagaaatgtgaccaccaagaactacagcgaggtgattgaggtggatgaaagtgatgtggaggaggacatcttccccaccaccagcaagacagaccagcgctggagcagcaccagcagcagcaagatcatgagccagagccaggtgtccaaaggagtggactttgagagcagtgaagatgatgatgatgaccccttcatgaacaccagcagcctgcggaggaacagaagatag

SEQ ID NO: 20563 - DNA, 384 bp, Artificial Sequence
  Description of Artificial Sequence: Synthetic coding sequence
atgagcacagcagatgccctggatgatgagaacaccttcaagatcctggtggccacagacatccacctgggcttcatggagaaggatgctgtgagaggaaatgacacctttgtgaccctggatgagatcctgcggctggcccaggagaatgaggtggacttcatcctgctgggcggggacctcttccacgagaacaagcccagcaggaagaccctgcacacctgcctggagctgctgaggaagtactgcatgggagacaggcctgtgcagtttgagatcctgagtgaccagagcgtgaactttggcttcagcaagttcccctgggtgaactaccaggacggcaacctgaacatcagcatccctgtgttcagcatccacggctag

SEQ ID NO: 20564 - DNA, 336 bp, Artificial Sequence
  Description of Artificial Sequence: Synthetic coding sequence
atgagcacagcagatgccctggatgatgagaacaccttcaagatcctggtggccacagacatccacctgggcttcatggagaaggatgctgtgagaggaaatgacacctttgtgaccctggatgagatcctgcggctggcccaggagaatgaggtggacttcatcctgctgggcggggacctcttccacgagaacaagcccagcaggaagaccctgcacacctgcctggagctgctgaggaagtactgcatgggagacaggcctgtgcagtttgagatcctgagtgaccagagcgtgaactttggcttcagcaagttcccctgggtgaactactag

SEQ ID NO: 20565 - DNA, 666 bp, Artificial Sequence
  Description of Artificial Sequence: Synthetic coding sequence
atgagcacagcagatgccctggatgatgagaacaccttcaagatcctggtggccacagacatccacctgggcttcatggagaaggatgctgtgagaggaaatgacacctttgtgaccctggatgagatcctgcggctggcccaggagaatgaggtggacttcatcctgctgggcggggacctcttccacgagaacaagcccagcaggaagaccctgcacacctgcctggagctgctgaggaagtactgcatgggagacaggcctgtgcagtttgagatcctgagtgaccagagcgtgaactttggcttcagcaagttcccctgggtgaactaccaggacggcaacctgaacatcagcatccctgtgttcagcatccacggcaaccatgatgaccccactggagcagatgccctgtgtgccctggacatcctgagctgtgccggctttgtgaaccacttcggccgctccatgtctgtggagaagattgacatcagccctgtgctgctgcagaagggcagcaccaagatcgccctgtatggcctgggcagcatcccagatgagcggctgtacaggatgtttgtgaacaagaaggtgaccatgctgcggcccaaggaggatgaaaattcctggttcaacctcttcgtcatccaccagaacagagtgtag

SEQ ID NO: 20566 - DNA, 822 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgccctgagcactggagtgtccttcttcttcctgtccttccacatcagcaacctgcagttcaacagcagcctggaggaccccagcacagactactaccaggagctgcagagggacatcagcgagatgttcctgcagatctacaagcagggcggcttcctgggcctgagcaacatcaagttccggcccggctctgtggtggtgcagctgaccctggccttccgggagggcaccatcaacgtgcatgatgtggagacccagttcaaccagtacaagacagaggccgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20567 - DNA, 675 bp, Artificial Sequence
  Description of Artificial Sequence: Synthetic coding sequence
atgaccccaggcacccagagccccttcttcctgctgctgctgctgactgtgctgacagccaccacagcccccaagccagccaccgtggtgactggaagtggccacgccagcagcaccccaggaggagagaaggagaccagcgccacccagaggagctctgtgcccagcagcacagagaagaatgccttccggcccggctctgtggtggtgcagctgaccctggccttccgggagggcaccatcaacgtgcatgatgtggagacccagttcaaccagtacaagacagaagctgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20568 - DNA, 501 bp, Artificial Sequence
  Description of Artificial Sequence: Synthetic coding sequence
atgaccccaggcacccagagccccttcttcctgctgctgctgctgactgtgctgacagccaccacagcccccaagccagccaccgtggtgactggaagtggccacgccagcagcaccccaggaggagagaaggagaccagcgccacccagaggagctctgtgcccagcagcacagagaagaatgccagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20569 - DNA, 612 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgccatcccagcccccaccaccaccaagagctgccgggagaccttcctgaagtgcttctgccgcttcatcaacaagggcgtcttctgggccagccccatcctgagctctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20570 - DNA, 507 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgccctgagcactggagtgtccttcttcttcctgtccttccacatcagcaacctgcagttcaacagcagcctggaggaccccagcacagactactaccaggagctgcagagggacatcagcgagatggctgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20571 - DNA, 768 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgccttcaacagcagcctggaggaccccagcacagactactaccaggagctgcagagggacatcagcgagatgttcctgcagatctacaagcagggcggcttcctgggcctgagcaacatcaagttccggcccggctctgtggtggtgcagctgaccctggccttccgggagggcaccatcaacgtgcatgatgtggagacccagttcaaccagtacaagacagaggccgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20572 - DNA, 795 bp, Artificial Sequence
  Description of Artificial Sequence: Synthetic coding sequence
atgaccccaggcacccagagccccttcttcctgctgctgctgctgactgtgctgacagccaccacagcccccaagccagccaccgtggtgactggaagtggccacgccagcagcaccccaggaggagagaaggagaccagcgccacccagaggagctctgtgcccagcagcacagagaagaatgccttcaacagcagcctggaggaccccagcacagactactaccaggagctgcagagggacatcagcgagatgttcctgcagatctacaagcagggcggcttcctgggcctgagcaacatcaagttccggcccggctctgtggtggtgcagctgaccctggccttccgggagggcaccatcaacgtgcatgatgtggagacccagttcaaccagtacaagacagaagctgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20573 - DNA, 597 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgccctgagcactggagtgtccttcttcttcctgtccttccacatcagcaacctgcagttcaacagcagcctggaggaccccagcacagactactaccaggagctgcagagggacatcagcgagatgttcctgcagatctacaagcagggcggcttcctgggcctgagcaacatcaagttccggcccggctctgtggtggtgcagctgaccctggccttccgggagggcaccatcaacgtgcatgatgtggagacccagttcaaccagtacaagacagaggccgccagccgctacaacctgaccatcagtgatgtgtctggctgcctgtctgtgccccccaaggagctgcgggctgctggccacctgagcagccctggctacctgcccagctatgagcgggtgccccacctgccccacccctgggccctgtgtgccccctag

SEQ ID NO: 20574 - DNA, 1428 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgctgtgtccatgaccagctctgtgctgagcagccacagccctggcagcggcagcagcaccacccagggccaggatgtgaccctggccccagccacagagcccgccagcggcagcgctgccacctggggccaggatgtgacctctgtgcctgtgaccaggcctgccctgggcagcaccaccccaccagcccatgatgtgaccagcgccccagacaacaagccagcccctggcagcacagcccccccagcccacggcgtgaccagcgccccagacaccaggcctgcccctggcagcacagcccccccagcccacggcgtgaccagcgccccagacaacagacctgccctgggcagcacagcccctcctgtgcacaacgtgaccagcgccagcggcagcgccagcggcagcgccagcaccctggtgcacaacggcaccagcgcccgggccaccaccaccccagccagcaagagcacccccttcagcatccccagccaccacagcgacacccccaccaccctggccagccacagcaccaagacagatgccagcagcacccaccacagcacagtgccccccctgaccagcagcaaccacagcaccagcccccagctgagcactggagtgtccttcttcttcctgtccttccacatcagcaacctgcagttcaacagcagcctggaggaccccagcacagactactaccaggagctgcagagggacatcagcgagatgttcctgcagatctacaagcagggcggcttcctgggcctgagcaacatcaagttccggcccggctctgtggtggtgcagctgaccctggccttccgggagggcaccatcaacgtgcatgatgtggagacccagttcaaccagtacaagacagaggccgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20575 - DNA, 480 bp, Artificial Sequence
  Description of Artificial Sequence: Synthetic coding sequence
atgaccccaggcacccagagccccttcttcctgctgctgctgctgactgtgctgacagccaccacagcccccaagccagccaccgtggtgactggaagtggccacgccagcagcaccccaggaggagagaaggagaccagcgccacccagaggagctctgtgcccagcagcacagagaagaatgccttcaacagcagcctggaggaccccagcacagactactaccaggagctgcagagggacatcagcgagatggctgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20576 - DNA, 693 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgccatcccagcccccaccaccaccaagagctgccgggagaccttcctgaagtggccaggctctgtggtggtgcagctgaccctggccttccgggagggcaccatcaacgtgcatgatgtggagacccagttcaaccagtacaagacagaagctgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20577 - DNA, 1686 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgctgtgtccatgaccagctctgtgctgagcagccacagccctggcagcggcagcagcaccacccagggccaggatgtgaccctggccccagccacagagcccgccagcggcagcgctgccacctggggccaggatgtgacctctgtgcctgtgaccaggcctgccctgggcagcaccaccccaccagcccatgatgtgaccagcgccccagacaccaggcctgcccctggcagcacagcccccccagcccacggcgtgaccagcgccccagacaccaggcctgcccctggcagcacagcccccccagcccacggcgtgaccagcgccccagacaccaggcctgcccctggcagcacagcccccccagcccacggcgtgaccagcgccccagacaccaggcctgcccctggcagcacagcccccccagcccacggcgtgaccagcgccccagacacccggcgggcccctggcagcaccccagcccctggcagcacagcccccccagcccacggcgtgaccagcgccccagacaccaggcctgcccctggcagcacagcccccccagcccacggcgtgaccagcgccccagacaacagacctgccctgggcagcacagcccctcctgtgcacaacgtgaccagcgccagcggcagcgccagcggcagcgccagcaccctggtgcacaacggcaccagcgcccgggccaccaccaccccagccagcaagagcacccccttcagcatccccagccaccacagcgacacccccaccaccctggccagccacagcaccaagacagatgccagcagcacccaccacagcacagtgccccccctgaccagcagcaaccacagcaccagcccccagctgagcactggagtgtccttcttcttcctgtccttccacatcagcaacctgcagttcaacagcagcctggaggaccccagcacagactactaccaggagctgcagagggacatcagcgagatgttcctgcagatctacaagcagggcggcttcctgggcctgagcaacatcaagttccggcccggctctgtggtggtgcagctgaccctggccttccgggagggcaccatcaacgtgcatgatgtggagacccagttcaaccagtacaagacagaggccgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20578 - DNA, 690 bp, Artificial Sequence
  Description of Artificial Sequence: Synthetic coding sequence
atgaccccaggcacccagagccccttcttcctgctgctgctgctgactgtgctgactgtggtgacaggcagcggccacgccagcagcaccccaggaggagagaaggagaccagcgccacccagaggagctctgtgcccagcagcacagagaagaatgccatctacaagcagggcggcttcctgggcctgagcaacatcaagttccggcccggctctgtggtggtgcagctgaccctggccttccgggagggcaccatcaacgtgcatgatgtggagacccagttcaaccagtacaagacagaggccgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaaggtgtctgctggaaatggaggcagcagcctgagctacaccaacccagctgtggccgccaccagcgccaacctgtag

SEQ ID NO: 20579 - DNA, 780 bp, Artificial Sequence
  Description of Artificial Sequence: Synthetic coding sequence
atgaccccaggcacccagagccccttcttcctgctgctgctgctgactgtgctgacagccaccacagcccccaagccagccaccgtggtgactggaagtggccacgccagcagcaccccaggaggagagaaggagaccagcgccacccagaggagctctgtgcccagcagcacagagaagaatgccttcaacagcagcctggaggaccccagcacagactactaccaggagctgcagagggacatcagcgagatgttcctgcagatctacaagcagggcggcttcctgggcctgagcaacatcaagttccggcccggctctgtggtggtgcagctgaccctggccttccgggagggcaccatcaacgtgcatgatgtggagacccagttcaaccagtacaagacagaagctgccagccgctacaacctgaccatcagtgatgtgtctgtgtctgatgtgcccttccccttcagcgcccagagcggggccggcgtgcccggctggggcatcgccctgctggtgctggtgtgtgtgctggtggccctggccatcgtgtacctgattgccctggccgtgtgccagtgcaggaggaagaactacggccagctggacatcttccctgcccgggacacctaccaccccatgtctgagtaccccacctaccacacccacggccgctacgtgccccccagcagcacagacaggagcccctatgagaagaggcagaatggctggagcaccatgcccaggggggccctgcctgaggagagccagggctag

SEQ ID NO: 20580 - DNA, 1833 bp, Artificial Sequence
  Description of Artificial Sequence: Synthetic coding sequence
atgggcctgaaggccgcccagaagaccctcttccccctgcggagcattgatgatgtggtgcggctgtttgctgctgagctgggccgggaggagccagacctggtgctgctgagcctggtgctgggctttgtggagcacttcctggccgtgaacagagtcatccccaccaacgtgcctgagctgaccttccagcccagccctgccccagaccccccaggcggcctgacctacttccctgtggccgacctgagcatcatcgccgccctgtatgcccgcttcaccgcccagatcagaggagctgtggacctgagcctgtacccccgggagggcggcgtgagcagccgggagctggtgaagaaggtgtctgatgtgatctggaacagcctgagccgcagctacttcaaggaccgggcccacatccagagcctcttctccttcatcaccggcaccaagctggacagcagtggagtggcctttgctgtggtgggcgcctgccaggccctgggcctgagagatgtgcacctggccctgtctgaagatcatgcctgggtggtgtttggccccaatggagagcagacagctgaggtgacctggcatggaaaaggaaatgaagatcggcggggccagacagtgaatgccggcgtggccgagaggtcctggctgtacctgaagggcagctacatgagatgtgacaggaagatggaggtggccttcatggtgtgtgccatcaaccccagcattgacctgcacacagacagcctggagctgctgcagctgcagcagaagctgctgtggctgctgtatgacctgggccacctggagcgctaccccatggccctgggcaacctggccgacctggaggagctggagcccaccccaggccgcccagaccccctgaccctgtaccacaagggcatcgccagcgccaagacctactacagagatgagcacatctacccctacatgtacctggccggctaccactgcaggaacagaaatgtgcgggaggccctgcaggcctgggccgacacagccaccgtcatccaggactacaactactgccgggaggatgaggagatctacaaggagttctttgaggtggccaatgatgtgatccccaacctgctgaaggaggccgccagcctgctggaggccggggaggagaggcctggagagcagagccagggcacccagagccagggcagcgccctgcaggaccctgagtgctttgcccacctgctgcgcttctatgatggcatctgcaagtgggaggagggcagccccacccctgtgctgcacgtgggctgggccaccttcctggtgcagagcctgggccgctttgagggccaggtgcggcagaaggtgagaattgtgtcccgggaggccgaggccgctgaggccgaggagccctggggcgaggaggcccgggagggcagaagaagaggcccccggcgggagagcaagccagaggagcccccaccacccaagaagccagccctggacaagggcctgggcaccggccagggcgctgtgtctggcccccccaggaagcccccaggcaccgtggccggcacagcccggggccctgagggcggcagcacagcccaggtgcctgcccccacagccagccccccacctgagggccctgtgctgaccttccagagcgagaagatgaagggcatgaaggagctgctggtggccaccaagatcaacagcagcgccatcaagctgcagctgacagcccagagccaggtgcagatgaagaagcagaaggtgtccacccccagcgactacaccctgtccttcctgaagaggcagaggaagggcctgtag

SEQ ID NO: 20581 - DNA, 1833 bp, Artificial Sequence; identical to SEQ ID NO: 20580
  Description of Artificial Sequence: Synthetic coding sequence

SEQ ID NO: 20582 - DNA, 1848 bp, Artificial Sequence
  Description of Artificial Sequence: Synthetic coding sequence
atgggcctgaaggccgcccagaagaccctcttccccctgcggagcattgatgatgtggtgcggctgtttgctgctgagctgggccgggaggagccagacctggtgctgctgagcctggtgctgggctttgtggagcacttcctggccgtgaacagagtcatccccaccaacgtgcctgagctgaccttccagcccagccctgccccagaccccccaggcggcctgacctacttccctgtggccgacctgagcatcatcgccgccctgtatgcccgcttcaccgcccagatcagaggagctgtggacctgagcctgtacccccgggagggcggcgtgagcagccgggagctggtgaagaaggtgtctgatgtgatctggaacagcctgagccgcagctacttcaaggaccgggcccacatccagagcctcttctccttcatcaccggctggagccctgtgggcaccaagctggacagcagcggcgtggcctttgctgtggtgggcgcctgccaggccctgggcctgagagatgtgcacctggccctgtctgaggaccacgcctgggtggtgtttggccccaacggggagcagacagctgaggtgacctggcacggcaaaggaaatgaagatagaagaggccagacagtgaatgctggggtggccgagaggtcctggctgtacctgaagggcagctacatgagatgtgacaggaagatggaggtggccttcatggtgtgtgccatcaaccccagcattgacctgcacacagacagcctggagctgctgcagctgcagcagaagctgctgtggctgctgtatgacctgggccacctggagcgctaccccatggccctgggcaacctggccgacctggaggagctggagcccaccccaggccgcccagaccccctgaccctgtaccacaagggcatcgccagcgccaagacctactacagagatgagcacatctacccctacatgtacctggccggctaccactgcaggaacagaaatgtgcgggaggccctgcaggcctgggccgacacagccaccgtcatccaggactacaactactgcagagaagatgaggagatctacaaggagttctttgaggtggccaatgatgtgatccccaacctgctgaaggaggccgccagcctgctggaggccggggaggagaggcctggagagcagagccagggcacccagagccagggcagcgccctgcaggaccctgaatgttttgcccacctgctgcgcttctatgatggcatctgcaagtgggaggagggcagccccacccctgtgctgcacgtgggctgggccaccttcctggtgcagagcctgggccgctttgagggccaggtgcggcagaaggtgcgcatcgtgtcccgggaggccgaggccgctgaggccgaggagccctggggcgaggaggcccgggagggcagaagaagaggcccccggcgggagagcaagccagaggagcccccaccacccaagaagccagccctggacaagggcctgggcaccggccagggcgctgtgtctggcccccccaggaagcccccaggcaccgtggccggcacagcccggggccctgagggcggcagcacagcccaggtgcctgcccccacagccagccccccacctgagggccctgtgctgaccttccagagcgagaagatgaagggcatgaaggagctgctggtggccaccaagatcaacagcagcgccatcaagctgcagctgacagcccagagccaggtgcagatgaagaagcagaaggtgtccacccccagcgactacaccctgtccttcctgaagaggcagaggaagggcctgtag

SEQ ID NO: 20583 - DNA, 1848 bp, Artificial Sequence; identical to SEQ ID NO: 20582
  Description of Artificial Sequence: Synthetic coding sequence

SEQ ID NO: 20584 - DNA, 1668 bp, Artificial Sequence
  Description of Artificial Sequence: Synthetic coding sequence
atgggcctgaaggccgcccagaagaccctcttccccctgcggagcattgatgatgtggtgcggctgtttgctgctgagctgggccgggaggagccagacctggtgctgctgagcctggtgctgggctttgtggagcacttcctggccgtgaacagagtcatccccaccaacgtgcctgagctgaccttccagcccagccctgccccagaccccccaggcggcctgacctacttccctgtggccgacctgagcatcatcgccgccctgtatgcccgcttcaccgcccagatcagaggagctgtggacctgagcctgtacccccgggagggcggcgtgagcagccgggagctggtgaagaaggtgtctgatgtgatctggaacagcctgagccgcagctacttcaaggaccgggcccacatccagagcctcttctccttcatcaccggcaccaagctggacagcagtggagtggcctttgctgtggtgggcgcctgccaggccctgggcctgagagatgtgcacctggccctgtctgaagatcatgcctgggtggtgtttggccccaatggagagcagacagctgaggtgacctggcatggaaaaggaaatgaagatcggcggggccagacagtgaatgccggcgtggccgagaggtcctggctgtacctgaagggcagctacatgagatgtgacaggaagatggaggtggccttcatggtgtgtgccatcaaccccagcattgacctgcacacagacagcctggagctgctgcagctgcagcagaagctgctgtggctgctgtatgacctgggccacctggagcgctaccccatggccctgggcaacctggccgacctggaggagctggagcccaccccaggccgcccagaccccctgaccctgtaccacaagggcatcgccagcgccaagacctactacagagatgagcacatctacccctacatgtacctggccggctaccactgcaggaacagaaatgtgcgggaggccctgcaggcctgggccgacacagccaccgtcatccaggactacaactactgccgggaggatgaggagatctacaaggagttctttgaggtggccaatgatgtgatccccaacctgctgaaggaggccgccagcctgctggaggccggggaggagaggcctggagagcagagccaggtgcggcagaaggtgcgcatcgtgtcccgggaggccgaggccgctgaggccgaggagccctggggcgaggaggcccgggagggcagaagaagaggcccccggcgggagagcaagccagaggagcccccaccacccaagaagccagccctggacaagggcctgggcaccggccagggcgctgtgtctggcccccccaggaagcccccaggcaccgtggccggcacagcccggggccctgagggcggcagcacagcccaggtgcctgcccccacagccagccccccacctgagggccctgtgctgaccttccagagcgagaagatgaagggcatgaaggagctgctggtggccaccaagatcaacagcagcgccatcaagctgcagctgacagcccagagccaggtgcagatgaagaagcagaaggtgtccacccccagcgactacaccctgtccttcctgaagaggcagaggaagggcctgtag

SEQ ID NO: 20585 - DNA, 1728 bp, Artificial Sequence
  Description of Artificial Sequence: Synthetic coding sequence
atgggcctgaaggccgcccagaagaccctcttccccctgcggagcattgatgatgtggtgcggctgtttgctgctgagctgggccgggaggagccagacctggtgctgctgagcctggtgctgggctttgtggagcacttcctggccgtgaacagagtcatccccaccaacgtgcctgagctgaccttccagcccagccctgccccagaccccccaggcggcctgacctacttccctgtggccgacctgagcatcatcgccgccctgtatgcccgcttcaccgcccagatcagaggagctgtggacctgagcctgtacccccgggagggcggcgtgagcagccgggagctggtgaagaaggtgtctgatgtgatctggaacagcctgagccgcagctacttcaaggaccgggcccacatccagagcctcttctccttcatcaccggcaccaagctggacagcagtggagtggcctttgctgtggtgggcgcctgccaggccctgggcctgagagatgtgcacctggccctgtctgaagatcatgcctggagctggctgtacctgaagggcagctacatgagatgtgacaggaagatggaggtggccttcatggtgtgtgccatcaaccccagcattgacctgcacacagacagcctggagctgctgcagctgcagcagaagctgctgtggctgctgtatgacctgggccacctggagcgctaccccatggccctgggcaacctggccgacctggaggagctggagcccaccccaggccgcccagaccccctgaccctgtaccacaagggcatcgccagcgccaagacctactacagagatgagcacatctacccctacatgtacctggccggctaccactgcaggaacagaaatgtgcgggaggccctgcaggcctgggccgacacagccaccgtcatccaggactacaactactgcagagaagatgaggagatctacaaggagttctttgaggtggccaatgatgtgatccccaacctgctgaaggaggccgccagcctgctggaggccggggaggagaggcctggagagcagagccagggcacccagagccagggcagcgccctgcaggaccctgaatgttttgcccacctgctgcgcttctatgatggcatctgcaagtgggaggagggcagccccacccctgtgctgcacgtgggctgggccaccttcctggtgcagagcctgggccgctttgagggccaggtgcggcagaaggtgcgcatcgtgtcccgggaggccgaggccgctgaggccgaggagccctggggcgaggaggcccgggagggcagaagaagaggcccccggcgggagagcaagccagaggagcccccaccacccaagaagccagccctggacaagggcctgggcaccggccagggcgctgtgtctggcccccccaggaagcccccaggcaccgtggccggcacagcccggggccctgagggcggcagcacagcccaggtgcctgcccccacagccagccccccacctgagggccctgtgctgaccttccagagcgagaagatgaagggcatgaaggagctgctggtggccaccaagatcaacagcagcgccatcaagctgcagctgacagcccagagccaggtgcagatgaagaagcagaaggtgtccacccccagcgactacaccctgtccttcctgaagaggcagaggaagggcctgtag

SEQ ID NO: 20586 - DNA, 1833 bp, Artificial Sequence; identical to SEQ ID NO: 20580
  Description of Artificial Sequence: Synthetic coding sequence

SEQ ID NO: 20587 - DNA, 1848 bp, Artificial Sequence; identical to SEQ ID NO: 20582
  Description of Artificial Sequence: Synthetic coding sequence

SEQ ID NO: 20588 - DNA, 1848 bp, Artificial Sequence; identical to SEQ ID NO: 20582
  Description of Artificial Sequence: Synthetic coding sequence

SEQ ID NO: 20589 - DNA, 786 bp, Artificial Sequence
  Description of Artificial Sequence: Synthetic coding sequence
atgggcctgaaggccgcccagaagaccctcttccccctgcggagcattgatgatgtggtgcggctgtttgctgctgagctgggccgggaggagccagacctggtgctgctgagcctggtgctgggctttgtggagcacttcctggccgtgaacagagtcatccccaccaacgtgcctgagctgaccttccagcccagccctgccccagaccccccaggcggcctgacctacttccctgtggccgacctgagcatcatcgccgccctgtatgcccgcttcaccgcccagatcagaggagctgtggacctgagcctgtacccccgggagggcggcgtgagcagccgggagctggtgaagaaggtgtctgatgtgatctggaacagcctgagccgcagctacttcaaggaccgggcccacatccagagcctcttctccttcatcaccggcaccaagctggacagcagtggagtggcctttgctgtggtgggcgcctgccaggccctgggcctgagagatgtgcacctggccctgtctgaagatcatgcctgggtggtgtttggccccaatggagagcagacagctgaggtgacctggcatggaaaaggaaatgaagatcggcggggccagacagtgaatgccggcgtggccgagaggtcctggctgtacctgaagggcagctacatgagatgtgacaggaagatggaggtggccttcatggtgtgtgccatcaaccccagcattgacctgcacacagacagcctggagctgctgcagctgcagcagtag

SEQ ID NO: 20590 - DNA, 441 bp, Artificial Sequence
  Description of Artificial Sequence: Synthetic coding sequence
atgggcctgaaggccgcccagaagaccctcttccccctgcggagcattgatgatgtggtgcggctgtttgctgctgagctgggccgggaggagccagacctggtgctgctgagcctggtgctgggctttgtggagcacttcctggccgtgaacagagtcatccccaccaacgtgcctgagctgaccttccagcccagccctgccccagaccccccaggcggcctgacctacttccctgtggccgacctgagcatcatcgccgccctgtatgcccgcttcaccgcccagatcagaggagctgtggacctgagcctgtacccccgggagggcggcgtgagcagccgggagctggtgaagaaggtgtctgatgtgatctggaacagcctgagccgcagctacttcaaggaccgggcccacatccagagcctcttctccttctag

SEQ ID NO: 20591 - DNA, 441 bp, Artificial Sequence; identical to SEQ ID NO: 20590
  Description of Artificial Sequence: Synthetic coding sequence

SEQ ID NO: 20592 - DNA, 1041 bp, Artificial Sequence
  Description of Artificial Sequence: Synthetic coding sequence
atgggcctgaaggccgcccagaagaccctcttccccctgcggagcattgatgatgtggtgcggctgtttgctgctgagctgggccgggaggagccagacctggtgctgctgagcctggtgctgggctttgtggagcacttcctggccgtgaacagagtcatccccaccaacgtgcctgagctgaccttccagcccagccctgccccagaccccccaggcggcctgacctacttccctgtggccgacctgagcatcatcgccgccctgtatgcccgcttcaccgcccagatcagaggagctgtggacctgagcctgtacccccgggagggcggcgtgagcagccgggagctggtgaagaaggtgtctgatgtgatctggaacagcctgagccgcagctacttcaaggaccgggcccacatccagagcctcttctccttcatcaccggcaccaagctggacagcagtggagtggcctttgctgtggtgggcgcctgccaggccctgggcctgagagatgtgcacctggccctgtctgaagatcatgcctgggtggtgtttggccccaatggagagcagacagctgaggtgacctggcatggaaaaggaaatgaagatcggcggggccagacagtgaatgccggcgtggccgagaggtcctggctgtacctgaagggcagctacatgagatgtgacaggaagatggaggtggccttcatggtgtgtgccatcaaccccagcattgacctgcacacagacagcctggagctgctgcagctgcagcagaagctgctgtggctgctgtatgacctgggccacctggagcgctaccccatggccctgggcaacctggccgacctggaggagctggagcccaccccaggccgcccagaccccctgaccctgtaccacaagggcatcgccagcgccaagacctactacagagatgagcacatctacccctacatgtacctggccggctaccactgcaggaacagaaatgtgcgggaggccctgcaggcctgggccgacacagccacctag

SEQ ID NO: 20593 - DNA, 1848 bp, Artificial Sequence; identical to SEQ ID NO: 20582
  Description of Artificial Sequence: Synthetic coding sequence

SEQ ID NO: 20594 - DNA, 846 bp, Artificial Sequence
  Description of Artificial Sequence: Synthetic coding sequence
atgggcctgaaggccgcccagaagaccctcttccccctgcggagcattgatgatgtggtgcggctgtttgctgctgagctgggccgggaggagccagacctggtgctgctgagcctggtgctgggctttgtggagcacttcctggccgtgaacagagtcatccccaccaacgtgcctgagctgaccttccagcccagccctgccccagaccccccaggcggcctgacctacttccctgtggccgacctgagcatcatcgccgccctgtatgcccgcttcaccgcccagatcagaggagctgtggacctgagcctgtacccccgggagggcggcgtgagcagccgggagctggtgaagaaggtgtctgatgtgatctggaacagcctgagccgcagctacttcaaggaccgggcccacatccagagcctcttctccttcatcaccggcaccaagctggacagcagtggagtggcctttgctgtggtgggcgcctgccaggccctgggcctgagagatgtgcacctggccctgtctgaagatcatgcctgggtggtgtttggccccaatggagagcagacagctgaggtgacctggcatggaaaaggaaatgaagatcggcggggccagacagtgaatgccggcgtggccgagaggtcctggctgtacctgaagggcagctacatgagatgtgacaggaagatggaggtggccttcatggtgtgtgccatcaaccccagcattgacctgcacacagacagcctggagctgctgcagctgcagcagaagctgctgtggctgctgtatgacctgggccacctggagcgctaccccatggccctgggctag

SEQ ID NO: 20595 - DNA, 1656 bp, Artificial Sequence
  Description of Artificial Sequence: Synthetic coding sequence
atggccgcccctgtgcggctgggcaggaagaggcccctgcctgcctgccccaaccccctgtttgtgcgctggctgacagagtggagagatgaggccaccaggagcagaagaaggaccaggtttgtgttccagaaggccctgcggagcctgcggcgctaccccctgcccctgcggagcggcaaggaggccaagatcctgcagcactttggagatggcctgtgcaggatgctggatgagcggctgcagaggcacaggaccagcggcggggaccacgccccagacagccccagcggggagaacagccctgccccccagggccgcctggccgaggtgcaggacagctccatgcctgtgcctgcccagcccaaggccggcggcagcggcagctactggccagcccggcacagcggggcccgggtcatcctgctggtgctgtaccgggagcacctgaaccccaacggccaccacttcctgaccaaggaggagctgctgcagagatgtgcccagaagagcccccgggtggcccctggcagcgcccggccctggccagccctgcggagcctgctgcacaggaacctggtgctgcggacccaccagcctgcccgctacagcctgaccccagagggcctggagctggcccagaagctggccgagagcgagggcctgagcctgctgaatgtgggcatcggccccaaggagcccccaggagaggagacagctgtgcctggggccgccagcgctgagctggccagcgaggccggcgtgcagcagcagcccctggagctgcggcctggagagtacagagtgctgctgtgtgtggacattggagagacccggggcggcggccacaggcctgagctgctgcgggagctgcagaggctgcacgtgacccacacagtgaggaagctgcacgtgggggactttgtgtgggtggcccaggagaccaacccccgggaccctgccaaccctggagagctggtgctggaccacatcgtggagaggaagaggctggatgacctgtgcagcagcatcattgatggccgcttccgggagcagaagttccggctgaagagatgtggcctggagaggagagtgtacctggtggaggagcacggctctgtgcacaacctgagcctgcctgagagcaccctgctgcaggccgtgaccaacacccaggtgattgatggcttctttgtgaagaggacagctgacatcaaggagagcgctgcctacctggccctgctgacccggggcctgcagaggctgtaccagggccacaccctgcggagccggccctggggcaccccaggcaaccctgagagcggggccatgaccagccccaaccccctgtgcagcctgctgaccttcagtgacttcaatgctggggccatcaagaacaaggcccagagcgtgcgggaggtgtttgcccggcagctgatgcaggtgcggggcgtgtctggagagaaggctgctgccctggtggaccgctacagcaccccagccagcctgctggccgcctatgatgcctgtgccacccccaaggagcaggagaccctgctgagcaccatcaagtgtggccgcctgcagaggaacctgggccctgccctgagcaggaccctgagccagctgtactgcagctatggccccctgacctag

SEQ ID NO: 20596 - DNA, 1656 bp, Artificial Sequence; identical to SEQ ID NO: 20595
  Description of Artificial Sequence: Synthetic coding sequence

SEQ ID NO: 20597 - DNA, 2490 bp, Artificial Sequence
  Description of Artificial Sequence: Synthetic coding sequence
atgaacagcggcgtggccatgaagtatggaaatgacagcagcgctgagctgtctgagctgcacagcgctgccctggccagcctgaagggggacatcgtggagctgaacaagaggctgcagcagacagagcgggagcgggacctgctggagaagaagctggccaaggcccagtgtgagcagagccacctgatgagggagcatgaagatgtgcaggagaggaccaccctgcgctatgaggagcgcatcacagagctgcacagcgtgattgctgagctgaacaagaagattgaccggctgcagggcaccaccatccgggaggaggatgagtacagcgagctgcggtctgagctgagccagagccagcacgaggtgaatgaagacagccgctccatggaccaggaccagacctctgtgtccatccctgagaaccagagcaccatggtgacagctgacatggacaactgcagcgacctgaacagcgagctgcagagggtgctgaccggcctggagaatgtggtgtgtggcaggaagaagagcagctgcagcctgtctgtggccgaggtggacaagcacatcgagcagctgaccacagccagcgagcactgtgacctggccatcaagacagtggaggagattgagggcgtgctgggccgggacctgtaccccaacctggccgaggagaggagccgctgggagaaggagctggccggcctgcgggaggagaatgaaagcctgacagccatgctgtgcagcaaggaggaggagctgaacagaaccaaggccaccatgaatgccatccgggaggagcgggaccggctgcggaggagagtgcgggagctgcagacccggctgcagagcgtgcaggccaccggccccagcagccctggccgcctgaccagcaccaaccggcccatcaaccccagcactggagagctgagcaccagcagcagcagcaatgacatccccatcgccaagattgctgagcgggtgaagctgagcaagaccaggtctgagagcagcagcagtgacaggcctgtgctgggcagcgagatcagcagcattggagtgagcagctctgtggccgagcacctggcccacagcctgcaggactgcagcaacatccaggagatcttccagaccctgtacagccacggcagcgccatcagcgagagcaagatccgggagtttgaggtggagacagagcggctgaacagcagaattgagcacctgaagagccagaatgacctgctgaccatcaccctggaggagtgcaagagcaatgctgagaggatgtccatgctggtgggcaagtatgagagcaatgccacagccctgcggctggccctgcagtacagcgagcagtgcatcgaggcctatgagctgctgctggccctggccgagagcgagcagagcctcatcctgggccagttccgggccgccggcgtgggcagcagccctggggaccagagcggagatgagaacatcacccagatgctgaagagggcccatgactgcaggaagacagcagaaaatgctgccaaggccctgctgatgaagctggatggcagctgtggcggggcctttgctgtggccggctgcagcgtgcagccctgggagagcctgagcagcaacagccacaccagcaccaccagcagcacagccagcagctgtgacacagagttcaccaaggaggatgagcagaggctgaaggactacatccagcagctgaagaatgacagagctgctgtgaagctgaccatgctggagctggagagcatccacatcgaccccctgtcctatgatgtgaagcccaggggggacagccagaggctggacctggagaatgctgtgctgatgcaggagctgatggccatgaaggaggagatggccgagctgaaggcccagctgtacctgctggagaaggagaagaaggccctggagctgaagctgagcacccgggaggcccaggagcaggcctacctggtgcacatcgagcacctgaagtctgaggtggaggagcagaaggagcagaggatgaggagcctgagcagcaccagcagcggcagcaaggacaagccaggcaaggaatgtgctgatgctgccagccctgccctgagcctggccgagctgcggaccacctgcagtgaaaatgagctggccgctgagttcaccaatgccatccggcgggagaagaagctgaaggcccgggtgcaggagctggtgtctgccctggagcggctgaccaagagcagcgagatccgccaccagcagagcgctgagtttgtgaatgacctgaagagggccaacagcaacctggtggccgcctatgagaaggccaagaagaagcaccagaacaagctgaagaagctggagagccagatgatggccatggtggagagacatgagacccaggtgaggatgctgaagcagagaattgccctgctggaggaggagaacagccggccccacaccaatgagaccagcctgtag

SEQ ID NO: 20598 - DNA, 2133 bp, Artificial Sequence
  Description of Artificial Sequence: Synthetic coding sequence
atgaagctggtgttcctggtgctgctcttcctgggcgccctgggcctgtgcctggccggcagaagaagatctgtgcagtggtgtgctgtgtcccagcctgaggccaccaagtgcttccagtggcagaggaacatgaggaaggtgcggggcccccctgtgtcctgcatcaagagggacagccccatccagtgcatccaggccatcgccgagaacagagcagatgctgtgaccctggatggcggcttcatctatgaggccggcctggccccctacaagctgcggcctgtggccgctgaggtgtatggaacagagcggcagcccaggacccactactatgctgtggccgtggtgaagaagggcggcagcttccagctgaatgagctgcagggcctgaagagctgccacacaggcctgcggaggacagctggctggaatgtgcccatcggcaccctgcggcccttcctgaactggacaggccccccagagcccatcgaggccgctgtggcccgcttcttcagcgccagctgtgtgcctggagctgacaagggccagttccccaacctgtgccgcctgtgtgccggcactggagaaaataaatgtgccttcagcagccaggagccctacttctcctacagcggggccttcaagtgcctgagagatggagctggagatgtggccttcatccgggagagcacagtgtttgaggacctgagtgatgaagctgagagagatgaatatgagctgctgtgcccagacaacaccaggaagcctgtggacaagttcaaggactgccacctggcccgggtgcccagccatgctgtggtggcccggtctgtgaatggcaaggaggatgccatctggaacctgctgcggcaggcccaggagaagtttgggaaggacaagagccccaagttccagctgtttggcagccccagcggccagaaggacctgctcttcaaggacagcgccatcggcttcagccgggtgcccccaagaattgattctggcctgtacctgggcagcggctacttcaccgccatccagaacctgaggaagtctgaggaggaggtggccgcccggcgggcccgggtggtgtggtgtgctgtgggggagcaggagctgaggaagtgcaaccagtggagcggcctgtctgagggctctgtgacctgcagcagcgccagcaccacagaggactgcatcgccctggtgctgaagggggaggctgatgccatgagcctggatggcggctacgtgtacacagctggaaaatgtggcctggtgcctgtgctggccgagaactacaagagccagcagagcagtgaccctgaccccaactgtgtggacaggcctgtggagggctacctggccgtggccgtggtgagaagaagtgacaccagcctgacctggaacagcgtgaagggcaagaagagctgccacacagctgtggacagaacagctggctggaacatccccatgggcctgctcttcaaccagacaggcagctgcaagtttgatgagtacttcagccagagctgtgcccctggcagtgaccccaggagcaacctgtgtgccctgtgcattggagatgagcagggagaaaataaatgtgtgcccaacagcaatgaaagatactacggctacaccggggccttccgctgcctggccgagaatgctggagatgtggcctttgtgaaggatgtgacagtgctgcagaacacagatggcaacaacaatgaggcctgggccaaggacctgaagctggccgactttgccctgctgtgcctggatggcaagaggaagcctgtgacagaggcccggagctgccacctggccatggcccccaaccacgctgtggtgtccaggatggacaaggtggagcggctgaagcaggtgctgctgcaccagcaggccaagtttggaagaaatggaagtgactgcccagacaagttctgcctcttccagagcgagaccaagaacctgctcttcaatgacaacacagaatgtctggcccggctgcacggcaagaccacctatgagaagtacctgggcccccagtatgtggccggcatcaccaacctgaagaagtgcagcaccagccccctgctggaggcctgtgagttcctgaggaagtag

SEQ ID NO: 20599 - DNA, 1656 bp, Artificial Sequence
  Description of Artificial Sequence: Synthetic coding sequence
aagcccctgctgaaccacgtgctggccatcaagggccccaggagccgctggaggaccttctacaacatcgccaccaggaggaaggccctgaagaaccccagcgaggagtatggcaagatcctggaggtggtgggccgctacagcgtgcacaatgccggcatctccttctctgtgaagaagcagggcgagaccgtggctgatgtgaggaccctgcccaatgccagcacagtggacaacatccgcagcatctttggaaatgctgtgtcccgggagctgattgaaattggctgtgaggacaagaccctggccttcaagatgaatggctacatcagcaatgccaactacagcgtgaagaagtgcatcttcctgctcttcatcaaccaccggctggtggagagcaccagcctgaggaaggccatcgagaccgtgtatgctgcctacctgcccaagaacacccaccccttcctgtacctgagcctggagatcagcccccagaatgtggatgtgaatgtgcaccccaccaagcatgaggtgcacttcctgcacgaggagagcatcctggagcgggtgcagcagcacatcgagagcaagctgctgggcagcaacagcagcaggatgtacttcacccagaccctgctgcccggcctggccggccccagcggggagatggtgaagagcaccaccagcctgaccagcagcagcaccagcggcagcagtgacaaggtgtatgcccaccagatggtgaggacagacagccgggagcagaagctggatgccttcctgcagcccctgagcaagcccctgagcagccagccccaggccatcgtgacagaggacaagacagacatcagcagcggccgggcccggcagcaggatgaggagatgctggagctgcctgccccagctgaggtggccgccaagaaccagagcctggagggggacaccaccaagggcaccagcgagatgtctgagaagaggggccccaccagcagcaaccccaggaagaggcacagagaagattctgatgtggagatggtggaggatgacagcaggaaggagatgacagctgcctgcaccccaagaagacgcatcatcaacctgacctctgtgctgagcctgcaggaggagatcaatgagcagggccacgaggtgctgcgggagatgctgcacaaccacagctttgtgggctgtgtgaacccccagtgggccctggcccagcaccagaccaagctgtacctgctgaacaccaccaagctgtctgaggagctgttctaccagatcctgatctatgactttgccaactttggagtgctgcggctgtctgagcccgcccccctgtttgacctggccatgctggccctggacagccctgagagcggctggacagaggaggatggccccaaggagggcctggccgagtacatcgtggagttcctgaagaagaaggccgagatgctggccgactacttcagcctggagattgatgaaagtgaggtgcccggcagcatccccaacagctggaagtggacagtggagcacatcgtgtacaaggccctgcggagccacatcctgccccccaagcacttcacagaagatggcaacatcctgcagctggccaacctgcctgacctgtacaaggtgtttgagcgctgctag

SEQ ID NO: 20600 - DNA, 351 bp, Artificial Sequence
  Description of Artificial Sequence: Synthetic coding sequence
atgtctgagaagaggggccccaccagcagcaaccccaggaagaggcaccgggaggacagtgatgtggagatggtggaggatgacagcaggaaggagatgacagctgcctgcaccccccggcggcgcatcatcaacctgacctctgtgctgagcctgcaggaggagatcaatgagcagggccacgaggtgctgcgggagatgctgcacaaccacagctttgtgggctgtgtgaacccccagtgggccctggcccagcaccagaccaagctgtacctgctgaacaccaccaagctgcgggtgaagtgcctggcccccttccagaccccaggcagcggcctgtggaacacctag

SEQ ID NO: 20601 - DNA, 525 bp, Artificial Sequence
  Description of Artificial Sequence: Synthetic coding sequence
atgtctgagaagaggggccccaccagcagcaaccccaggaagaggcaccgggaggacagtgatgtggagatggtggaggatgacagcaggaaggagatgacagctgcctgcaccccccggcggcgcatcatcaacctgacctctgtgctgagcctgcaggaggagatcaatgagcagggccacgaggtgctgcgggagatgctgcacaaccacagctttgtgggctgtgtgaacccccagccctggcacagcatcaagcccagctacaccttcagcaccccacccagcttcagcgaggagctgttctaccagatcctgatctatgactttgccaactttggagtgctgcggctgagcagcgaggtgcccggcagcatccccaacagctggaagtggacagtggagcacatcgtgtacaaggccctgcggagccacatcctgccccccaagcacttcacagaagatggcaacatcctgcagctggccaacctgcctgacctgtacaaggtgtttgagcgctgctag

SEQ ID NO: 20602 - DNA, 1977 bp, Artificial Sequence
  Description of Artificial Sequence: Synthetic coding sequence
atggcctttgaggccctggccagcatcagccacgtggcccacgtgaccatcaccaccaagacagcagatggaaaatgtgcctaccgggccagctacagtgatggcaagctgaaggccccacccaagccctgtgccggcaaccagggcacccagatcaccgtggaggacctcttctacaacatcgccaccaggaggaaggccctgaagaaccccagcgaggagtatggcaagatcctggaggtggtgggccgctacagcgtgcacaatgccggcatctccttctctgtgaagaagcagggcgagaccgtggctgatgtgaggaccctgcccaatgccagcacagtggacaacatccgcagcatctttggaaatgctgtgtcccgggagctgattgaaattggctgtgaggacaagaccctggccttcaagatgaatggctacatcagcaatgccaactacagcgtgaagaagtgcatcttcctgctcttcatcaaccaccggctggtggagagcaccagcctgaggaaggccatcgagaccgtgtatgctgcctacctgcccaagaacacccaccccttcctgtacctgagcctggagatcagcccccagaatgtggatgtgaatgtgcaccccaccaagcatgaggtgcacttcctgcacgaggagagcatcctggagcgggtgcagcagcacatcgagagcaagctgctgggcagcaacagcagcaggatgtacttcacccagaccctgctgcccggcctggccggccccagcggggagatggtgaagagcaccaccagcctgaccagcagcagcaccagcggcagcagtgacaaggtgtatgcccaccagatggtgaggacagacagccgggagcagaagctggatgccttcctgcagcccctgagcaagcccctgagcagccagccccaggccatcgtgacagaggacaagacagacatcagcagcggccgggcccggcagcaggatgaggagatgctggagctgcctgccccagctgaggtggccgccaagaaccagagcctggagggggacaccaccaagggcaccagcgagatgtctgagaagaggggccccaccagcagcaaccccaggaagaggcacagagaagattctgatgtggagatggtggaggatgacagcaggaaggagatgacagctgcctgcaccccaagaagacgcatcatcaacctgacctctgtgctgagcctgcaggaggagatcaatgagcagggccacgaggtgctgcgggagatgctgcacaaccacagctttgtgggctgtgtgaacccccagtgggccctggcccagcaccagaccaagctgtacctgctgaacaccaccaagctgtctgaggagctgttctaccagatcctgatctatgactttgccaactttggagtgctgcggctgtctgagcccgcccccctgtttgacctggccatgctggccctggacagccctgagagcggctggacagaggaggatggccccaaggagggcctggccgagtacatcgtggagttcctgaagaagaaggccgagatgctggccgactacttcagcctggagattgatgaggagggcaacctgattggcctgcccctgctgattgacaactacgtgccccccctggagggcctgcccatcttcatcctgcggctggccacagaggtgaactgggatgaggagaaggaatgttttgagagcctgagcaaagaatgtgccatgttctacagcatcaggaagcagtacatcagcgaggagagcaccctgagcggccagcagagcgaggtgcccggcagcatccccaacagctggaagtggacagtggagcacatcgtgtacaaggccctgcggagccacatcctgccccccaagcacttcacagaagatggcaacatcctgcagctggccaacctgcctgacctgtacaaggtgtttgagcgctgctag

SEQ ID NO: 20603 - DNA, 960 bp, Artificial Sequence
  Description of Artificial Sequence: Synthetic coding sequence
atgattgagaactgcctggatgccaagagcaccagcatccaggtgattgtgaaggagggcggcctgaagctgatccagatccaggacaatggcaccggcatcagaaaagaagacctggacatcgtgtgtgagcgcttcaccaccagcaagctgcagagctttgaggacctggccagcatcagcacctacggcttccggggggaggccctggccagcatcagccacgtggcccacgtgaccatcaccaccaagacagcagatggaaaatgtgcctaccgggccagctacagtgatggcaagctgaaggccccacccaagccctgtgccggcaaccagggcacccagatcaccgtggaggacctcttctacaacatcgccaccaggaggaaggccctgaagaaccccagcgaggagtatggcaagatcctggaggtggtgggccgctacagcgtgcacaatgccggcatctccttctctgtgaagaagcagggcgagaccgtggctgatgtgaggaccctgcccaatgccagcacagtggacaacatccgcagcatctttggaaatgctgtgtcccgggagctgattgaaattggctgtgaggacaagaccctggccttcaagatgaatggctacatcagcaatgccaactacagcgtgaagaagtgcatcttcctgctcttcatcaaccaccggctggtggagagcaccagcctgaggaaggccatcgagaccgtgtatgctgcctacctgcccaagaacacccaccccttcctgtacctgagcctggagatcagcccccagaatgtggatgtgaatgtgcaccccaccaagcatgaggtgcacttcctgcacgaggagagcatcctggagcgggtgcagcagcacatcgagagcaagctgctgggcagcaacagcagcaggatgtacttcacccagaaggagaccagcggccgcttctag

SEQ ID NO: 20604 - DNA, 1548 bp, Artificial Sequence
  Description of Artificial Sequence: Synthetic coding sequence
atgaatggctacatcagcaatgccaactacagcgtgaagaagtgcatcttcctgctcttcatcaaccaccggctggtggagagcaccagcctgaggaaggccattgaaacagtgtatgctgcctacctgcccaagaacacccaccccttcctgtacctgagcctggagatcagcccccagaatgtggatgtgaatgtgcaccccaccaagcatgaggtgcacttcctgcacgaggagagcatcctggagcgggtgcagcagcacatcgagagcaagctgctgggcagcaacagcagcaggatgtacttcacccagaccctgctgcccggcctggccggccccagcggggagatggtgaagagcaccaccagcctgaccagcagcagcaccagcggcagcagtgacaaggtgtatgcccaccagatggtgaggacagacagccgggagcagaagctggatgccttcctgcagcccctgagcaagcccctgagcagccagccccaggccatcgtgacagaggacaagacagacatcagcagcggccgggcccggcagcaggatgaggagatgctggagctgcctgccccagctgaggtggccgccaagaaccagagcctggagggggacaccaccaagggcaccagcgagatgtctgagaagaggggccccaccagcagcaaccccaggaagaggcaccgggaggacagtgatgtggagatggtggaggatgacagcaggaaggagatgacagctgcctgcaccccccggcggcgcatcatcaacctgacctctgtgctgagcctgcaggaggagatcaatgagcagggccacgaggtgctgcgggagatgctgcacaaccacagctttgtgggctgtgtgaacccccagtgggccctggcccagcaccagaccaagctgtacctgctgaacaccaccaagctgtctgaggagctgttctaccagatcctgatctatgactttgccaactttggagtgctgcggctgtctgagcccgcccccctgtttgacctggccatgctggccctggacagccctgagagcggctggacagaagaagatggccccaaggagggcctggccgagtacatcgtggagttcctgaagaagaaggccgagatgctggccgactacttcagcctggagattgatgaggagggcaacctgattggcctgcccctgctgattgacaactacgtgccccccctggagggcctgcccatcttcatcctgcggctggccacagaggtgaactgggatgaggagaaggagtgctttgagagcctgagcaaagaatgtgccatgttctacagcatcaggaagcagtacatcagcgaggagagcaccctgagcggccagcagagcgaggtgcccggcagcatccccaacagctggaagtggacagtggagcacatcgtgtacaaggccctgcggagccacatcctgccccccaagcacttcacagaagatggcaacatcctgcagctggccaacctgcctgacctgtacaaggtgtttgagcgctgctag

SEQ ID NO: 20605 - DNA, 2040 bp, Artificial Sequence
  Description of Artificial Sequence: Synthetic coding sequence
tgaagactggatgagaccgtggtgaacagaattgctgctggggaggtgatccagaggcctgccaatgccatcaaggagatgattgagaactgcctggatgccaagagcaccagcatccaggtgattgtgaaggagggcggcctgaagctgatccagatccaggacaatggcaccggcatcagaaaagaagacctggacatcgtgtgtgagcgcttcaccaccagcaagctgcagagctttgaggacctggccagcatcagcacctacggcttccggggggaggccctggccagcatcagccacgtggcccacgtgaccatcaccaccaagacagcagatggaaaatgtgcctaccgggccagctacagtgatggcaagctgaaggccccacccaagccctgtgccggcaaccagggcacccagatcaccgtggaggacctcttctacaacatcgccaccaggaggaaggccctgaagaaccccagcgaggagtatggcaagatcctggaggtggtgggccgctacagcgtgcacaatgccggcatctccttctctgtgaagaagcagggcgagaccgtggctgatgtgaggaccctgcccaatgccagcacagtggacaacatccgcagcatctttggaaatgctgtgtcccgggagctgattgaaattggctgtgaggacaagaccctggccttcaagatgaatggctacatcagcaatgccaactacagcgtgaagaagtgcatcttcctgctcttcatcaaccaccggctggtggagagcaccagcctgaggaaggccatcgagaccgtgtatgctgcctacctgcccaagaacacccaccccttcctgtacctgagcctggagatcagcccccagaatgtggatgtgaatgtgcaccccaccaagcatgaggtgcacttcctgcacgaggagagcatcctggagcgggtgcagcagcacatcgagagcaagctgctgggcagcaacagcagcaggatgtacttcacccagaccctgctgcccggcctggccggccccagcggggagatggtgaagagcaccaccagcctgaccagcagcagcaccagcggcagcagtgacaaggtgtatgcccaccagatggtgaggacagacagccgggagcagaagctggatgccttcctgcagcccctgagcaagcccctgagcagccagccccaggccatcgtgacagaggacaagacagacatcagcagcggccgggcccggcagcaggatgaggagatgctggagctgcctgccccagctgaggtggccgccaagaaccagagcctggagggggacaccaccaagggcaccagcgagatgtctgagaagaggggccccaccagcagcaaccccaggaagaggcacagagaagattctgatgtggagatggtggaggatgacagcaggaaggagatgacagctgcctgcaccccaagaagacgcatcatcaacctgacctctgtgctgagcctgcaggaggagatcaatgagcagggccacgaggtgctgcgggagatgctgcacaaccacagctttgtgggctgtgtgaacccccagtgggccctggcccagcaccagaccaagctgtacctgctgaacaccaccaagctgtctgaggagctgttctaccagatcctgatctatgactttgccaactttggagtgctgcggctgtctgagcccgcccccctgtttgacctggccatgctggccctggacagccctgagagcggctggacagaggaggatggccccaaggagggcctggccgagtacatcgtggagttcctgaagaagaaggccgagatgctggccgactacttcagcctggagattgatgaaagtgaggtgcccggcagcatccccaacagctggaagtggacagtggagcacatcgtgtacaaggccctgcggagccacatcctgccccccaagcacttcacagaagatggcaacatcctgcagctggccaacctgcctgacctgtacaaggtgtttgagcgctgctag

SEQ ID NO: 20606 - DNA, 1548 bp, Artificial Sequence; identical to SEQ ID NO: 20604
  Description of Artificial Sequence: Synthetic coding sequence

SEQ ID NO: 20607 - DNA, 1383 bp, Artificial Sequence
  Description of Artificial Sequence: Synthetic coding sequence
atgaatggctacatcagcaatgccaactacagcgtgaagaagtgcatcttcctgctcttcatcaaccaccggctggtggagagcaccagcctgaggaaggccattgaaacagtgtatgctgcctacctgcccaagaacacccaccccttcctgtacctgagcctggagatcagcccccagaatgtggatgtgaatgtgcaccccaccaagcatgaggtgcacttcctgcacgaggagagcatcctggagcgggtgcagcagcacatcgagagcaagctgctgggcagcaacagcagcaggatgtacttcacccagaccctgctgcccggcctggccggccccagcggggagatggtgaagagcaccaccagcctgaccagcagcagcaccagcggcagcagtgacaaggtgtatgcccaccagatggtgaggacagacagccgggagcagaagctggatgccttcctgcagcccctgagcaagcccctgagcagccagccccaggccatcgtgacagaggacaagacagacatcagcagcggccgggcccggcagcaggatgaggagatgctggagctgcctgccccagctgaggtggccgccaagaaccagagcctggagggggacaccaccaagggcaccagcgagatgtctgagaagaggggccccaccagcagcaaccccaggaagaggcaccgggaggacagtgatgtggagatggtggaggatgacagcaggaaggagatgacagctgcctgcaccccccggcggcgcatcatcaacctgacctctgtgctgagcctgcaggaggagatcaatgagcagggccacgaggtgctgcgggagatgctgcacaaccacagctttgtgggctgtgtgaacccccagtgggccctggcccagcaccagaccaagctgtacctgctgaacaccaccaagctgtctgaggagctgttctaccagatcctgatctatgactttgccaactttggagtgctgcggctgtctgagcccgcccccctgtttgacctggccatgctggccctggacagccctgagagcggctggacagaagaagatggccccaaggagggcctggccgagtacatcgtggagttcctgaagaagaaggccgagatgctggccgactacttcagcctggagattgatgaggagggcaacctgattggcctgcccctgctgattgacaactacgtgccccccctggagggcctgcccatcttcatcctgcggctggccacagaggtgaactgggatgaggagaaggagtgctttgagagcctgagcaaagaatgtgccatgttctacagcatcaggaagcagtacatcagcgaggagagcaccctgagcggccagcagtag

SEQ ID NO: 20608 - DNA, 843 bp, Artificial Sequence
  Description of Artificial Sequence: Synthetic coding sequence
atgattgagaactgcctggatgccaagagcaccagcatccaggtgattgtgaaggagggcggcctgaagctgatccagatccaggacaatggcaccggcatcagaaaagaagacctggacatcgtgtgtgagcgcttcaccaccagcaagctgcagagctttgaggacctggccagcatcagcacctacggcttccggggggaggccctggccagcatcagccacgtggcccacgtgaccatcaccaccaagacagcagatggaaaatgtgcctaccgggccagctacagtgatggcaagctgaaggccccacccaagccctgtgccggcaaccagggcacccagatcaccgtggaggacctcttctacaacatcgccaccaggaggaaggccctgaagaaccccagcgaggagtatggcaagatcctggaggtggtgggccgctacagcgtgcacaatgccggcatctccttctctgtgaagaagcagggcgagaccgtggctgatgtgaggaccctgcccaatgccagcacagtggacaacatccgcagcatctttggaaatgctgtgtcccgggagctgattgaaattggctgtgaggacaagaccctggccttcaagatgaatggctacatcagcaatgccaactacagcgtgaagaagtgcatcttcctgctcttcatcaaccaccggctggtggagagcaccagcctgaggaaggccatcgagaccgtgtatgctgcctacctgcccaagaacacccaccccttcctgtacctgcggctgtgctaccaggacctgctggcccccctgggccgctggctgaacccccagcaggtgtag

SEQ ID NO: 20609 - DNA, 1548 bp, Artificial Sequence; identical to SEQ ID NO: 20604
  Description of Artificial Sequence: Synthetic coding sequence

SEQ ID NO: 20610 - DNA, 4290 bp, Artificial Sequence
  Description of Artificial Sequence: Synthetic coding sequence
atgatcaagtgcctgtctgtggaggtgcaggccaagctgcggagcggcctggccatcagcagcctgggccagtgtgtggaggagctggccctgaacagcattgatgctgaggccaagtgtgtggccgtgcgggtgaacatggagaccttccaggtgcaggtgattgacaatggatttggcatgggcagtgatgatgtggagaaggtgggcaaccgctacttcaccagcaagtgccacagcgtgcaggacctggagaacccccgcttctacggcttccggggggaggccctggccaacattgctgacatggccagcgctgtggagatcagcagcaagaagaacagaaccatgaagacctttgtgaagctgttccagagcggcaaggccctgaaggcctgtgaggctgatgtgacccgggccagcgctggcaccaccgtgacagtgtacaacctcttctaccagctgcctgtgcggaggaagtgcatggacccccggctggagtttgagaaggtgcggcagagaattgaggccctgagcctgatgcaccccagcatctccttcagcctgagaaatgatgtgtctggctccatggtgctgcagctgcccaagaccaaggatgtgtgcagccgcttctgccagatctacggcctgggcaagagccagaagctgcgggagatctccttcaagtacaaggagtttgagctgagcggctacatcagcagcgaggcccactacaacaagaacatgcagttcctgtttgtgaacaagaggctggtgctgcggaccaagctgcacaagctgattgacttcctgctgaggaaggagagcatcatctgcaagcccaagaatggccccaccagccggcagatgaacagcagcctgcggcacaggagcaccccagagctgtatggcatctacgtgatcaacgtgcagtgccagttctgtgaatatgatgtgtgcatggagcccgccaagaccctcatcgagttccagaactgggacaccctgctcttctgcatccaggagggcgtgaagatgttcctgaagcaggagaagctgtttgtggagctgagcggggaggacatcaaggagttctctgaagataatggcttcagcctgtttgatgccaccctgcagaagagggtgaccagtgatgagaggagcaacttccaggaggcctgcaacaacatcctggacagctatgagatgttcaacctgcagagcaaggctgtgaagaggaagaccacagcagaaaatgtgaacacccagagcagccgggacagcgaggccaccaggaagaacaccaatgatgccttcctgtacatctatgaaagtggcggccctggccacagcaagatgacagagcccagcctgcagaacaaggacagcagctgcagcgagagcaagatgctggagcaggagaccatcgtggccagcgaggccggagaaaatgagaagcacaagaagagcttcctggagcacagcagcctggagaacccctgtggcaccagcctggagatgttcctgagccccttccagaccccctgccactttgaggagagcggccaggacctggagatctggaaggagagcaccaccgtgaatggcatggccgccaacatcctgaagaacaaccgcatccagaaccagcccaagcgcttcaaggatgccacagaggtgggctgccagcccctgccctttgccaccaccctgtggggcgtgcacagcgcccagacagagaaggagaagaagaaggagagcagcaactgtggcagaagaaatgtgttctcctatggccgggtgaagctgtgcagcacaggcttcatcacccacgtggtgcagaatgagaagaccaagagcacagaaacagagcacagcttcaagaactacgtgcggcccggccccacccgggcccaggagaccttcggcaacagaaccaggcacagcgtggagaccccagacatcaaggacctggccagcaccctgagcaaggagagcggccagctgcccaacaagaagaactgcaggaccaacatctcctatggcctggagaatgagcccacagccacctacaccatgttttctgccttccaggagggcagcaagaagagccagacagactgcatcctgagtgacaccagccccagcttcccctggtaccgccacgtgtccaatgacagcaggaagacagacaagctgattggcttcagcaagcccatcgtgaggaagaagctgagcctgagcagccagctgggcagcctggagaagttcaagaggcagtatggcaaggtggagaaccccctggacacagaggtggaggagagcaatggagtgaccaccaacctgagcctgcaggtggagccagacatcctgctgaaggacaagaaccggctggagaacagtgatgtgtgcaagatcaccaccatggagcacagcgacagcgacagcagctgccagcctgccagccacatcctgaacagcgagaagttccccttcagcaaggatgaggactgcctggagcagcagatgcccagcctgcgggagagccccatgaccctgaaggagctgagcctcttcaacaggaagcccctggacctggagaagagcagcgagagcctggccagcaagctgagccggctgaagggcagcgagcgggagacccagaccatgggcatgatgagccgcttcaatgagctgcccaacagcgacagcagcaggaaggacagcaagctgtgcagcgtgctgacccaggacttctgcatgctgttcaacaacaagcatgagaagacagaaaatggagtcatccccaccagtgacagcgccacccaggacaacagcttcaacaagaacagcaagacccacagcaacagcaacaccacagagaactgtgtgatcagcgagacccccctggtgctgccctacaacaacagcaaggtgacaggcaaggacagtgatgtgctgatccgggccagcgagcagcagatcggcagcctggacagccccagcggcatgctgatgaaccctgtggaggatgccactggagaccagaatggcatctgcttccagagcgaggagagcaaggcccgggcctgcagcgagacagaggagagcaacacctgctgcagcgactggcagaggcactttgatgtggccctgggccgcatggtgtatgtgaacaagatgacaggcctgagcaccttcatcgcccccacagaggacatccaggccgcctgcaccaaggacctgaccaccgtggccgtggatgtggtgctggagaatggcagccagtaccgctgccagcccttcagaagtgacctggtgctgcccttcctgccccgggcccgggcagagaggacagtgatgaggcaggacaacagagacacagtggatgacacagtgtcctctgagagcctgcagagcctcttcagcgagtgggacaaccctgtgtttgcccgctacccagaggtggccgtggatgtgagcagcggccaggccgagagcctggccgtgaagatccacaacatcctgtacccctaccgcttcaccaagggcatgatccacagcatgcaggtgctgcagcaggtggacaacaagttcatcgcctgcctgatgagcaccaagacagaggagaatggagaggccgacagctatgagaagcagcaggcccagggcagcggcaggaagaagctgctgagcagcaccctcatcccccccctggagatcaccgtgacagaggagcagaggcggctgctgtggtgctaccacaagaacctggaggacctgggcctggagtttgtgtttcctgacaccagtgacagcctggtgctggtgggcaaggtgcccctgtgctttgtggagcgggaggccaatgagctgcggcggggccgcagcacagtgaccaagagcatcgtggaggagttcatccgggagcagctggagctgctgcagaccaccggcggcatccagggcaccctgcccctgactgtgcagaaggtgctggccagccaggcctgccacggggccatcaagttcaatgatggcctgagcctgcaggagagctgccgcctgattgaggccctgagcagctgccagctgcccttccagtgtgcccacggccggcccagcatgctgcccctggccgacatcgaccacctggagcaggagaagcagatcaagcccaacctgaccaagctgaggaagatggcccaggcctggaggctgtttgggaaggccgagtgtgacacccggcagagcctgcagcagagcatgccaccctgtgagcccccatag

SEQ ID NO: 20611 - DNA, 4362 bp, Artificial Sequence
  Description of Artificial Sequence: Synthetic coding sequence
atgatcaagtgcctgtctgtggaggtgcaggccaagctgcggagcggcctggccatcagcagcctgggccagtgtgtggaggagctggccctgaacagcattgatgctgaggccaagtgtgtggccgtgcgggtgaacatggagaccttccaggtgcaggtgattgacaatggatttggcatgggcagtgatgatgtggagaaggtgggcaaccgctacttcaccagcaagtgccacagcgtgcaggacctggagaacccccgcttctacggcttccggggggaggccctggccaacattgctgacatggccagcgctgtggagatcagcagcaagaagaacagaaccatgaagacctttgtgaagctgttccagagcggcaaggccctgaaggcctgtgaggctgatgtgacccgggccagcgctggcaccaccgtgacagtgtacaacctcttctaccagctgcctgtgcggaggaagtgcatggacccccggctggagtttgagaaggtgcggcagagaattgaggccctgagcctgatgcaccccagcatctccttcagcctgagaaatgatgtgtctggctccatggtgctgcagctgcccaagaccaaggatgtgtgcagccgcttctgccagatctacggcctgggcaagagccagaagctgcgggagatctccttcaagtacaaggagtttgagctgagcggctacatcagcagcgaggcccactacaacaagaacatgcagttcctgtttgtgaacaagaggctggtgctgcggaccaagctgcacaagctgattgacttcctgctgaggaaggagagcatcatctgcaagcccaagaatggccccaccagccggcagatgaacagcagcctgcggcacaggagcaccccagagctgtatggcatctacgtgatcaacgtgcagtgccagttctgtgaatatgatgtgtgcatggagcccgccaagaccctcatcgagttccagaactgggacaccctgctcttctgcatccaggagggcgtgaagatgttcctgaagcaggagaagctgtttgtggagctgagcggggaggacatcaaggagttctctgaagataatggcttcagcctgtttgatgccaccctgcagaagagggtgaccagtgatgagaggagcaacttccaggaggcctgcaacaacatcctggacagctatgagatgttcaacctgcagagcaaggctgtgaagaggaagaccacagcagaaaatgtgaacacccagagcagccgggacagcgaggccaccaggaagaacaccaatgatgccttcctgtacatctatgaaagtggcggccctggccacagcaagatgacagagcccagcctgcagaacaaggacagcagctgcagcgagagcaagatgctggagcaggagaccatcgtggccagcgaggccggagaaaatgagaagcacaagaagagcttcctggagcacagcagcctggagaacccctgtggcaccagcctggagatgttcctgagccccttccagaccccctgccactttgaggagagcggccaggacctggagatctggaaggagagcaccaccgtgaatggcatggccgccaacatcctgaagaacaaccgcatccagaaccagcccaagcgcttcaaggatgccacagaggtgggctgccagcccctgccctttgccaccaccctgtggggcgtgcacagcgcccagacagagaaggagaagaagaaggagagcagcaactgtggcagaagaaatgtgttctcctatggccgggtgaagctgtgcagcacaggcttcatcacccacgtggtgcagaatgagaagaccaagagcacagaaacagagcacagcttcaagaactacgtgcggcccggccccacccgggcccaggagaccttcggcaacagaaccaggcacagcgtggagaccccagacatcaaggacctggccagcaccctgagcaaggagagcggccagctgcccaacaagaagaactgcaggaccaacatctcctatggcctggagaatgagcccacagccacctacaccatgttttctgccttccaggagggcagcaagaagagccagacagactgcatcctgagtgacaccagccccagcttcccctggtaccgccacgtgtccaatgacagcaggaagacagacaagctgattggcttcagcaagcccatcgtgaggaagaagctgagcctgagcagccagctgggcagcctggagaagttcaagaggcagtatggcaaggtggagaaccccctggacacagaggtggaggagagcaatggagtgaccaccaacctgagcctgcaggtggagccagacatcctgctgaaggacaagaaccggctggagaacagtgatgtgtgcaagatcaccaccatggagcacagcgacagcgacagcagctgccagcctgccagccacatcctgaacagcgagaagttccccttcagcaaggatgaggactgcctggagcagcagatgcccagcctgcgggagagccccatgaccctgaaggagctgagcctcttcaacaggaagcccctggacctggagaagagcagcgagagcctggccagcaagctgagccggctgaagggcagcgagcgggagacccagaccatgggcatgatgagccgcttcaatgagctgcccaacagcgacagcagcaggaaggacagcaagctgtgcagcgtgctgacccaggacttctgcatgctgttcaacaacaagcatgagaagacagaaaatggagtcatccccaccagtgacagcgccacccaggacaacagcttcaacaagaacagcaagacccacagcaacagcaacaccacagagaactgtgtgatcagcgagacccccctggtgctgccctacaacaacagcaaggtgacaggcaaggacagtgatgtgctgatccgggccagcgagcagcagatcggcagcctggacagccccagcggcatgctgatgaaccctgtggaggatgccactggagaccagaatggcatctgcttccagagcgaggagagcaaggcccgggcctgcagcgagacagaggagagcaacacctgctgcagcgactggcagaggcactttgatgtggccctgggccgcatggtgtatgtgaacaagatgacaggcctgagcaccttcatcgcccccacagaggacatccaggccgcctgcaccaaggacctgaccaccgtggccgtggatgtggtgctggagaatggcagccagtaccgctgccagcccttcagaagtgacctggtgctgcccttcctgccccgggcccgggcagagaggacagtgatgaggcaggacaacagagacacagtggatgacacagtgtcctctgagagcctgcagagcctcttcagcgagtgggacaaccctgtgtttgcccgctacccagaggtggccgtggatgtgagcagcggccaggccgagagcctggccgtgaagatccacaacatcctgtacccctaccgcttcaccaagggcatgatccacagcatgcaggtgctgcagcaggtggacaacaagttcatcgcctgcctgatgagcaccaagacagaggagaatggagaggccggcggcaacctgctggtgctggtggaccagcacgccgcccacgagcgcatccggctggagcagctgatcatcgacagctatgagaagcagcaggcccagggcagcggcaggaagaagctgctgagcagcaccctcatcccccccctggagatcaccgtgacagaggagcagaggcggctgctgtggtgctaccacaagaacctggaggacctgggcctggagtttgtgtttcctgacaccagtgacagcctggtgctggtgggcaaggtgcccctgtgctttgtggagcgggaggccaatgagctgcggcggggccgcagcacagtgaccaagagcatcgtggaggagttcatccgggagcagctggagctgctgcagaccaccggcggcatccagggcaccctgcccctgactgtgcagaaggtgctggccagccaggcctgccacggggccatcaagttcaatgatggcctgagcctgcaggagagctgccgcctgattgaggccctgagcagctgccagctgcccttccagtgtgcccacggccggcccagcatgctgcccctggccgacatcgaccacctggagcaggagaagcagatcaagcccaacctgaccaagctgaggaagatggcccaggcctggaggctgtttgggaaggccgagtgtgacacccggcagagcctgcagcagagcatgccaccctgtgagcccccatag

SEQ ID NO: 20612 - DNA, 1176 bp, Artificial Sequence
  Description of Artificial Sequence: Synthetic coding sequence
atggtgtatgtgaacaagatgacaggcctgagcaccttcatcgcccccacagaggacatccaggccgcctgcaccaaggacctgaccaccgtggccgtggatgtggtgctggagaatggcagccagtaccgctgccagcccttcagaagtgacctggtgctgcccttcctgccccgggcccgggcagagaggacagtgatgaggcaggacaacagagacacagtggatgacacagtgtcctctgagagcctgcagagcctcttcagcgagtgggacaaccctgtgtttgcccgctacccagaggtggccgtggatgtgagcagcggccaggccgagagcctggccgtgaagatccacaacatcctgtacccctaccgcttcaccaagggcatgatccacagcatgcaggtgctgcagcaggtggacaacaagttcatcgcctgcctgatgagcaccaagacagaggagaatggagaggccggcggcaacctgctggtgctggtggaccagcacgccgcccacgagcgcatccggctggagcagctgatcatcgacagctatgagaagcagcaggcccagggcagcggcaggaagaagctgctgagcagcaccctcatcccccccctggagatcaccgtgacagaggagcagaggcggctgctgtggtgctaccacaagaacctggaggacctgggcctggagtttgtgtttcctgacaccagtgacagcctggtgctggtgggcaaggtgcccctgtgctttgtggagcgggaggccaatgagctgcggcggggccgcagcacagtgaccaagagcatcgtggagctgctgcagaccaccggcggcatccagggcaccctgcccctgactgtgcagaaggtgctggccagccaggcctgccacggggccatcaagttcaatgatggcctgagcctgcaggagagctgccgcctgattgaggccctgagcagctgccagctgcccttccagtgtgcccacggccggcccagcatgctgcccctggccgacatcgaccacctggagcaggagaagcagatcaagcccaacctgaccaagctgaggaagatggcccaggcctggaggctgtttgggaaggccgagtgtgacacccggcagagcctgcagcagagcatgccaccctgtgagcccccatag

SEQ ID NO: 20613 - DNA, 597 bp, Artificial Sequence
  Description of Artificial Sequence: Synthetic coding sequence
atgaaccctgtggaggatgccaccggggaccagaatggcatctgcttccagagcgaggagagcaaggcccgggcctgcagcgagacagaggagagcaacacctgctgcagcgactggcagaggcactttgatgtggccctgggccgcatggtgtatgtgaacaagatgacaggcctgagcaccttcatcgcccccacagaggacatccaggccgcctgcaccaaggacctgaccaccgtggccgtggatgtggtgctggagaatggcagccagtaccgctgccagcccttcagaagtgacctggtgctgcccttcctgccccgggcccgggcagagaggacagtgatgaggcaggacaacagagacacagtggatgacacagtgagcagcgagagcctgcagagcctcttcagcgagtgggacaaccctgtgtttgcccgctacccagaggtgctgcagcaggtggacaacaagttcatcgcctgcctgatgagcaccaagacagaggagaatggagaggccgctgagctgatgatgctgcaggacccctgctgccggcagagccgggaggatgagaaccacgagttcagcctgtag

SEQ ID NO: 20614 - DNA, 489 bp, Artificial Sequence
  Description of Artificial Sequence: Synthetic coding sequence
atgatcaagtgcctgtctgtggaggtgcaggccaagctgcggagcggcctggccatcagcagcctgggccagtgtgtggaggagctggccctgaacagcattgatgctgaggccaagtgtgtggccgtgcgggtgaacatggagaccttccaggtgcaggtgattgacaatggatttggcatgggcagtgatgatgtggagaaggtgggcaaccgctacttcaccagcaagtgccacagcgtgcaggacctggagaacccccgcttctacggcttccggggggaggccctggccaacattgctgacatggccagcgctgtggagatcagcagcaagaagaacagaaccatgaagacctttgtgaagctgttccagagcggcaaggccctgaaggcctgtgaggctgatgtgacccgggccagcgctggcaccaccgtgacagtgtacaacctcttctaccagctgcctgtgcggaggaagtgcatgtag

SEQ ID NO: 20615 - DNA, 4362 bp, Artificial Sequence; identical to SEQ ID NO: 20611
  Description of Artificial Sequence: Synthetic coding sequence

SEQ ID NO: 20616 - DNA, 321 bp, Artificial Sequence
  Description of Artificial Sequence: Synthetic coding sequence
atgatcaagtgcctgtctgtggaggtgcaggccaagctgcggagcggcctggccatcagcagcctgggccagtgtgtggaggagctggccctgaacagcattgatgctgaggccaagtgtgtggccgtgcgggtgaacatggagaccttccaggtgcaggtgattgacaatggatttggcatgggcagtgatgatgtggagaaggtgggcaaccgctacttcaccagcaagtgccacagcgtgcaggacctggagaacccccgcttctacggcttccggggggaggccctggccaacattgctgacatggccagcgcctag

SEQ ID NO: 20617 - DNA, 135 bp, Artificial Sequence
  Description of Artificial Sequence: Synthetic coding sequence
atggctgacaagccagacatgggagagatcgccagctttgacaaggccaagctgaagaagacagagacccaggagaagaacaccctgcccaccaaggagaccatcgagcaggagaagaggtctgagatctcctag

SEQ ID NO: 20618 - DNA, 1026 bp, Artificial Sequence
  Description of Artificial Sequence: Synthetic coding sequence
atggctgtgcagcccaaggagaccctgcagctggagagcgctgctgaggtgggctttgtgcgcttcttccagggcatgcctgagaagcccaccaccaccgtgcggctgtttgacagaggagacttctacacagcccacggggaggatgccctgctggccgcccgggaggtgttcaagacccagggcgtcatcaagtacatgggccctgctggggccaagaacctgcagagcgtggtgctgagcaagatgaactttgagagctttgtgaaggacctgctgctggtgcggcagtacagagtggaggtgtacaagaacagagctggcaacaaggccagcaaagaaaatgactggtacctggcctacaaggccagccctggcaacctgagccagtttgaggacatcctgtttggaaataatgacatgtctgccagcattggagtggtgggcgtgaagatgtctgctgtggatggccagaggcaggtgggcgtgggctacgtggacagcatccagaggaagctgggcctgtgtgagttcccagacaatgaccagttcagcaacctggaggccctgctgatccagatcggccccaaggaatgtgtgctgcccggcggggagacagctggggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccaggtggccgtgagcagcctgtctgctgtgatcaagttcctggagctgctgagtgatgacagcaactttggccagtttgagctgaccacctttgacttcagccagtacatgaagctggacattgctgctgtgcgggccctgaacctcttccagggctctgtggaggacaccaccggcagccagagcctggccgccctgctgaacaagtgcaagaccccccagggccagacctgctag

SEQ ID NO: 20619 - DNA, 2766 bp, Artificial Sequence
  Description of Artificial Sequence: Synthetic coding sequence
atggctgtgcagcccaaggagaccctgcagctggagagcgctgctgaggtgggctttgtgcgcttcttccagggcatgcctgagaagcccaccaccaccgtgcggctgtttgacagaggagacttctacacagcccacggggaggatgccctgctggccgcccgggaggtgttcaagacccagggcgtcatcaagtacatgggccctgctggggccaagaacctgcagagcgtggtgctgagcaagatgaactttgagagctttgtgaaggacctgctgctggtgcggcagtacagagtggaggtgtacaagaacagagctggcaacaaggccagcaaagaaaatgactggtacctggcctacaaggccagccctggcaacctgagccagtttgaggacatcctgtttggaaataatgacatgtctgccagcattggagtggtgggcgtgaagatgtctgctgtggatggccagaggcaggtgggcgtgggctacgtggacagcatccagaggaagctgggcctgtgtgagttcccagacaatgaccagttcagcaacctggaggccctgctgatccagatcggccccaaggaatgtgtgctgcccggcggggagacagctggggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccaggtggccgtgagcagcctgtctgctgtgatcaagttcctggagctgctgagtgatgacagcaactttggccagtttgagctgaccacctttgacttcagccagtacatgaagctggacattgctgctgtgcgggccctgaacctcttccagggctctgtggaggacaccaccggcagccagagcctggccgccctgctgaacaagtgcaagaccccccagggccagaggctggtgaaccagtggatcaagcagcccctgatggacaagaaccgcatcgaggagcggctgaacctggtggaggcctttgtggaggatgctgagctgcggcagaccctgcaggaggacctgctgcggcgcttcccagacctgaaccggctggccaagaagttccagaggcaggccgccaacctgcaggactgctaccgcctgtaccagggcatcaaccagctgcccaacgtcatccaggccctggagaagcatgagggcaagcaccagaagctgctgctggccgtgtttgtgacccccctgacagacctgcggagtgacttcagcaagttccaggagatgattgagaccaccctggacatggaccaggtggagaaccacgagttcctggtgaagcccagctttgaccccaacctgtctgagctgcgggagatcatgaatgacctggagaagaagatgcagagcaccctcatctctgctgcccgggacctgggcctggaccccgggaagcagatcaagctggacagcagcgcccagtttggctactacttccgggtgacctgcaaggaggagaaggtgctgaggaacaacaagaacttcagcacagtggacatccagaagaatggagtgaagttcaccaacagcaagctgaccagcctgaatgaggagtacaccaagaacaagacagaatatgaggaggcccaggatgccatcgtgaaggagatcgtgaacatcagcagcggctacgtggagcccatgcagaccctgaatgatgtgctggcccagctggatgctgtggtgtcctttgcccacgtgtccaatggagcccctgtgccctacgtgcggcctgccatcctggagaagggccagggccgcatcatcctgaaggccagcagacatgcctgtgtggaggtgcaggatgagatcgccttcatccccaatgatgtgtactttgagaaggacaagcagatgttccacatcatcaccggccccaacatgggcggcaagagcacctacatccggcagacaggagtgattgtgctgatggcccagatcggctgctttgtgccctgtgagagcgctgaggtgtccatcgtggactgcatcctggcccgggtgggcgctggggacagccagctgaagggcgtgtccaccttcatggccgagatgctggagacagccagcatcctgcggagcgccaccaaggacagcctcatcatcattgatgagctgggccggggcaccagcacctatgatggcttcggcctggcctgggccatcagcgagtacatcgccaccaagatcggggccttctgcatgtttgccacccacttccacgagctgacagccctggccaaccagatccccaccgtgaacaacctgcacgtgacagccctgaccacagaggagaccctgaccatgctgtaccaggtgaagaagggcgtgtgtgaccagagctttggcatccacgtggccgagctggccaacttccccaagcacgtgattgaatgtgccaagcagaaggccctggagctggaggagttccagtacatcggggagagccagggctatgacatcatggagcctgctgccaagaagtgctacctggagcgggagaacctgcgggtgacagagcccaaggaccagtgcctgatcctgctgacctggaagaggaagctgcggggcggcaagaggtctgcctgcagcaggcctgagcggcagaaccagggcagcggggagctgtcctag

SEQ ID NO: 20620 - DNA, 2163 bp, Artificial Sequence
  Description of Artificial Sequence: Synthetic coding sequence
atgattggcatctggcacatccggctgctgctggccatcagcctgagcctgaagaccttcagcctggtgaccatgatctgccagctgcccctggtgctgtgggtgctgaagtgcccccagctgatggcccgggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccagggctctgtggaggacaccaccggcagccagagcctggccgccctgctgaacaagtgcaagaccccccagggccagaggctggtgaaccagtggatcaagcagcccctgatggacaagaaccgcatcgaggagcggctgaacctggtggaggcctttgtggaggatgctgagctgcggcagaccctgcaggaggacctgctgcggcgcttcccagacctgaaccggctggccaagaagttccagaggcaggccgccaacctgcaggactgctaccgcctgtaccagggcatcaaccagctgcccaacgtcatccaggccctggagaagcatgagggcaagcaccagaagctgctgctggccgtgtttgtgacccccctgacagacctgcggagtgacttcagcaagttccaggagatgattgagaccaccctggacatggaccaggtggagaaccacgagttcctggtgaagcccagctttgaccccaacctgtctgagctgcgggagatcatgaatgacctggagaagaagatgcagagcaccctcatctctgctgcccgggacctgggcctggaccccgggaagcagatcaagctggacagcagcgcccagtttggctactacttccgggtgacctgcaaggaggagaaggtgctgaggaacaacaagaacttcagcacagtggacatccagaagaatggagtgaagttcaccaacagcaagctgaccagcctgaatgaggagtacaccaagaacaagacagaatatgaggaggcccaggatgccatcgtgaaggagatcgtgaacatcagcagcggctacgtggagcccatgcagaccctgaatgatgtgctggcccagctggatgctgtggtgtcctttgcccacgtgtccaatggagcccctgtgccctacgtgcggcctgccatcctggagaagggccagggccgcatcatcctgaaggccagcagacatgcctgtgtggaggtgcaggatgagatcgccttcatccccaatgatgtgtactttgagaaggacaagcagatgttccacatcatcaccggccccaacatgggcggcaagagcacctacatccggcagacaggagtgattgtgctgatggcccagatcggctgctttgtgccctgtgagagcgctgaggtgtccatcgtggactgcatcctggcccgggtgggcgctggggacagccagctgaagggcgtgtccaccttcatggccgagatgctggagacagccagcatcctgcggagcgccaccaaggacagcctcatcatcattgatgagctgggccggggcaccagcacctatgatggcttcggcctggcctgggccatcagcgagtacatcgccaccaagatcggggccttctgcatgtttgccacccacttccacgagctgacagccctggccaaccagatccccaccgtgaacaacctgcacgtgacagccctgaccacagaggagaccctgaccatgctgtaccaggtgaagaagggcgtgtgtgaccagagctttggcatccacgtggccgagctggccaacttccccaagcacgtgattgaatgtgccaagcagaaggccctggagctggaggagttccagtacatcggggagagccagggctatgacatcatggagcctgctgccaagaagtgctacctggagcgggagcagggcgagaagatcatccaggagttcctgagcaaggtgaagcagatgcccttcacagagatgtctgaggagaacatcaccatcaagctgaagcagctgaaggccgaggtgattgccaagaacaacagctttgtgaatgagatcatcagccgcatcaaggtgaccacctag

SEQ ID NO: 20621 - DNA, 2433 bp, Artificial Sequence
  Description of Artificial Sequence: Synthetic coding sequence
atggctgtgcagcccaaggagaccctgcagctggagagcgctgctgaggtgggctttgtgcgcttcttccagggcatgcctgagaagcccaccaccaccgtgcggctgtttgacagaggagacttctacacagcccacggggaggatgccctgctggccgcccgggaggtgttcaagacccagggcgtcatcaagtacatgggccctgctggggccaagaacctgcagagcgtggtgctgagcaagatgaactttgagagctttgtgaaggacctgctgctggtgcggcagtacagagtggaggtgtacaagaacagagctggcaacaaggccagcaaagaaaatgactggtacctggcctacaaggccagccctggcaacctgagccagtttgaggacatcctgtttggaaataatgacatgtctgccagcattggagtggtgggcgtgaagatgtctgctgtggatggccagaggcaggtgggcgtgggctacgtggacagcatccagaggaagctgggcctgtgtgagttcccagacaatgaccagttcagcaacctggaggccctgctgatccagatcggccccaaggaatgtgtgctgcccggcggggagacagctggggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccaggtggccgtgagcagcctgtctgctgtgatcaagttcctggagctgctgagtgatgacagcaactttggccagtttgagctgaccacctttgacttcagccagtacatgaagctggacattgctgctgtgcgggccctgaacctcttccagggctctgtggaggacaccaccggcagccagagcctggccgccctgctgaacaagtgcaagaccccccagggccagaggctggtgaaccagtggatcaagcagcccctgatggacaagaaccgcatcgaggagcggctgaacctggtggaggcctttgtggaggatgctgagctgcggcagaccctgcaggaggacctgctgcggcgcttcccagacctgaaccggctggccaagaagttccagaggcaggccgccaacctgcaggactgctaccgcctgtaccagggcatcaaccagctgcccaacgtcatccaggccctggagaagcatgagggcaagcaccagaagctgctgctggccgtgtttgtgacccccctgacagacctgcggagtgacttcagcaagttccaggagatgattgagaccaccctggacatggaccaggtggagaaccacgagttcctggtgaagcccagctttgaccccaacctgtctgagctgcgggagatcatgaatgacctggagaagaagatgcagagcaccctcatctctgctgcccgggacctgggcctggaccccgggaagcagatcaagctggacagcagcgcccagtttggctactacttccgggtgacctgcaaggaggagaaggtgctgaggaacaacaagaacttcagcacagtggacatccagaagaatggagtgaagttcaccaacagcaagctgaccagcctgaatgaggagtacaccaagaacaagacagaatatgaggaggcccaggatgccatcgtgaaggagatcgtgaacatcagcagcggctacgtggagcccatgcagaccctgaatgatgtgctggcccagctggatgctgtggtgtcctttgcccacgtgtccaatggagcccctgtgccctacgtgcggcctgccatcctggagaagggccagggccgcatcatcctgaaggccagcagacatgcctgtgtggaggtgcaggatgagatcgccttcatccccaatgatgtgtactttgagaaggacaagcagatgttccacatcatcaccggccccaacatgggcggcaagagcacctacatccggcagacaggagtgattgtgctgatggcccagatcggctgctttgtgccctgtgagagcgctgaggtgtccatcgtggactgcatcctggcccgggtgggcgctggggacagccagctgaagggcgtgtccaccttcatggccgagatgctggagacagccagcatcctgcggagcgccaccaaggacagcctcatcatcattgatgagctgggccggggcaccagcacctatgatggcttcggcctggcctgggccatcagcgagtacatcgccaccaagatcggggccttctgcatgtttgccaccatcttcatgaacctgctgccctggcccatccgctaccagctgctgatcatctacatgagccagcacagccccctgaagaggccctag

SEQ ID NO: 20622 - DNA, 507 bp, Artificial Sequence
  Description of Artificial Sequence: Synthetic coding sequence
atggacaagaaccgcatcgaggagcggctgaacctggtggaggcctttgtggaggatgctgagctgcggcagaccctgcaggaggacctgctgcggcgcttcccagacctgaaccggctggccaagaagttccagaggcaggccgccaacctgcaggactgctaccgcctgtaccagggcatcaaccagctgcccaacgtcatccaggccctggagaagcatgagggcaagcaccagaagctgctgctggccgtgtttgtgacccccctgacagacctgcggagtgacttcagcaagttccaggagatgattgagaccaccctggacatggaccaggtggagaaccacgagttcctggtgaagcccagctttgaccccaacctgtctgagctgcgggagatcatgaatgacctggagaagaagatgcagagcaccctcatctctgctgcccgggacctgggcggcagcctgcagcccaggagcagccggctggcctgtgccacctag

SEQ ID NO: 20623 - DNA, 1602 bp, Artificial Sequence
  Description of Artificial Sequence: Synthetic coding sequence
atggctgtgcagcccaaggagaccctgcagctggagagcgctgctgaggtgggctttgtgcgcttcttccagggcatgcctgagaagcccaccaccaccgtgcggctgtttgacagaggagacttctacacagcccacggggaggatgccctgctggccgcccgggaggtgttcaagacccagggcgtcatcaagtacatgggccctgctggggccaagaacctgcagagcgtggtgctgagcaagatgaactttgagagctttgtgaaggacctgctgctggtgcggcagtacagagtggaggtgtacaagaacagagctggcaacaaggccagcaaagaaaatgactggtacctggcctacaaggccagccctggcaacctgagccagtttgaggacatcctgtttggaaataatgacatgtctgccagcattggagtggtgggcgtgaagatgtctgctgtggatggccagaggcaggtgggcgtgggctacgtggacagcatccagaggaagctgggcctgtgtgagttcccagacaatgaccagttcagcaacctggaggccctgctgatccagatcggccccaaggaatgtgtgctgcccggcggggagacagctggggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccaggtggccgtgagcagcctgtctgctgtgatcaagttcctggagctgctgagtgatgacagcaactttggccagtttgagctgaccacctttgacttcagccagtacatgaagctggacattgctgctgtgcgggccctgaacctcttccagggctctgtggaggacaccaccggcagccagagcctggccgccctgctgaacaagtgcaagaccccccagggccagaggctggtgaaccagtggatcaagcagcccctgatggacaagaaccgcatcgaggagcggctgaacctggtggaggcctttgtggaggatgctgagctgcggcagaccctgcaggaggacctgctgcggcgcttcccagacctgaaccggctggccaagaagttccagaggcaggccgccaacctgcaggactgctaccgcctgtaccagggcatcaaccagctgcccaacgtcatccaggccctggagaagcatgagggcaagcaccagaagctgctgctggccgtgtttgtgacccccctgacagacctgcggagtgacttcagcaagttccaggagatgattgagaccaccctggacatggaccaggtggagaaccacgagttcctggtgaagcccagctttgaccccaacctgtctgagctgcgggagatcatgaatgacctggagaagaagatgcagagcaccctcatctctgctgcccgggacctgggcctggaccccgggaagcagatcaagctggacagcagcgcccagtttggctactacttccgggtgacctgcaaggagaagagccccagctag

SEQ ID NO: 20624 - DNA, 1233 bp, Artificial Sequence
  Description of Artificial Sequence: Synthetic coding sequence
atggctgtgcagcccaaggagaccctgcagctggagagcgctgctgaggtgggctttgtgcgcttcttccagggcatgcctgagaagcccaccaccaccgtgcggctgtttgacagaggagacttctacacagcccacggggaggatgccctgctggccgcccgggaggtgttcaagacccagggcgtcatcaagtacatgggccctgctggggccaagaacctgcagagcgtggtgctgagcaagatgaactttgagagctttgtgaaggacctgctgctggtgcggcagtacagagtggaggtgtacaagaacagagctggcaacaaggccagcaaagaaaatgactggtacctggcctacaaggccagccctggcaacctgagccagtttgaggacatcctgtttggaaataatgacatgtctgccagcattggagtggtgggcgtgaagatgtctgctgtggatggccagaggcaggtgggcgtgggctacgtggacagcatccagaggaagctgggcctgtgtgagttcccagacaatgaccagttcagcaacctggaggccctgctgatccagatcggccccaaggaatgtgtgctgcccggcggggagacagctggggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccaggtggccgtgagcagcctgtctgctgtgatcaagttcctggagctgctgagtgatgacagcaactttggccagtttgagctgaccacctttgacttcagccagtacatgaagctggacattgctgctgtgcgggccctgaacctcttccagggctctgtggaggacaccaccggcagccagagcctggccgccctgctgaacaagtgcaagaccccccagggccagaggctggtgaaccagtggatcaagcagcccctgatggacaagaaccgcatcgaggagcggctgaacctggtggaggcctttgtggaggatgctgagctgcggcagaccctgcaggaggactactttgtggacagccagatcctgacagacctgcccaggagcttcaaggacaagcagcagacctacaagatcgtgacagacagcatccgggtgtag

SEQ ID NO: 20625 - DNA, 1458 bp, Artificial Sequence
  Description of Artificial Sequence: Synthetic coding sequence
atggctgtgcagcccaaggagaccctgcagctggagagcgctgctgaggtgggctttgtgcgcttcttccagggcatgcctgagaagcccaccaccaccgtgcggctgtttgacagaggagacttctacacagcccacggggaggatgccctgctggccgcccgggaggtgttcaagacccagggcgtcatcaagtacatgggccctgctggggccaagaacctgcagagcgtggtgctgagcaagatgaactttgagagctttgtgaaggacctgctgctggtgcggcagtacagagtggaggtgtacaagaacagagctggcaacaaggccagcaaagaaaatgactggtacctggcctacaaggccagccctggcaacctgagccagtttgaggacatcctgtttggaaataatgacatgtctgccagcattggagtggtgggcgtgaagatgtctgctgtggatggccagaggcaggtgggcgtgggctacgtggacagcatccagaggaagctgggcctgtgtgagttcccagacaatgaccagttcagcaacctggaggccctgctgatccagatcggccccaaggaatgtgtgctgcccggcggggagacagctggggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccaggtggccgtgagcagcctgtctgctgtgatcaagttcctggagctgctgagtgatgacagcaactttggccagtttgagctgaccacctttgacttcagccagtacatgaagctggacattgctgctgtgcgggccctgaacctcttccagggctctgtggaggacaccaccggcagccagagcctggccgccctgctgaacaagtgcaagaccccccagggccagaggctggtgaaccagtggatcaagcagcccctgatggacaagaaccgcatcgaggagcggctgaacctggtggaggcctttgtggaggatgctgagctgcggcagaccctgcaggaggacctgctgcggcgcttcccagacctgaaccggctggccaagaagttccagaggcaggccgccaacctgcaggactgctaccgcctgtaccagggcatcaaccagctgcccaacgtcatccaggccctggagaagcatgagggcaagcaccagaagctgctgctggccgtgtttgtgacccccctgacagacctgcggagtgacttcagcaagttccaggagatgattgagaccaccctggacatggaccaggtggagaaccacgagttcctggtgaagcccagctttgaccccaacctgtctgagctgaggaacaatgaatag

SEQ ID NO: 20626 - DNA, 2607 bp, Artificial Sequence
  Description of Artificial Sequence: Synthetic coding sequence
atgggccctgctggggccaagaacctgcagagcgtggtgctgagcaagatgaactttgagagctttgtgaaggacctgctgctggtgcggcagtacagagtggaggtgtacaagaacagagctggcaacaaggccagcaaagaaaatgactggtacctggcctacaaggccagccctggcaacctgagccagtttgaggacatcctgtttggaaataatgacatgtctgccagcattggagtggtgggcgtgaagatgtctgctgtggatggccagaggcaggtgggcgtgggctacgtggacagcatccagaggaagctgggcctgtgtgagttcccagacaatgaccagttcagcaacctggaggccctgctgatccagatcggccccaaggaatgtgtgctgcccggcggggagacagctggggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccaggtggccgtgagcagcctgtctgctgtgatcaagttcctggagctgctgagtgatgacagcaactttggccagtttgagctgaccacctttgacttcagccagtacatgaagctggacattgctgctgtgcgggccctgaacctcttccagggctctgtggaggacaccaccggcagccagagcctggccgccctgctgaacaagtgcaagaccccccagggccagaggctggtgaaccagtggatcaagcagcccctgatggacaagaaccgcatcgaggagcggctgaacctggtggaggcctttgtggaggatgctgagctgcggcagaccctgcaggaggacctgctgcggcgcttcccagacctgaaccggctggccaagaagttccagaggcaggccgccaacctgcaggactgctaccgcctgtaccagggcatcaaccagctgcccaacgtcatccaggccctggagaagcatgagggcaagcaccagaagctgctgctggccgtgtttgtgacccccctgacagacctgcggagtgacttcagcaagttccaggagatgattgagaccaccctggacatggaccaggtggagaaccacgagttcctggtgaagcccagctttgaccccaacctgtctgagctgcgggagatcatgaatgacctggagaagaagatgcagagcaccctcatctctgctgcccgggacctgggcctggaccccgggaagcagatcaagctggacagcagcgcccagtttggctactacttccgggtgacctgcaaggaggagaaggtgctgaggaacaacaagaacttcagcacagtggacatccagaagaatggagtgaagttcaccaacagcaagctgaccagcctgaatgaggagtacaccaagaacaagacagaatatgaggaggcccaggatgccatcgtgaaggagatcgtgaacatcagcagcggctacgtggagcccatgcagaccctgaatgatgtgctggcccagctggatgctgtggtgtcctttgcccacgtgtccaatggagcccctgtgccctacgtgcggcctgccatcctggagaagggccagggccgcatcatcctgaaggccagcagacatgcctgtgtggaggtgcaggatgagatcgccttcatccccaatgatgtgtactttgagaaggacaagcagatgttccacatcatcaccggccccaacatgggcggcaagagcacctacatccggcagacaggagtgattgtgctgatggcccagatcggctgctttgtgccctgtgagagcgctgaggtgtccatcgtggactgcatcctggcccgggtgggcgctggggacagccagctgaagggcgtgtccaccttcatggccgagatgctggagacagccagcatcctgcggagcgccaccaaggacagcctcatcatcattgatgagctgggccggggcaccagcacctatgatggcttcggcctggcctgggccatcagcgagtacatcgccaccaagatcggggccttctgcatgtttgccacccacttccacgagctgacagccctggccaaccagatccccaccgtgaacaacctgcacgtgacagccctgaccacagaggagaccctgaccatgctgtaccaggtgaagaagggcgtgtgtgaccagagctttggcatccacgtggccgagctggccaacttccccaagcacgtgattgaatgtgccaagcagaaggccctggagctggaggagttccagtacatcggggagagccagggctatgacatcatggagcctgctgccaagaagtgctacctggagcgggagcagggcgagaagatcatccaggagttcctgagcaaggtgaagcagatgcccttcacagagatgtctgaggagaacatcaccatcaagctgaagcagctgaaggccgaggtgattgccaagaacaacagctttgtgaatgagatcatcagccgcatcaaggtgaccacctag

SEQ ID NO: 20627 - DNA, 3414 bp, Artificial Sequence
  Description of Artificial Sequence: Synthetic coding sequence
atgagcaggaggaagccagccagcggcggcctggccgccagcagcagcgccccagcccggcaggccgtgctgagccgcttcttccagagcacaggcagcctgaagagcaccagcagcagcactggagctgctgaccaggtggaccctggagctgctgctgctgctgctgctgctgctgctgctgcccccccagcccccccagccccagccttccccccccagctgcccccccacatcgccacagaaattgacaggaggaagaagaggcccctggagaatgatggccctgtgaagaagaaggtgaagaaggtgcagcagaaggagggcggcagtgacctgggcatgagcggcaacagcgagcccaagaagtgcctgcggaccagaaatgtgtccaagagcctggagaagctgaaggagttctgctgtgacagcgccctgccccagagccgggtgcagacagagagcctgcaggagagatttgctgtgctgcccaagtgcacagactttgatgacatcagcctgctgcacgccaagaatgctgtgtcctctgaggacagcaagaggcagatcaaccagaaggacaccaccctgtttgacctgagccagtttggcagcagcaacaccagccatgagaacctgcagaagacagccagcaagagcgccaacaagaggagcaagagcatctacacccccctggagctgcagtacatcgagatgaagcagcagcacaaggatgctgtgctgtgtgtggagtgtggctacaagtaccgcttctttggagaagatgctgagattgctgcccgggagctgaacatctactgccacctggaccacaacttcatgacagccagcatccccacccaccggctgtttgtgcacgtgcggcggctggtggccaagggctacaaggtgggcgtggtgaagcagacagaaacagctgccctgaaggccatcggggacaacagaagcagcctcttcagcaggaagctgacagccctgtacaccaagagcaccctcatcggggaggatgtgaaccccctcatcaagctggatgatgctgtgaatgtggatgagatcatgacagacaccagcaccagctacctgctgtgcatcagcgagaacaaggaaaatgtgcgggacaagaagaagggcaacatcttcatcggcatcgtgggcgtgcagcctgccactggagaggtggtgtttgacagcttccaggacagcgccagccgctctgagctggagaccaggatgagcagcctgcagcctgtggagctgctgctgcccagcgccctgtctgagcagacagaggccctgatccaccgggccacctctgtgtctgtgcaggatgaccgcatccgggtggagaggatggacaacatctactttgagtacagccacgccttccaggccgtgacagagttctacgccaaggacacagtggacatcaagggcagccagatcatcagcggcatcgtgaacctggagaagcctgtgatctgcagcctggccgccatcatcaagtacctgaaggagttcaacctggagaagatgctgagcaagccagagaacttcaagcagctgagcagcaagatggagttcatgaccatcaatggcaccaccctgaggaacctggagatcctgcagaaccagacagacatgaagaccaagggcagcctgctgtgggtgctggaccacaccaagaccagctttggaagaaggaagctgaagaagtgggtgacccagcccctgctgaagctgcgggagatcaatgcccggctggatgctgtgtctgaggtgctgcacagcgagagctctgtgtttggccagatcgagaaccacctgaggaagctgcctgacatcgagcggggcctgtgcagcatctaccacaagaagtgcagcacccaggagttcttcctgattgtgaagaccctgtaccacctgaagtctgagttccaggccatcatcccagctgtgaacagccacatccagagcgacctgctgaggacagtcatcctggagatccctgagctgctgagccctgtggagcactacctgaagatcctgaatgagcaggccgccaaggtgggggacaagacagagctgttcaaggacctgagtgacttccccctcatcaagaagaggaaggatgagatccagggcgtgattgatgagatccgcatgcacctgcaggagatcaggaagatcctgaagaaccccagcgcccagtatgtgacagtgtctggccaggagttcatgattgagatcaagaacagcgctgtgtcctgcatccccacagactgggtgaaggtgggcagcaccaaggctgtgagccgcttccacagccccttcatcgtggagaactaccgccacctgaaccagctgcgggagcagctggtgctggactgcagcgctgagtggctggacttcctggagaagttcagcgagcactaccacagcctgtgcaaggctgtgcaccacctggccaccgtggactgcatcttcagcctggccaaggtggccaagcagggcgactactgccggcccaccgtgcaggaggagaggaagatcgtcatcaagaatggccgccaccctgtgattgatgtgctgctgggggagcaggaccagtatgtgcccaacaacacagacctgtctgaggacagcgagcgggtgatgatcatcaccggccccaacatgggcggcaagagcagctacatcaagcaggtggccctgatcaccatcatggcccagatcggcagctatgtgcctgctgaggaggccaccatcggcatcgtggatggcatcttcaccaggatgggcgctgctgacaacatctacaagggccagagcaccttcatggaggagctgacagacacagctgagatcatcaggaaggccaccagccagagcctggtgatcctggatgagctgggccggggcaccagcacccatgatggcatcgccatcgcctatgccaccctggagtacttcatcagagatgtgaagagcctgaccctgtttgtgacccactacccacctgtgtgtgagctggagaagaactacagccaccaggtgggcaactaccacatgggcttcctggtgtctgaagatgagagcaagctggaccctggagctgctgagcaggtgcctgactttgtgaccttcctgtaccagatcacccggggcattgctgcccggagctatggcctgaatgtggccaagctggctgatgtgcctggagagatcctgaagaaggccgcccacaagagcaaggagctggagggcctcatcaacaccaagaggaagaggctgaagtactttgccaagctgtggaccatgcacaatgcccaggacctgcagaagtggacagaggagttcaacatggaggagacccagaccagcctgctgcactag

SEQ ID NO: 20628 - DNA, 3387 bp, Artificial Sequence
  Description of Artificial Sequence: Synthetic coding sequence
atgagcaggaggaagccagccagcggcggcctggccgccagcagcagcgccccagcccggcaggccgtgctgagccgcttcttccagagcacaggcagcctgaagagcaccagcagcagcactggagctgctgaccaggtggaccctggagctgctgctgctgctgcccccccagccccagccttccccccccagctgcccccccacatcgccacagaaattgacaggaggaagaagaggcccctggagaatgatggccctgtgaagaagaaggtgaagaaggtgcagcagaaggagggcggcagtgacctgggcatgagcggcaacagcgagcccaagaagtgcctgcggaccagaaatgtgtccaagagcctggagaagctgaaggagttctgctgtgacagcgccctgccccagagccgggtgcagacagagagcctgcaggagagatttgctgtgctgcccaagtgcacagactttgatgacatcagcctgctgcacgccaagaatgctgtgtcctctgaggacagcaagaggcagatcaaccagaaggacaccaccctgtttgacctgagccagtttggcagcagcaacaccagccatgagaacctgcagaagacagccagcaagagcgccaacaagaggagcaagagcatctacacccccctggagctgcagtacatcgagatgaagcagcagcacaaggatgctgtgctgtgtgtggagtgtggctacaagtaccgcttcttcggggaggatgctgagattgctgcccgggagctgaacatctactgccacctggaccacaacttcatgacagccagcatccccacccaccggctgtttgtgcacgtgcggcggctggtggccaagggctacaaggtgggcgtggtgaagcagacagaaacagctgccctgaaggccatcggggacaacagaagcagcctcttcagcaggaagctgacagccctgtacaccaagagcaccctgattggagaagatgtgaaccccctcatcaagctggatgatgctgtgaatgtggatgagatcatgacagacaccagcaccagctacctgctgtgcatcagcgagaacaaggaaaatgtgcgggacaagaagaagggcaacatcttcatcggcatcgtgggcgtgcagcctgccaccggggaggtggtgtttgacagcttccaggacagcgccagccgctctgagctggagaccaggatgagcagcctgcagcctgtggagctgctgctgcccagcgccctgtctgagcagacagaggccctgatccaccgggccacctctgtgtctgtgcaggatgaccgcatccgggtggagaggatggacaacatctactttgagtacagccacgccttccaggccgtgacagagttctacgccaaggacacagtggacatcaagggcagccagatcatctctggaattgtgaacctggagaagcctgtgatctgcagcctggccgccatcatcaagtacctgaaggagttcaacctggagaagatgctgagcaagccagagaacttcaagcagctgagcagcaagatggagttcatgaccatcaatggcaccaccctgaggaacctggagatcctgcagaaccagacagacatgaagaccaagggcagcctgctgtgggtgctggaccacaccaagaccagctttggccgcaggaagctgaagaagtgggtgacccagcccctgctgaagctgcgggagatcaatgcccggctggatgctgtgtctgaggtgctgcacagcgagagctctgtgtttggccagatcgagaaccacctgaggaagctgcctgacatcgagcggggcctgtgcagcatctaccacaagaagtgcagcacccaggagttcttcctgattgtgaagaccctgtaccacctgaagtctgagttccaggccatcatcccagctgtgaacagccacatccagagcgacctgctgaggacagtcatcctggagatccctgagctgctgagccctgtggagcactacctgaagatcctgaatgagcaggccgccaaggtgggggacaagacagagctgttcaaggacctgagtgacttccccctcatcaagaagaggaaggatgagatccagggcgtgattgatgagatccgcatgcacctgcaggagatcaggaagatcctgaagaaccccagcgcccagtatgtgacagtgtctggccaggagttcatgattgagatcaagaacagcgctgtgtcctgcatccccacagactgggtgaaggtgggcagcaccaaggctgtgagccgcttccacagccccttcatcgtggagaactaccgccacctgaaccagctgcgggagcagctggtgctggactgcagcgctgagtggctggacttcctggagaagttcagcgagcactaccacagcctgtgcaaggctgtgcaccacctggccaccgtggactgcatcttcagcctggccaaggtggccaagcagggcgactactgccggcccaccgtgcaggaggagaggaagatcgtcatcaagaatggccgccaccctgtgattgatgtgctgctgggggagcaggaccagtatgtgcccaacaacacagacctgtctgaagattctgagcgggtgatgatcatcaccggccccaacatgggcggcaagagcagctacatcaagcaggtggccctgatcaccatcatggcccagatcggcagctatgtgcctgctgaggaggccaccatcggcatcgtggatggcatcttcaccaggatgggcgctgctgacaacatctacaagggccagagcaccttcatggaggagctgacagacacagctgagatcatcaggaaggccaccagccagagcctggtgatcctggatgagctgggccggggcaccagcacccatgatggcatcgccatcgcctatgccaccctggagtacttcatcagagatgtgaagagcctgaccctgtttgtgacccactacccacctgtgtgtgagctggagaagaactacagccaccaggtgggcaactaccacatgggcttcctggtgtctgaagatgagagcaagctggaccccggggctgctgagcaggtgcctgactttgtgaccttcctgtaccagatcacccggggcattgctgcccggagctatggcctgaatgtggccaagctggctgatgtgcctggagagatcctgaagaaggccgcccacaagagcaaggagctggagggcctcatcaacaccaagaggaagaggctgaagtactttgccaagctgtggaccatgcacaatgcccaggacctgcagaagtggacagaggagttcaacatggaggagacccagaccagcctgctgcactag

SEQ ID NO: 20629 - DNA, 2811 bp, Artificial Sequence
  Description of Artificial Sequence: Synthetic coding sequence
atgctgcggcctgagatcagcagcaccagccccagcgccccagctgtgagccccagcagcggggagaccaggagcccccagggcccccgctacaactttggcctgcaggagaccccccagagccggcccagcgtgcaggtggtgtctgccagcacctgccccggcaccagcggggccgccggggacaggagcagcagcagcagcagcctgccctgcccagcccccaacagcaggcctgcccagggcagctactttggaaacaagagggcctatgcagaaaatacagtggccagcaacttcaccttcggggccagcagcagcagcgcccgggacaccaactacccccagaccctgaagacccccctgagcacaggcaacccccagaggagcggctacaagtcctggaccccccaggtgggctacagcgccagcagcagcagcgccatcagcgcccacagccccagcgtgattgtggccgtggtggagggccggggcctggcccggggggagatcggcatggccagcattgacctgaagaacccccagatcatcctgagccagtttgctgacaacaccacctacgccaaggtgatcaccaagctgaagatcctgagccccctggagatcatcatgagcaacacagcctgtgctgtgggcaacagcaccaagctgttcaccctcatcacagagaacttcaagaatgtgaacttcaccaccatccagaggaagtacttcaatgagaccaagggcctggagtacatcgagcagctgtgcatcgccgagttcagcacagtgctgatggaggtgcagagcaagtactactgcctggccgctgtggccgccctgctgaagtatgtggagttcatccagaacagcgtgtatgcccccaagagcctgaagatctgcttccagggcagcgagcagacagccatgattgacagcagcagcgcccagaacctggagctgctgatcaacaaccaggactacagaaacaaccacaccctgtttggagtgctgaactacaccaagaccccaggcggcagccggcggctgcggagcaacatcctggagcccctggtggacatcgagaccatcaacatgaggctggactgtgtgcaggagctgctgcaggatgaggagctgttcttcggcctgcagagcgtcatcagccgcttcctggacacagagcagctgctgtctgtgctggtgcagatccccaagcaggacacagtgaatgctgctgagagcaagatcaccaacctgatctacctgaagcacaccctggagctggtggaccccctgaagatcgccatgaagaactgcaacacccccctgctgcgggcctactacggcagcctggaggacaagcgcttcggcatcatcctggagaagatcaagacagtcatcaatgatgatgcccgctacatgaagggctgcctgaacatgaggacccagaagtgctatgctgtgcgcagcaacatcaatgagttcctggacatcgcccggaggacctacacagagatcgtggatgacattgctggcatgatcagccagctgggggagaagtacagcctgcccctgcggaccagcttcagcagcgcccggggcttcttcatccagatgaccacagactgcatcgccctgcccagcgaccagctgcccagcgagttcatcaagatcagcaaggtgaagaacagctacagcttcaccagcgctgacctgatcaagatgaatgaacgctgccaggagagcctgcgggagatctaccacatgacctacatgattgtgtgcaagctgctgtctgagatctatgagcacatccactgcctgtacaagctgagtgacacagtgtccatgctggacatgctgctgagctttgcccacgcctgcaccctgagtgactatgtgcggcctgagttcacagacaccctggccatcaagcagggctggcaccccatcctggagaagatctctgctgagaagcccatcgccaacaacacctacgtgacagagggcagcaacttcctgatcatcaccggccccaacatgtctgggaagagcacctacctgaagcagatcgccctgtgccagatcatggcccagatcggcagctatgtgcctgctgagtacagcagcttcagaattgccaagcagatcttcacccgcatcagcacagatgatgacatcgagaccaacagcagcaccttcatgaaggagatgaaggagatcgcctacatcctgcacaatgccaatgacaagagcctcatcctgattgatgagctgggccggggcaccaacacagaggagggcatcggcatctgctatgctgtgtgtgagtacctgctgagcctgaaggccttcaccctgtttgccacccacttcctggagctgtgccacattgatgccctgtaccccaacgtggagaacatgcactttgaggtgcagcacgtgaagaacaccagcaggaacaaggaggccatcctgtacacctacaagctgagcaagggcctgacagaggagaagaactacggcctgaaggctgctgaggtgagcagcctgccccccagcatcgtgctggatgccaaggagatcaccacccagatcacccggcagatcctgcagaaccagaggagcaccccagagatggagcggcagagagctgtgtaccacctggccacccggctggtgcagacagccaggaacagccagctggaccctgacagcctgcgcatctacctgagcaacctgaagaagaagtacaaggaggacttccccaggacagagcaggtgcctgagaagacagaggagtag

SEQ ID NO: 20630 - DNA, 813 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagaattggagtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgtag

SEQ ID NO: 20631 - DNA, 813 bp, Artificial Sequence; identical to SEQ ID NO: 20630
  Description of Artificial Sequence: Synthetic coding sequence

SEQ ID NO: 20632 - DNA, 585 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagatag

SEQ ID NO: 20633 - DNA, 813 bp, Artificial Sequence; identical to SEQ ID NO: 20630
  Description of Artificial Sequence: Synthetic coding sequence

SEQ ID NO: 20634 - DNA, 864 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgaccccacctggggacctgcgcttcacccccatccccctgctgatccccagccaggtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgtag

SEQ ID NO: 20635 - DNA, 324 bp, Artificial Sequence
  Description of Artificial Sequence: Synthetic coding sequence
aagatcctcttcctgagcagcatcatcccctttgactgcctgctgactgtgcgggccctgggcggcctgctgaagttcctgggcagaagacgcatcggcgtggagctggaggactacaacgtgtctgtgcccatcctgggcttcaagaagttcatgctgacccacctggtgaacatcgaccaggacacctacagcgtgctgcagatcttcaagtctgagagccaccccagcgtgtacaaggtggccagcggcctgaaggagggcctgagcctgtttggcatcctgaaccgctgccactgcaagtggggcgagaagctgctgtag

SEQ ID NO: 20636 - DNA, 765 bp, Artificial Sequence
  Description of Artificial Sequence: Synthetic coding sequence
atggccagcctgggcgccaaccccaggaggaccccccagggccccaggcctggagctgccagcagcggcttccccagccctgcccctgtgcccggcccccgggaggccgaggaggaggaggtggaggaggaggaggagctggccgagatccacctgtgtgtgctgtggaacagcggctacctgggcatcgcctactatgacaccagtgacagcaccatccacttcatgccagatgccccagaccacgagagcctgaagctgctgcagagggtgctggatgagatcaacccccagagcgtggtgaccagcgccaagcaggatgagaacatgacccgcttcctgggcaagctggccagccaggagcaccgggagcccaagaggcctgagatcatcttcctgcccagcgtggactttggcctggagatcagcaagcagaggctgctgagcggcaactacagcttcatcccagatgccatgacagccacagagaagatcctcttcctgagcagcatcatcccctttgactgcctgctgactgtgcgggccctgggcggcctgctgaagttcctgggcagaagaagaattggagtggagctggaggactacaacgtgtctgtgcccatcctgggcttcaagaagttcatgctgacccacctggtgaacatcgaccaggacacctaccgcctggagtgcaatggagccatcagcgcccagtgcaacctgtgcctgctgggcagcagtgacagccctgccagcgccagctag

SEQ ID NO: 20637 - DNA, 1542 bp, Artificial Sequence
  Description of Artificial Sequence: Synthetic coding sequence
atggccatggagattgacagcaggcctgggggcctgcccggcagcagctgcaacctgggcgccgcccgggagcacatgcaggccgtgaccaggaactacatcacccacccccgggtgacctacagaacagtgtgcagcgtgaatggccccctggtggtgctggacagagtgaagtttgcccagtatgcagaaattgtgcacttcaccctgcctgatggcacccagaggagcggccaggtgctggaggtggccggcaccaaggccatcgtgcaggtgtttgagggcaccagcggcattgatgccaggaagaccacctgtgagttcaccggggacatcctgcggacccctgtgtctgaggacatgctgggccgggtcttcaatggaagtggcaagcccatcgacaagggccctgtggtgatggccgaggacttcctggacatcaatggccagcccatcaacccccacagccgcatctacccagaggagatgatccagacaggcatcagccccattgatgtgatgaacagcatcgcccggggccagaagatccccatcttctctgctgctggcctgccccacaatgaaattgctgcccagatctgccggcaggccggcctggtgaagaagagcaaggctgtgctggactaccatgatgacaactttgccatcgtgtttgctgccatgggcgtgaacatggagacagcccgcttcttcaagagtgactttgagcagaatggcaccatgggaaatgtgtgcctcttcctgaacctggccaatgaccccaccatcgagcgcatcatcaccccccggctggccctgaccacagctgagttcctggcctaccagtgtgagaagcacgtgctggtgatcctgacagacatgagcagctatgcagaggccctgcgggaggtgtctgctgcccgggaggaggtgcccggccggcggggcttccctggctacatgtacacagacctggccaccatctatgagcgggccggccgggtggagggccggggcggcagcatcacccagatccccatcctgaccatgcccaatgatgacatcacccaccccatcccagacctgaccggcttcatcacagagggccagatctacgtggaccggcagctgcacaaccggcagatctacccacccatcaacgtgctgcccagcctgagccggctgatgaagagcgccatcggggagggcatgaccaggaaggaccatggagatgtgagcaaccagctgtatgcctgctacgccatcggcaaggatgtgcaggccatgaaggctgtggtgggggaggaggccctgaccagcgaggacctgctgtacctggagttcctgcagaagtttgagaagaacttcatcaaccagggcccctatgaaaatagatctgtgtttgagagcctggacctgggctggaagctgctgcgcatcttccccaaggagatgctgaagaggatcccccaggccgtgattgatgagttctacagccgggagggcgccctgcaggacctggccccagacacagccctgtag

SEQ ID NO: 20638 - DNA, 759 bp, Artificial Sequence
  Description of Artificial Sequence: Synthetic coding sequence
atgagccggcagagcaccctgtacagcttcttccccaagagccctgccctgagtgatgccaacaaggccagcgcccgggccagccgggagggcggccgggctgctgctgcccctggggccagccccagccctggaggagatgctgcctggagcgaggccggccctggcccccggcccctggcccggagcgccagcccccccaaggccaagaacctgaatggaggcctgcggcgctctgtggccccagctgcccccaccagctgtgacttcagccctggggacctggtgtgggccaagatggagggctacccctggtggccctgcctggtgtacaaccacccctttgatggcaccttcatccgggagaagggcaagtctgtgcgggtgcacgtgcagttctttgatgacagccccacccggggctgggtgtccaagaggctgctgaagccctacacaggcagcaagagcaaggaggcccagaagggcggccacttctacagcgccaagccagagatcctgcgggccatgcagagagcagatgaggccctgaacaaggacaagatcaagaggctggagctggccgtgtgtgatgagcccagcgagcctgaggaggaggaggagatggaggtgggcaccacctacgtgacagacaagtcagaagaagataatgaaattgaaagtgaggaggaggtgcagcccaagacccagggcagcagaagaagcagccggcagatcaagaagaggaggaagaagaggtag

SEQ ID NO: 20639 - DNA, 3177 bp, Artificial Sequence
  Description of Artificial Sequence: Synthetic coding sequence
atggtgactggaaatggcagcctgaagaggaagagcagcaggaaggagaccccatctgccaccaagcaggccaccagcatcagcagcgagaccaagaacaccctgcgggccttcagcgccccccagaacagcgagagccaggcccacgtgtctggaggaggagatgacagcagccggcccaccgtgtggtaccacgagaccctggagtggctgaaggaggagaagagaagagatgagcacagaagaagaccagaccacccagactttgatgccagcaccctgtatgtgcctgaggacttcctgaacagctgcaccccaggcatgaggaagtggtggcagatcaagagccagaactttgacctggtgatctgctacaaggtgggcaagttctatgagctgtaccacatggatgccctgattggagtgtctgagctgggcctggtgttcatgaagggcaactgggcccacagcggcttccctgagatcgccttcggccgctacagcgacagcctggtgcagaagggctacaaggtggcccgggtggagcagacagagaccccagagatgatggaggcccgctgcaggaagatggcccacatcagcaaatatgacagagtggtgcggcgggagatctgccgcatcatcaccaagggcacccagacctacagcgtgctggagggggaccccagcgagaactacagcaagtacctgctgagcctgaaggagaaggaggaggacagcagcggccacacccgggcctacggcgtgtgctttgtggacaccagcctgggcaagttcttcatcggccagttcagtgatgacagacactgcagccgcttccgcaccctggtggcccactacccacctgtgcaggtgctgtttgagaagggcaacctgagcaaggagaccaagaccatcctgaagagcagcctgagctgcagcctgcaggagggcctcatccctggcagccagttctgggatgccagcaagaccctgcggaccctgctggaggaggagtacttccgggagaagctgagtgatggcattggagtgatgctgccccaggtgctgaagggcatgaccagcgagagtgacagcatcggcctgaccccaggagagaagtctgagctggccctgagcgccctgggcggctgtgtgttctacctgaagaagtgcctgattgaccaggagctgctgtccatggccaactttgaggagtacatccccctggacagcgacacagtgtccaccaccaggtctggggccatcttcaccaaggcctaccagaggatggtgctggatgctgtgaccctgaacaacctggagatcttcctgaatggcaccaacggcagcacagagggcaccctgctggagcgggtggacacctgccacaccccatttgggaagaggctgctgaagcagtggctgtgtgcccccctgtgcaaccactacgccatcaatgaccggctggatgccatcgaggacctgatggtggtgcctgacaagatcagcgaggtggtggagctgctgaagaagctgcctgacctggagcggctgctgagcaagatccacaacgtgggcagccccctgaagagccagaaccacccagacagccgggccatcatgtatgaggagaccacctacagcaagaagaagatcatcgacttcctgagcgccctggagggcttcaaggtgatgtgcaagatcatcggcatcatggaggaggtggctgatggcttcaagagcaagatcctgaagcaggtgatcagcctgcagaccaagaaccctgagggccgcttcccagacctgactgtggagctgaaccgctgggacacagcctttgaccacgagaaggccaggaagacaggcctcatcacccccaaggccggctttgacagcgactatgaccaggccctggccgacatccgggagaatgagcagagcctgctggagtacctggagaagcagaggaaccgcatcggctgcaggaccatcgtgtactggggcatcggcaggaaccgctaccagctggagatccctgagaacttcaccaccaggaacctgcctgaggagtatgagctgaagagcaccaagaagggctgcaagcgctactggaccaagaccatcgagaagaagctggccaacctgatcaatgctgaggagaggagagatgtgtccctgaaggactgcatgaggaggctcttctacaactttgacaagaactacaaggactggcagagcgctgtggagtgcatcgctgtgctggatgtgctgctgtgcctggccaactacagcagaggaggagatggccccatgtgcaggcctgtgatcctgctgcctgaggacaccccacccttcctggagctgaagggcagccgccacccctgcatcaccaagaccttctttggagatgacttcatccccaatgacatcctgattggctgtgaggaggaggagcaggagaatggcaaggcctactgtgtgctggtgacaggccccaacatgggcggcaagagcaccctgatgaggcaggccggcctgctggccgtgatggcccagatgggctgctacgtgcctgctgaggtgtgccgcctgacccccatcgacagagtcttcacccggctgggcgccagtgaccgcatcatgtctggagagagcaccttctttgtggagctgtctgaaacagccagcatcctgatgcacgccacagcccacagcctggtgctggtggatgagctgggccggggcacagccacctttgatggaacagccatcgccaatgctgtggtgaaggagctggccgagaccatcaagtgcaggaccctcttcagcacccactaccacagcctggtggaggactacagccagaatgtggccgtgcggctgggccacatggcctgcatggtggagaatgaatgtgaggaccccagccaggagaccatcaccttcctgtacaagttcatcaagggggcctgccccaagagctatggcttcaatgctgcccggctggccaacctgcctgaggaggtgatccagaagggccacaggaaggcccgggagtttgagaagatgaaccagagcctgcggctcttccgggaggtgtgcctggccagcgagaggagcacagtggatgctgaggccgtgcacaagctgctgaccctcatcaaggagctgtag

SEQ ID NO: 20640 - DNA, 3693 bp, Artificial Sequence
  Description of Artificial Sequence: Synthetic coding sequence
atgagccggcagagcaccctgtacagcttcttccccaagagccctgccctgagtgatgccaacaaggccagcgcccgggccagccgggagggcggccgggctgctgctgcccctggggccagccccagccctggaggagatgctgcctggagcgaggccggccctggcccccggcccctggcccggagcgccagcccccccaaggccaagaacctgaatggaggcctgcggcgctctgtgggcaccacctacgtgacagacaagtcagaagaagataatgaaattgaaagtgaggaggaggtgcagcccaagacccagggcagcagaagaagcagccggcagatcaagaagagaagagtcatcagtgacagcgagagtgacatcggcggcagtgatgtggagttcaagccagacaccaaggaggagggcagcagtgatgagatcagcagcggcgtgggggacagcgagagcgagggcctgaacagccctgtgaaggtggccaggaagaggaagaggatggtgactggaaatggcagcctgaagaggaagagcagcaggaaggagaccccatctgccaccaagcaggccaccagcatcagcagcgagaccaagaacaccctgcgggccttcagcgccccccagaacagcgagagccaggcccacgtgtctggaggaggagatgacagcagccggcccaccgtgtggtaccacgagaccctggagtggctgaaggaggagaagagaagagatgagcacagaagaagaccagaccacccagactttgatgccagcaccctgtatgtgcctgaggacttcctgaacagctgcaccccaggcatgaggaagtggtggcagatcaagagccagaactttgacctggtgatctgctacaaggtgggcaagttctatgagctgtaccacatggatgccctgattggagtgtctgagctgggcctggtgttcatgaagggcaactgggcccacagcggcttccctgagatcgccttcggccgctacagcgacagcctggtgcagaagggctacaaggtggcccgggtggagcagacagagaccccagagatgatggaggcccgctgcaggaagatggcccacatcagcaaatatgacagagtggtgcggcgggagatctgccgcatcatcaccaagggcacccagacctacagcgtgctggagggggaccccagcgagaactacagcaagtacctgctgagcctgaaggagaaggaggaggacagcagcggccacacccgggcctacggcgtgtgctttgtggacaccagcctgggcaagttcttcatcggccagttcagtgatgacagacactgcagccgcttccgcaccctggtggcccactacccacctgtgcaggtgctgtttgagaagggcaacctgagcaaggagaccaagaccatcctgaagagcagcctgagctgcagcctgcaggagggcctcatccctggcagccagttctgggatgccagcaagaccctgcggaccctgctggaggaggagtacttccgggagaagctgagtgatggcattggagtgatgctgccccaggtgctgaagggcatgaccagcgagagtgacagcatcggcctgaccccaggagagaagtctgagctggccctgagcgccctgggcggctgtgtgttctacctgaagaagtgcctgattgaccaggagctgctgtccatggccaactttgaggagtacatccccctggacagcgacacagtgtccaccaccaggtctggggccatcttcaccaaggcctaccagaggatggtgctggatgctgtgaccctgaacaacctggagatcttcctgaatggcaccaacggcagcacagagggcaccctgctggagcgggtggacacctgccacaccccatttgggaagaggctgctgaagcagtggctgtgtgcccccctgtgcaaccactacgccatcaatgaccggctggatgccatcgaggacctgatggtggtgcctgacaagatcagcgaggtggtggagctgctgaagaagctgcctgacctggagcggctgctgagcaagatccacaacgtgggcagccccctgaagagccagaaccacccagacagccgggccatcatgtatgaggagaccacctacagcaagaagaagatcatcgacttcctgagcgccctggagggcttcaaggtgatgtgcaagatcatcggcatcatggaggaggtggctgatggcttcaagagcaagatcctgaagcaggtgatcagcctgcagaccaagaaccctgagggccgcttcccagacctgactgtggagctgaaccgctgggacacagcctttgaccacgagaaggccaggaagacaggcctcatcacccccaaggccggctttgacagcgactatgaccaggccctggccgacatccgggagaatgagcagagcctgctggagtacctggagaagcagaggaaccgcatcggctgcaggaccatcgtgtactggggcatcggcaggaaccgctaccagctggagatccctgagaacttcaccaccaggaacctgcctgaggagtatgagctgaagagcaccaagaagggctgcaagcgctactggaccaagaccatcgagaagaagctggccaacctgatcaatgctgaggagaggagagatgtgtccctgaaggactgcatgaggaggctcttctacaactttgacaagaactacaaggactggcagagcgctgtggagtgcatcgctgtgctggatgtgctgctgtgcctggccaactacagcagaggaggagatggccccatgtgcaggcctgtgatcctgctgcctgaggacaccccacccttcctggagctgaagggcagccgccacccctgcatcaccaagaccttctttggagatgacttcatccccaatgacatcctgattggctgtgaggaggaggagcaggagaatggcaaggcctactgtgtgctggtgacaggccccaacatgggcggcaagagcaccctgatgaggcaggccggcctgctggccgtgatggcccagatgggctgctacgtgcctgctgaggtgtgccgcctgacccccatcgacagagtcttcacccggctgggcgccagtgaccgcatcatgtctggagagagcaccttctttgtggagctgtctgaaacagccagcatcctgatgcacgccacagcccacagcctggtgctggtggatgagctgggccggggcacagccacctttgatggaacagccatcgccaatgctgtggtgaaggagctggccgagaccatcaagtgcaggaccctcttcagcacccactaccacagcctggtggaggactacagccagaatgtggccgtgcggctgggccacatggcctgcatggtggagaatgaatgtgaggaccccagccaggagaccatcaccttcctgtacaagttcatcaagggggcctgccccaagagctatggcttcaatgctgcccggctggccaacctgcctgaggaggtgatccagaagggccacaggaaggcccgggagtttgagaagatgaaccagagcctgcggctcttccgggaggtgtgcctggccagcgagaggagcacagtggatgctgaggccgtgcacaagctgctgaccctcatcaaggagctgtag

SEQ ID NO: 20641 - DNA, 975 bp, Artificial Sequence
  Description of Artificial Sequence: Synthetic coding sequence
atgaggaggctcttctacaactttgacaagaactacaaggactggcagagcgctgtggagtgcatcgctgtgctggatgtgctgctgtgcctggccaactacagcagaggaggagatggccccatgtgcaggcctgtgatcctgctgcctgaggacaccccacccttcctggagctgaagggcagccgccacccctgcatcaccaagaccttctttggagatgacttcatccccaatgacatcctgattggctgtgaggaggaggagcaggagaatggcaagatcgtgtgcctgctgctggaccagatctggggcgccagcctgaggatgaggcaggccggcctgctggccgtgatggcccagatgggctgctacgtgcctgctgaggtgtgccgcctgacccccatcgacagagtcttcacccggctgggcgccagtgaccgcatcatgtctggagagagcaccttctttgtggagctgtctgaaacagccagcatcctgatgcacgccacagcccacagcctggtgctggtggatgagctgggccggggcacagccacctttgatggaacagccatcgccaatgctgtggtgaaggagctggccgagaccatcaagtgcaggaccctcttcagcacccactaccacatcagcagaagactcttcagcaagtgctgctgcctgggccacatggcctgcatggtggagaatgaatgtgaggaccccagccaggagaccatcaccttcctgtacaagttcatcaagggggcctgccccaagagctatggcttcaatgctgcccggctggccaacctgcctgaggaggtgatccagaagggccacaggaaggcccgggagtttgagaagatgaaccagagcctgcggctcttccgggaggtgtgcctggccagcgagaggagcacagtggatgctgaggccgtgcacaagctgctgaccctcatcaaggagctgtag

SEQ ID NO: 20642 - DNA, 3201 bp, Artificial Sequence
  Description of Artificial Sequence: Synthetic coding sequence
atgagccggcagagcaccctgtacagcttcttccccaagagccctgccctgagtgatgccaacaaggccagcgcccgggccagccgggagggcggccgggccgcctgcccccggggcctgtccttcccccggcggggctgcggcctggagcggggctgggcctggaggcccctggcccggagcgccagcccccccaaggccaagaacctgaatggaggcctgcggcgctctgtggccccagctgcccccaccagctgtgacttcagccctggggacctggtgtgggccaagatggagggctacccctggtggccctgcctggtgtacaaccacccctttgatggcaccttcatccgggagaagggcaagtctgtgcgggtgcacgtgcagttctttgatgacagccccacccggggctgggtgtccaagaggctgctgaagccctacacaggcagcaagagcaaggaggcccagaagggcggccacttctacagcgccaagccagagatcctgcgggccatgcagagagcagatgaggccctgaacaaggacaagatcaagaggctggagctggccgtgtgtgatgagcccagcgagcctgaggaggaggaggagatggaggtgggcaccacctacgtgacagacaagtcagaagaagataatgaaattgaaagtgaggaggaggtgcagcccaagacccagggcagcagaagaagcagccggcagatcaagaagagaagagtcatcagtgacagcgagagtgacatcggcggcagtgatgtggagttcaagccagacaccaaggaggagggcagcagtgatgagatcagcagcggcgtgggggacagcgagagcgagggcctgaacagccctgtgaaggtggccaggaagaggaagaggatggtgactggaaatggcagcctgaagaggaagagcagcaggaaggagaccccatctgccaccaagcaggccaccagcatcagcagcgagaccaagaacaccctgcgggccttcagcgccccccagaacagcgagagccaggcccacgtgtctggaggaggagatgacagcagccggcccaccgtgtggtaccacgagaccctggagtggctgaaggaggagaagagaagagatgagcacagaagaagaccagaccacccagactttgatgccagcaccctgtatgtgcctgaggacttcctgaacagctgcaccccaggcatgaggaagtggtggcagatcaagagccagaactttgacctggtgatctgctacaaggtgggcaagttctatgagctgtaccacatggatgccctgattggagtgtctgagctgggcctggtgttcatgaagggcaactgggcccacagcggcttccctgagatcgccttcggccgctacagcgacagcctggtgcagaagggctacaaggtggcccgggtggagcagacagagaccccagagatgatggaggcccgctgcaggaagatggcccacatcagcaaatatgacagagtggtgcggcgggagatctgccgcatcatcaccaagggcacccagacctacagcgtgctggagggggaccccagcgagaactacagcaagtacctgctgagcctgaaggagaaggaggaggacagcagcggccacacccgggcctacggcgtgtgctttgtggacaccagcctgggcaagttcttcatcggccagttcagtgatgacagacactgcagccgcttccgcaccctggtggcccactacccacctgtgcaggtgctgtttgagaagggcaacctgagcaaggagaccaagaccatcctgaagagcagcctgagctgcagcctgcaggagggcctcatccctggcagccagttctgggatgccagcaagaccctgcggaccctgctggaggaggagtacttccgggagaagctgagtgatggcattggagtgatgctgccccaggtgctgaagggcatgaccagcgagagtgacagcatcggcctgaccccaggagagaagtctgagctggccctgagcgccctgggcggctgtgtgttctacctgaagaagtgcctgattgaccaggagctgctgtccatggccaactttgaggagtacatccccctggacagcgacacagtgtccaccaccaggtctggggccatcttcaccaaggcctaccagaggatggtgctggatgctgtgaccctgaacaacctggagatcttcctgaatggcaccaacggcagcacagagggcaccctgctggagcgggtggacacctgccacaccccatttgggaagaggctgctgaagcagtggctgtgtgcccccctgtgcaaccactacgccatcaatgaccggctggatgccatcgaggacctgatggtggtgcctgacaagatcagcgaggtggtggagctgctgaagaagctgcctgacctggagcggctgctgagcaagatccacaacgtgggcagccccctgaagagccagaaccacccagacagccgggccatcatgtatgaggagaccacctacagcaagaagaagatcatcgacttcctgagcgccctggagggcttcaaggtgatgtgcaagatcatcggcatcatggaggaggtggctgatggcttcaagagcaagatcctgaagcaggtgatcagcctgcagaccaagaaccctgagggccgcttcccagacctgactgtggagctgaaccgctgggacacagcctttgaccacgagaaggccaggaagacaggcctcatcacccccaaggccggctttgacagcgactatgaccaggccctggccgacatccgggagaatgagcagagcctgctggagtacctggagaagcagaggaaccgcatcggctgcaggaccatcgtgtactggggcatcggcaggaaccgctaccagctggagatccctgagaacttcaccaccaggaacctgcctgaggagtatgagctgaagagcaccaagaagggctgcaagcgctactggaccaagaccatcgagaagaagctggccaacctgatcaatgctgaggagaggagagatgtgtccctgaaggactgcatgaggaggctcttctacaactttgacaagaactacaaggactggcagagcgctgtggagtgcatcgctgtgctgggcaagaccctgaacaagctggtgctgcggctgtag

SEQ ID NO: 20643 - DNA, 1569 bp, Artificial Sequence
  Description of Artificial Sequence: Synthetic coding sequence
atgaggaagcccagggctgctgtgggcagcggccacaggaagcaggccgccagccaggagggccggcagaagcacgccaagaacaacagccaggccaagcccagcgcctgtgatgctggcctggcccggcagcctgaggaggtggtgctgcaggcctctgtgagcagctaccacctgttcagagatgtggccgaggtgacagccttccggggcagcctgctgtcctggtatgaccaggagaagagggacctgccctggaggcggcgggcagaagatgagatggacctggaccggcgggcctatgctgtgtgggtgtctgaggtgatgctgcagcagacccaggtggccaccgtcatcaactactacacaggctggatgcagaagtggcccaccctgcaggacctggccagcgccagcctggaggaggtgaaccagctgtgggccggcctgggctactacagccggggccgccgcctgcaggagggcgccaggaaggtggtggaggagctgggcggccacatgcccaggacagctgagaccctgcagcagctgctgcccggggtgggccgctacacagctggggccatcgccagcatcgccttcggccaggccactggagtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcccggcagagggtggagcaggagcagctgctggccagcggcagcctgagcggcagcccagatgtggaggagtgtgcccccaacacaggccagtgccacctgtgcctgcccccatctgagccctgggaccagaccctgggcgtggtgaacttccccaggaaggccagcaggaagccaccccgggaggagagcagcgccacctgtgtgctggagcagcccggggccctgggcgcccagatcctgctggtgcagaggcccaacagcggcctgctggccggcctgtgggagttccccagcgtgacctgggagcccagcgagcagctgcagaggaaggccctgctgcaggagctgcagcgctgggccggccccctgcctgccacccacctgcggcacctgggggaggtggtgcacaccttcagccacatcaagctgacctaccaggtgtatggcctggccctggagggccagacccctgtgaccaccgtgcccccaggggcccgctggctgacccaggaggagttccacacagctgctgtgtccacagccatgaagaaggtgttccgggtgtaccagggccagcagcccggcacctgcatgggcagcaagaggagccaggtgagcagcccctgcagcaggaagaagcccaggatgggccagcaggtgctggacaacttcttccgcagccacatcagcacagatgcccacagcctgaacagcgctgcccagtag

SEQ ID NO: 20644 - DNA, 1566 bp, Artificial Sequence
  Description of Artificial Sequence: Synthetic coding sequence
atgaggaagcccagggctgctgtgggcagcggccacaggaagcaggccgccagccaggagggccggcagaagcacgccaagaacaacagccaggccaagcccagcgcctgtgatggcctggcccggcagcctgaggaggtggtgctgcaggcctctgtgtcctcctaccacctgttcagagatgtggccgaggtgacagccttccggggcagcctgctgtcctggtatgaccaggagaagagggacctgccctggaggagaagagcagaagatgagatggacctggacagaagagcctatgctgtgtgggtgtctgaggtgatgctgcagcagacccaggtggccaccgtcatcaactactacacaggctggatgcagaagtggcccaccctgcaggacctggccagcgccagcctggaggaggtgaaccagctgtgggccggcctgggctactacagccggggccggcggctgcaggagggcgccaggaaggtggtggaggagctgggcggccacatgcccaggacagctgagaccctgcagcagctgctgcccggggtgggccgctacacagctggggccatcgccagcatcgccttcggccaggccaccggggtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcccggcagagggtggagcaggagcagctgctggccagcggcagcctgagcggcagcccagatgtggaggagtgtgcccccaacacaggccagtgccacctgtgcctgccccccagcgagccctgggaccagaccctgggcgtggtgaacttccccaggaaggccagcaggaagccaccccgggaggagagcagcgccacctgtgtgctggagcagcccggggccctgggcgcccagatcctgctggtgcagaggcccaacagcggcctgctggccggcctgtgggagttccccagcgtgacctgggagcccagcgagcagctgcagaggaaggccctgctgcaggagctgcagcgctgggccggccccctgcctgccacccacctgcggcacctgggggaggtggtgcacaccttcagccacatcaagctgacctaccaggtgtatggcctggccctggagggccagacccctgtgaccaccgtgcccccaggggcccgctggctgacccaggaggagttccacacagctgctgtgtccacagccatgaagaaggtgttccgggtgtaccagggccagcagcccggcacctgcatgggcagcaagaggagccaggtgagcagcccctgcagcaggaagaagcccaggatgggccagcaggtgctggacaacttcttccgcagccacatcagcacagatgcccacagcctgaacagcgctgcccagtag

SEQ ID NO: 20645 - DNA, 1641 bp, Artificial Sequence
  Description of Artificial Sequence: Synthetic coding sequence
atgacccccctggtgtcccggctgagccggctgtgggccatcatgaggaagcccagggctgctgtgggcagcggccacaggaagcaggccgccagccaggagggccggcagaagcacgccaagaacaacagccaggccaagcccagcgcctgtgatggcatgattgctgaatgtcctggggccccagctggcctggcccggcagcctgaggaggtggtgctgcaggcctctgtgagcagctaccacctgttcagagatgtggccgaggtgacagccttccggggcagcctgctgtcctggtatgaccaggagaagagggacctgccctggaggcggcgggcagaagatgagatggacctggaccggcgggcctatgctgtgtgggtgtctgaggtgatgctgcagcagacccaggtggccaccgtcatcaactactacacaggctggatgcagaagtggcccaccctgcaggacctggccagcgccagcctggaggaggtgaaccagctgtgggccggcctgggctactacagccggggccgccgcctgcaggagggcgccaggaaggtggtggaggagctgggcggccacatgcccaggacagctgagaccctgcagcagctgctgcccggggtgggccgctacacagctggggccatcgccagcatcgccttcggccaggccactggagtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcccggcagagggtggagcaggagcagctgctggccagcggcagcctgagcggcagcccagatgtggaggagtgtgcccccaacacaggccagtgccacctgtgcctgcccccatctgagccctgggaccagaccctgggcgtggtgaacttccccaggaaggccagcaggaagccaccccgggaggagagcagcgccacctgtgtgctggagcagcccggggccctgggcgcccagatcctgctggtgcagaggcccaacagcggcctgctggccggcctgtgggagttccccagcgtgacctgggagcccagcgagcagctgcagaggaaggccctgctgcaggagctgcagcgctgggccggccccctgcctgccacccacctgcggcacctgggggaggtggtgcacaccttcagccacatcaagctgacctaccaggtgtatggcctggccctggagggccagacccctgtgaccaccgtgcccccaggggcccgctggctgacccaggaggagttccacacagctgctgtgtccacagccatgaagaaggtgttccgggtgtaccagggccagcagcccggcacctgcatgggcagcaagaggagccaggtgagcagcccctgcagcaggaagaagcccaggatgggccagcaggtgctggacaacttcttccgcagccacatcagcacagatgcccacagcctgaacagcgctgcccagtag

SEQ ID NO: 20646 - DNA, 1599 bp, Artificial Sequence
  Description of Artificial Sequence: Synthetic coding sequence
atgaggaagcccagggctgctgtgggcagcggccacaggaagcaggccgccagccaggagggccggcagaagcacgccaagaacaacagccaggccaagcccagcgcctgtgatggcatgattgctgaatgtcctggggccccagctggcctggcccggcagcctgaggaggtggtgctgcaggcctctgtgagcagctaccacctgttcagagatgtggccgaggtgacagccttccggggcagcctgctgtcctggtatgaccaggagaagagggacctgccctggaggcggcgggcagaagatgagatggacctggaccggcgggcctatgctgtgtgggtgtctgaggtgatgctgcagcagacccaggtggccaccgtcatcaactactacacaggctggatgcagaagtggcccaccctgcaggacctggccagcgccagcctggaggaggtgaaccagctgtgggccggcctgggctactacagccggggccgccgcctgcaggagggcgccaggaaggtggtggaggagctgggcggccacatgcccaggacagctgagaccctgcagcagctgctgcccggggtgggccgctacacagctggggccatcgccagcatcgccttcggccaggccactggagtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcccggcagagggtggagcaggagcagctgctggccagcggcagcctgagcggcagcccagatgtggaggagtgtgcccccaacacaggccagtgccacctgtgcctgcccccatctgagccctgggaccagaccctgggcgtggtgaacttccccaggaaggccagcaggaagccaccccgggaggagagcagcgccacctgtgtgctggagcagcccggggccctgggcgcccagatcctgctggtgcagaggcccaacagcggcctgctggccggcctgtgggagttccccagcgtgacctgggagcccagcgagcagctgcagaggaaggccctgctgcaggagctgcagcgctgggccggccccctgcctgccacccacctgcggcacctgggggaggtggtgcacaccttcagccacatcaagctgacctaccaggtgtatggcctggccctggagggccagacccctgtgaccaccgtgcccccaggggcccgctggctgacccaggaggagttccacacagctgctgtgtccacagccatgaagaaggtgttccgggtgtaccagggccagcagcccggcacctgcatgggcagcaagaggagccaggtgagcagcccctgcagcaggaagaagcccaggatgggccagcaggtgctggacaacttcttccgcagccacatcagcacagatgcccacagcctgaacagcgctgcccagtag

SEQ ID NO: 20647 - DNA, 1566 bp, Artificial Sequence; identical to SEQ ID NO: 20644
  Description of Artificial Sequence: Synthetic coding sequence

SEQ ID NO: 20648 - DNA, 1611 bp, Artificial Sequence
  Description of Artificial Sequence: Synthetic coding sequence
atgacccccctggtgtcccggctgagccggctgtgggccatcatgaggaagcccagggctgctgtgggcagcggccacaggaagcaggccgccagccaggagggccggcagaagcacgccaagaacaacagccaggccaagcccagcgcctgtgatgctggcctggcccggcagcctgaggaggtggtgctgcaggcctctgtgagcagctaccacctgttcagagatgtggccgaggtgacagccttccggggcagcctgctgtcctggtatgaccaggagaagagggacctgccctggaggcggcgggcagaagatgagatggacctggaccggcgggcctatgctgtgtgggtgtctgaggtgatgctgcagcagacccaggtggccaccgtcatcaactactacacaggctggatgcagaagtggcccaccctgcaggacctggccagcgccagcctggaggaggtgaaccagctgtgggccggcctgggctactacagccggggccgccgcctgcaggagggcgccaggaaggtggtggaggagctgggcggccacatgcccaggacagctgagaccctgcagcagctgctgcccggggtgggccgctacacagctggggccatcgccagcatcgccttcggccaggccactggagtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcccggcagagggtggagcaggagcagctgctggccagcggcagcctgagcggcagcccagatgtggaggagtgtgcccccaacacaggccagtgccacctgtgcctgcccccatctgagccctgggaccagaccctgggcgtggtgaacttccccaggaaggccagcaggaagccaccccgggaggagagcagcgccacctgtgtgctggagcagcccggggccctgggcgcccagatcctgctggtgcagaggcccaacagcggcctgctggccggcctgtgggagttccccagcgtgacctgggagcccagcgagcagctgcagaggaaggccctgctgcaggagctgcagcgctgggccggccccctgcctgccacccacctgcggcacctgggggaggtggtgcacaccttcagccacatcaagctgacctaccaggtgtatggcctggccctggagggccagacccctgtgaccaccgtgcccccaggggcccgctggctgacccaggaggagttccacacagctgctgtgtccacagccatgaagaaggtgttccgggtgtaccagggccagcagcccggcacctgcatgggcagcaagaggagccaggtgagcagcccctgcagcaggaagaagcccaggatgggccagcaggtgctggacaacttcttccgcagccacatcagcacagatgcccacagcctgaacagcgctgcccagtag

SEQ ID NO: 20649 - DNA, 1608 bp, Artificial Sequence
  Description of Artificial Sequence: Synthetic coding sequence
atgacccccctggtgtcccggctgagccggctgtgggccatcatgaggaagcccagggctgctgtgggcagcggccacaggaagcaggccgccagccaggagggccggcagaagcacgccaagaacaacagccaggccaagcccagcgcctgtgatggcctggcccggcagcctgaggaggtggtgctgcaggcctctgtgtcctcctaccacctgttcagagatgtggccgaggtgacagccttccggggcagcctgctgtcctggtatgaccaggagaagagggacctgccctggaggagaagagcagaagatgagatggacctggacagaagagcctatgctgtgtgggtgtctgaggtgatgctgcagcagacccaggtggccaccgtcatcaactactacacaggctggatgcagaagtggcccaccctgcaggacctggccagcgccagcctggaggaggtgaaccagctgtgggccggcctgggctactacagccggggccggcggctgcaggagggcgccaggaaggtggtggaggagctgggcggccacatgcccaggacagctgagaccctgcagcagctgctgcccggggtgggccgctacacagctggggccatcgccagcatcgccttcggccaggccaccggggtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcccggcagagggtggagcaggagcagctgctggccagcggcagcctgagcggcagcccagatgtggaggagtgtgcccccaacacaggccagtgccacctgtgcctgccccccagcgagccctgggaccagaccctgggcgtggtgaacttccccaggaaggccagcaggaagccaccccgggaggagagcagcgccacctgtgtgctggagcagcccggggccctgggcgcccagatcctgctggtgcagaggcccaacagcggcctgctggccggcctgtgggagttccccagcgtgacctgggagcccagcgagcagctgcagaggaaggccctgctgcaggagctgcagcgctgggccggccccctgcctgccacccacctgcggcacctgggggaggtggtgcacaccttcagccacatcaagctgacctaccaggtgtatggcctggccctggagggccagacccctgtgaccaccgtgcccccaggggcccgctggctgacccaggaggagttccacacagctgctgtgtccacagccatgaagaaggtgttccgggtgtaccagggccagcagcccggcacctgcatgggcagcaagaggagccaggtgagcagcccctgcagcaggaagaagcccaggatgggccagcaggtgctggacaacttcttccgcagccacatcagcacagatgcccacagcctgaacagcgctgcccagtag

SEQ ID NO: 20650 - DNA, 876 bp, Artificial Sequence
  Description of Artificial Sequence: Synthetic coding sequence
atgaggaagcccagggctgctgtgggcagcggccacaggaagcaggccgccagccaggagggccggcagaagcacgccaagaacaacagccaggccaagcccagcgcctgtgatggcatgattgctgaatgtcctggggccccagctggcctggcccggcagcctgaggaggtggtgctgcaggcctctgtgagcagctaccacctgttcagagatgtggccgaggtgacagccttccggggcagcctgctgtcctggtatgaccaggagaagagggacctgccctggaggcggcgggcagaagatgagatggacctggaccggcgggcctatgctgtgtgggtgtctgaggtgatgctgcagcagacccaggtggccaccgtcatcaactactacacaggctggatgcagaagtggcccaccctgcaggacctggccagcgccagcctggaggaggtgaaccagctgtgggccggcctgggctactacagccggggccgccgcctgcaggagggcgccaggaaggtggtggaggagctgggcggccacatgcccaggacagctgagaccctgcagcagctgctgcccggggtgggccgctacacagctggggccatcgccagcatcgccttcggccaggccactggagtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcctag

SEQ ID NO: 20651 - DNA, 1599 bp, Artificial Sequence; identical to SEQ ID NO: 20646
  Description of Artificial Sequence: Synthetic coding sequence

SEQ ID NO: 20652 - DNA, 1650 bp, Artificial Sequence
  Description of Artificial Sequence: Synthetic coding sequence
atgacccccctggtgtcccggctgagccggctgtgggccatcatgaggaagcccagggctgctgtgggcagcggccacaggaagcaggccgccagccaggagggccggcagaagcacgccaagaacaacagccaggccaagcccagcgcctgtgatgcctgtgccggcatgattgctgagtgccctggggccccagctggcctggcccggcagcctgaggaggtggtgctgcaggcctctgtgtcctcctaccacctgttcagagatgtggccgaggtgacagccttccggggcagcctgctgtcctggtatgaccaggagaagagggacctgccctggaggagaagagcagaagatgagatggacctggacagaagagcctatgctgtgtgggtgtctgaggtgatgctgcagcagacccaggtggccaccgtcatcaactactacacaggctggatgcagaagtggcccaccctgcaggacctggccagcgccagcctggaggaggtgaaccagctgtgggccggcctgggctactacagccggggccggcggctgcaggagggcgccaggaaggtggtggaggagctgggcggccacatgcccaggacagctgagaccctgcagcagctgctgcccggggtgggccgctacacagctggggccatcgccagcatcgccttcggccaggccaccggggtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcccggcagagggtggagcaggagcagctgctggccagcggcagcctgagcggcagcccagatgtggaggagtgtgcccccaacacaggccagtgccacctgtgcctgccccccagcgagccctgggaccagaccctgggcgtggtgaacttccccaggaaggccagcaggaagccaccccgggaggagagcagcgccacctgtgtgctggagcagcccggggccctgggcgcccagatcctgctggtgcagaggcccaacagcggcctgctggccggcctgtgggagttccccagcgtgacctgggagcccagcgagcagctgcagaggaaggccctgctgcaggagctgcagcgctgggccggccccctgcctgccacccacctgcggcacctgggggaggtggtgcacaccttcagccacatcaagctgacctaccaggtgtatggcctggccctggagggccagacccctgtgaccaccgtgcccccaggggcccgctggctgacccaggaggagttccacacagctgctgtgtccacagccatgaagaaggtgttccgggtgtaccagggccagcagcccggcacctgcatgggcagcaagaggagccaggtgagcagcccctgcagcaggaagaagcccaggatgggccagcaggtgctggacaacttcttccgcagccacatcagcacagatgcccacagcctgaacagcgctgcccagtag

SEQ ID NO: 20653 - DNA, 1566 bp, Artificial Sequence; identical to SEQ ID NO: 20644
  Description of Artificial Sequence: Synthetic coding sequence

SEQ ID NO: 20654 - DNA, 648 bp, Artificial Sequence
  Description of Artificial Sequence: Synthetic coding sequence
atgacccccctggtgtcccggctgagccggctgtgggaggtgaaccagctgtgggccggcctgggctactacagccggggccggcggctgcaggagggcgccaggaaggtggtggaggagctgggcggccacatgcccaggacagctgagaccctgcagcagctgctgcccggggtgggccgctacacagctggggccatcgccagcatcgccttcggccaggccaccggggtggtggatggaaatgtggcccgggtgctgtgccgggtgcgggccatcggggctgaccccagcagcaccctggtgtcccagcagctgtggggcctggcccagcagctggtggaccctgcccggcctggggacttcaaccaggccgccatggagctgggcgccaccgtgtgcaccccccagaggcccctgtgcagccagtgccctgtggagagcctgtgccgggcccggcagagggtggagcaggagcagctgctggccagcggcagcctgagcggcagcccagatgtggaggagtgtgcccccaacacaggccagtgccacctgtgcctgccccccagcgagccctgggaccagaccctgggcgtggtgaacttccccaggaaggccagcaggaagccaccccgggaggagagctag

SEQ ID NO: 20655 - DNA, 693 bp, Artificial Sequence
  Description of Artificial Sequence: Synthetic coding sequence
atgacccccctggtgtcccggctgagccggctgtgggccatcatgaggaagcccagggctgctgtgggcagcggccacaggaagcaggccgccagccaggagggccggcagaagcacgccaagaacaacagccaggccaagcccagcgcctgtgatggaggagagagcaccctgggctggccaggcctgctcttctcctggccagctgctgctgggggcagcagcgagggcctgctggccggcctgtgggagttccccagcgtgacctgggagcccagcgagcagctgcagaggaaggccctgctgcaggagctgcagcgctgggccggccccctgcctgccacccacctgcggcacctgggggaggtggtgcacaccttcagccacatcaagctgacctaccaggtgtatggcctggccctggagggccagacccctgtgaccaccgtgcccccaggggcccgctggctgacccaggaggagttccacacagctgctgtgtccacagccatgaagaaggtgttccgggtgtaccagggccagcagcccggcacctgcatgggcagcaagaggagccaggtgagcagcccctgcagcaggaagaagcccaggatgggccagcaggtgctggacaacttcttccgcagccacatcagcacagatgcccacagcctgaacagcgctgcccagtag

SEQ ID NO: 20656 - DNA, 291 bp, Artificial Sequence
  Description of Artificial Sequence: Synthetic coding sequence
atgtctgacaatgatgacatcgaggtggagagtgatgaggagcagccccgcttccagagcgctgctgacaagagggcccaccacaatgccctggagaggaagagaagagaccacatcaaggacagcttccacagcctgcgggacagcgtgcccagcctgcagggcgagaagctgtacttcctgttctggaagctgtgcacccctgtgctgcaccggcagagcctgatgcagaagtgccacaccttcatcagcagctaccaggtgcacaagaagaaggagtgcaagatctag

SEQ ID NO: 20657 - DNA, 405 bp, Artificial Sequence
  Description of Artificial Sequence: Synthetic coding sequence
atgtctgacaatgatgacatcgaggtggagagtgatgaggagcagccccgcttccagagcgctgctgacaagagggcccaccacaatgccctggagaggaagagaagagaccacatcaaggacagcttccacagcctgcgggacagcgtgcccagcctgcagggcgagaaggccagccgggcccagatcctggacaaggccacagagtacatccagtacatgaggaggaagaaccacacccaccagcaggacattgatgacctgaagaggcagaatgccctgctggagcagcagggcgagcaccccagctcctggggctcctggccctgctgtgccccagcccggagcggcttcggcacctgggcctgccgggtgcgggccagccatggagtgtgtgcccagtag

SEQ ID NO: 20658 - DNA, 252 bp, Artificial Sequence
  Description of Artificial Sequence: Synthetic coding sequence
atgtctgacaatgatgacatcgaggtggagagtgatgaggagcagccccgcttccagagcgctgctgacaagagggcccaccacaatgccctggagaggaagagaagagaccacatcaaggacagcttccacagcctgcgggacagcgtgcccagcctgcagggcgagaagggcaccaagatgaagctgaccctgccccctgtgttcccctatgagcacctgcccttccccaccgtcttctgccacggctag

SEQ ID NO: 20659 - DNA, 456 bp, Artificial Sequence
  Description of Artificial Sequence: Synthetic coding sequence
atgtctgacaatgatgacatcgaggtggagagtgatgctgacaagagggcccaccacaatgccctggagaggaagaggcgggaccacatcaaggacagcttccacagcctgcgggacagcgtgcccagcctgcagggcgagaaggccagccgggcccagatcctggacaaggccacagagtacatccagtacatgaggaggaagaaccacacccaccagcaggacattgatgacctgaagaggcagaatgccctgctggagcagcaggtgcgggccctggagaaggcccggagcagcgcccagctgcagaccaactaccccagcagtgacaacagcctgtacaccaatgccaagggcagcaccatcagcgcctttgatggcggcagtgacagcagcagcgagagcgagcctgaggagccccagagcaggaagaagctgaggatggaggccagctag

SEQ ID NO: 20660 - DNA, 483 bp, Artificial Sequence
  Description of Artificial Sequence: Synthetic coding sequence
atgtctgacaatgatgacatcgaggtggagagtgatgaggagcagccccgcttccagagcgctgctgacaagagggcccaccacaatgccctggagaggaagagaagagaccacatcaaggacagcttccacagcctgcgggacagcgtgcccagcctgcagggcgagaaggccagccgggcccagatcctggacaaggccacagagtacatccagtacatgaggaggaagaaccacacccaccagcaggacattgatgacctgaagaggcagaatgccctgctggagcagcaggtgcgggccctggagaaggcccggagcagcgcccagctgcagaccaactaccccagcagtgacaacagcctgtacaccaatgccaagggcagcaccatcagcgcctttgatggcggcagtgacagcagcagcgagagcgagcctgaggagccccagagcaggaagaagctgaggatggaggccagctag

SEQ ID NO: 20661 - DNA, 426 bp, Artificial Sequence
  Description of Artificial Sequence: Synthetic coding sequence
atgctgtctgtgaagatcaccagcatcttcagcatcttcttcttcctgctcttccaggaggagcagccccgcttccagagcgctgctgacaagagggcccaccacaatgccctggagaggaagaggcgggaccacatcaaggacagcttccacagcctgcgggacagcgtgcccagcctgcagggcgagaaggccagccgggcccagatcctggacaaggccacagagtacatccagtacatgaggaggaagaaccacacccaccagcaggacattgatgacctgaagaggcagaatgccctgctggagcagcagggcgagcaccccagctcctggggctcctggccctgctgtgccccagcccggagcggcttcggcacctgggcctgccgggtgcgggccagccacggcgtgtgtgcccagtag

SEQ ID NO: 20662 - DNA, 312 bp, Artificial Sequence
  Description of Artificial Sequence: Synthetic coding sequence
atgtctgacaatgatgacatcgaggtggagagtgatgaggagcagccccgcttccagagcgctgctgacaagagggcccaccacaatgccctggagaggaagagaagagaccacatcaaggacagcttccacagcctgcgggacagcgtgcccagcctgcagggcgagaaggccagccgggcccagatcctggacaaggccacagagtacatccagtacatgaggaggaagaaccacacccaccagcaggacattgatgacctgaagaggcagaatgccctgctggagcagcagggcgagagcgagagctag

SEQ ID NO: 20663 - DNA, 312 bp, Artificial Sequence; identical to SEQ ID NO: 20662
  Description of Artificial Sequence: Synthetic coding sequence

SEQ ID NO: 20664 - DNA, 13923 bp, Artificial Sequence
  Description of Artificial Sequence: Synthetic coding sequence
atgcctgtgcctgatggctctgtggccgctgctggcctgggcctgggcctgcctgctgctgacagccggggccactaccagctgctgctgagcggccgggccctggccgaccgctaccgccgcatctacacagctgccctgaatgaccgggaccagggcggcggcagcgctggccacccagccagcaggaacaagaagatcctgaacaagaagaagctgaagaggaagcagaagagcaagagcaaggtgaagaccaggagcaagtctgagaacctggagaacacagtcatcatcccagacatcaagctgcacagcaaccccagcgccttcaacatctactgcaatgtgcgccactgtgtgctggagtggcagaagaaggagatcagcctggccgccgccagcaagaacagcgtgcagagcggggagagtgacagtgatgaggaggaggagagcaaggagccccccatcaagctgcccaagatcatcgaggtgggcctgtgtgaggtgtttgagctgatcaaggagacccgcttcagccaccccagcctgtgcctgcggagcctgcaggccctgctgaatgtgctgcagggccagcagcctgagggcctgcagagcgagcccccagaggtgctggagagcctcttccagctgctgctggagatcaccgtgcgcagcacaggcatgaatgacagcacaggccagagcctgacagccctgagctgtgcctgcctcttcagcctggtggcctcctggggcgagaccggccgcaccctgcaggccatcagcgccatcctgaccaacaacggcagccacgcctgccagaccatccaggtgcccaccatcctgaacagcctgcagaggtctgtgcaggccgtgctggtgggcaagatccagatccaggactggttcagcaatggcatcaagaaggccgccctgatgcacaagtggcccctgaaggagatctctgtggatgaagatgaccagtgcctgctgcagaatgatggcttcttcctgtacctgctgtgcaaggatggcctgtacaagattggcagcggctacagcggcaccgtgcggggccacatctacaacagcaccagccgcatccggaacaggaaggagaagaagtcctggctgggctacgcccagggctacctgctgtacagagatgtgaacaaccacagcatgacagccatccgcatcagccctgagaccctggagcaggacggcaccgtgatgctgcctgactgccacacagagggccagaacatcctcttcacagatggagagtacatcaaccagattgctgccagcagagatgatggctttgtggtgcgcatctttgccaccagcacagagcctgtgctgcagcaggagctgcagctgaagctggccaggaagtgcctgcacgcctgtggcatcagcctgtttgacctggagaaggacctgcacatcatcagcactggatttgatgaggagagcgccatcctgggcgccggccgggagtttgccctgatgaagacagccaacgggaagatctactacacaggcaagtaccagagcctgggcatcaagcagggcggccccagcgctgggaagtgggtggagctgcccatcaccaagagccccaagatcgtgcacttctctgtgggccatgatggcagccacgccctgctggtggctgaagatggcagcatcttcttcaccggcagcgccagcaaaggagaagatggagagagcaccaagagccggcggcagagcaagccctacaagcccaagaagatcatcaagatggagggcaagatcgtggtgtacacagcctgcaacaacggcagcagcagcgtcatcagcaaggatggagagctgtacatgtttgggaaggatgccatctacagcgacagcagcagcctggtgacagacctgaagggccactttgtgacccaggtggccatgggcaaggcccacacctgtgtgctgatgaagaatggagaggtgtggacctttggagtgaacaacaagggccagtgtggccgggacacaggagccatgaaccagggcggcaaaggatttggagtggagaacatggccacagccatggatgaggacctggaggaggagctggatgagaaggatgagaagtccatgatgtgccccccaggcatgcacaagtggaagctggagcagtgcatggtgtgcaccgtgtgtggggactgcaccggctacggggccagctgtgtgagcagcggccgcccagacagagtgcctgggggcatctgtggctgcggcagcggggagagcggctgtgctgtgtgtggctgctgcaaggcctgtgcccgggagctggatggccaggaggcccggcagaggggcatcctggatgctgtgaaggagatgatccccctggacctgctgctggccgtgcctgtgcctggggtgaacatcgaggagcacctgcagctgcggcaggaggagaagaggcagagggtcatccgccgccaccggctggaggagggccggggccccctggtgtttgctggccccatcttcatgaaccaccgggagcaggccctggcccggctgcggagccacccagcccagctgaagcacaagagggacaagcacaaggatggcagcggggagcggggggagaaggatgccagcaagatcaccacctacccacctggctctgtgcgctttgactgtgagctgcgggctgtgcaggtgtcctgtggcttccaccacagcgtggtgctgatggagaatggagatgtgtacaccttcggctacggccagcacggccagctgggccatggagatgtgaacagccggggctgccccaccctggtgcaggccctgcccggccccagcacccaggtgacagctggcagcaaccacacagctgtgctgctgatggatggccaggtgttcaccttcggcagcttcagcaagggccagctgggccggcccatcctggatgtgccctactggaatgccaagccagcccccatgcccaacatcggcagcaaatatggcaggaaggccacctggattggagccagcggggaccagaccttcctgagaattgatgaggccctgatcaacagccacgtgctggccaccagcgagatctttgccagcaagcacatcatcggcctggtgcctgccagcatcagcgagcccccacccttcaagtgcctgctgatcaacaaggtggatggcagctgcaagaccttcaatgacagcgagcaggaggacctgcagggcttcggcgtgtgcctggaccctgtgtatgatgtgatctggaggttccggcccaacacccgggagctgtggtgctacaatgctgtggtggctgatgcccggctgcccagcgctgctgacatgcagagccgctgcagcatcctgagccctgagctggccctgcccaccggcagccgggccctgaccaccaggagccatgctgccctgcacatcctgggctgcctggacaccctggccgccatgcaggacctgaagatgggcgtggccagcacagaggaggagacccaggccgtgatgaaggtgtacagcaaagaagactacagcgtggtgaacagatttgagagccacggcggcggctggggctacagcgcccacagcgtggaggccatccgcttctctgctgacacagacatcctgctgggcggcctgggcctgtttggaggccgcggggagtacacagccaagatcaagctgtttgagctgggcccagatggaggagaccacgagacagatggagacctgctggccgagacagatgtgctggcctatgactgtgccgcccgggagaagtatgccatgatgtttgatgagcctgtgctgctgcaggccggctggtggtacgtggcctgggcccgggtgtctggccccagcagtgactgtggcagccacggccaggccagcatcaccacagatgatggagtggtgttccagttcaagagcagcaagaagagcaacaacggcacagatgtgaatgccggccagatcccccagctgctgtaccgcctgcccaccagtgatggcagcgccagcaagggcaagcagcagaccagcgagcctgtgcacatcctgaagaggagctttgccaggacagtgtctgtggagtgctttgagagcctgctgagcatcctgcactggagctggaccaccctggtgctgggcgtggaggagctgcggggcctgaagggcttccagttcaccgccaccctgctggacctggagcggctgcgctttgtgggcacctgctgcctgcggctgctgcgggtgtacacctgtgagatctaccctgtgtctgccaccgggaaggctgtggtggaggagaccagcaagctggccgagtgcatcggcaagaccaggaccctgctgaggaagatcctgtctgagggcgtggaccactgcatggtgaagctggacaatgacccccagggctacctgagccagcccctgagcctgctggaggccgtgctgcaggagtgccacaacaccttcaccgcctgcttccacagcttctaccccaccccagccctgcagtgggcctgcctgtgtgacctgctgaactgcctggaccaggacatccaggaggccaacttcaagaccagcagcagccggctgctggccgctgtgatgtctgccctgtgccacacctctgtgaagctgaccagcatcttccccatcgcctatgatggagaggtgctgctgcggagcatcgtgaagcaggtgtccacagaaaatgacagcaccctggtgcaccgcttccccctgctggtggcccacatggagaagctgagccagagcgaggagaacatcagcggcatgaccagcttccgggaggtgctggagaagatgctggtgattgtggtgctgcctgtgaggaacagcctgcggcgggagaatgaactcttcagcagccacctggtgagcaacacctgtggcctgctggccagcatcgtgtctgagctgacagccagcgccctgggcagcgaggtggatggcctgaacagcctgcacagcgtgaaggccagcgccaaccgcttcaccaagaccagccagggccgctcctggaacacaggaaatggcagcccagatgccatctgcttctctgtggacaagccaggcatcgtggtggtgggcttctctgtgtatggaggcggcggcatccacgagtatgagctggaggtgctggtggatgattctgaacatgctggggacagcacccacagccaccgctggaccagcctggagctggtgaagggcacctacaccacagatgacagccccagcgacattgctgagatccggctggacaaggtggtgcccctgaaggaaaatgtgaagtatgctgtgcggctgaggaactacggcagcaggacagccaatggagatggcggcatgaccaccgtgcagtgcccagatggagtgaccttcaccttcagcacctgcagcctgagcagcaatggcaccaaccagacccggggccagatcccccagatcctgtactacagaagtgaatttgatggagacctgcagagccagctgctgagcaaggccaatgaggaggacaagaactgcagccgggccctgtctgtggtgtccacagtggtgcgggccagcaaggacctgctgcaccgggccctggccgtggatgctgatgacatccctgagctgctgagcagcagcagcctcttctccatgctgctgcccctcatcatcgcctacatcggccctgtggccgccgccatccccaaggtggccgtggaggtgtttggcctggtgcagcagctgctgcccagcgtggccatcctgaaccagaagtatgcccccccagccttcaaccccaaccagagcacagacagcaccactggaaaccagcctgagcagggcctgagcgcctgcaccaccagcagccactatgctgtgattgaaagtgagcacccctacaagccagcctgtgtgatgcactacaaggtgaccttcccagaatgtgtgcgctggatgaccatcgagtttgacccccagtgtggcacagcccagagtgaagatgtgctgcggctgctgatccctgtgaggacagtgcagaacagcggctacggccccaagctgacctctgtgcatgagaacctgaacagctggattgagctgaagaagttcagcggcagcagcggctggcccaccatggtgctggtgctgcctggaaatgaggccctcttcagcctggagacagccagtgactatgtgaaggatgacaaggccagcttctacggcttcaagtgctttgccatcggctatgagttcagccctggcccagatgagggcgtcatccagctggagaaggagctggccaacctgggcggcgtgtgtgccgccgccctgatgaagaaggacctggccctgcccatcggaaatgagctggaggaggacctggagatcctggaggaggccgccctgcaggtgtgcaagacccacagcggcatcctgggcaagggcctggccctgagccacagccccaccatcctggaggccctggagggcaacctgcccctgcagatccagagcaatgagcagagcttcctggatgacttcatcgcctgtgtgcccggcagcagcggcggccgcctggcccgctggctgcagcctgacagctatgctgacccccagaagaccagcctcatcctgaacaaggatgacatccgctgtggctggcccaccaccatcaccgtgcagaccaaggaccagtatggagatgtggtgcacgtgcccaacatgaaggtggaggtgaaggctgtgcctgtgtcccagaagaagatgagcctgcagcaggaccaggccaagaagccccagagaattcctggcagccctgctgtgacagctgccagcagcaacacagacatgacctacggcggcctggccagccccaagctggatgtgtcctatgagcccatgattgtgaaggaggcccgctacatcgccatcaccatgatgaaggtgtatgagaactacagctttgaggagctgcgctttgccagccccacccccaagaggcccagcgagaacatgctgatccgggtgaacaatgatggcacctactgtgccaactggacccctggggccatcggcctgtacaccctgcacgtgaccattgatggcatcgagattgatgctggcctggaggtgaaggtgaaggacccccccaagggcatgatccccccaggcacccagctggtgaagcccaagtctgagccccagcccaacaaggtgaggaagtttgtggccaaggacagcgctggcctgcgcatccgcagccaccccagcctgcagagcgagcagatcggcatcgtgaaggtgaatggcaccatcaccttcattgatgagatccacaatgatgatggagtgtggctgcggctgaatgatgagaccatcaagaagtatgtgcccaacatgaatggctacacagaggcctggtgcctgtccttcaaccagcacctgggcaagagcctgctggtgcctgtggatgagagcaagaccaacacagatgacttcttcaaggacatcaacagctgctgcccccaggaggccaccatgcaggagcaggacatgcccttcctgcggggcggccctggcatgtacaaggtggtgaagacaggccccagcggccacaacatccgcagctgccccaacctgcggggcatccccatcggcatgctggtgctgggcaacaaggtgaaggctgtgggggaggtgaccaacagcgagggcacctgggtgcagctggaccagaacagcatggtggagttctgtgagagtgatgaaggagaggcctggagcctggcccgggacagaggaggcaaccagtacctgcggcatgaagatgagcaggccctgctggaccagaacagccagaccccaccacccagccccttctctgtgcaggccttcaacaagggggccagctgcagcgcccagggctttgattatggcctgggcaacagcaaaggagaccggggcaacatcagcaccagcagcaagccagccagcaccagcggcaagtctgagctgagcagcaagcacagccgcagcctgaagccagatggccgcatgagcaggaccacagctgaccagaagaagccccggggcacagagagcctgagcgccagcgagagcctcatcctgaagagtgatgctgccaagctgcggagtgacagccacagccgcagcctgagccccaaccacaacaccctgcagaccctgaagagtgatggccgcatgcccagcagcagcagagctgagagccctggccctggcagccggctgagcagccccaagcccaagaccctgcctgccaacagaagcagccccagcggggccagcagccccaggagcagcagcccccatgacaagaacctgccccagaagagcacagcccctgtgaagaccaagctggaccccccccgggagaggagcaagagtgacagctacaccctggaccctgacaccctgaggaagaagaagatgcccctgacagagcccctgcggggccgcagcaccagccccaagcccaagtctgtgcccaaggacagcacagacagccctggctctgaaaatagagcccccagcccccacgtggtgcaggagaacctgcacagcgaggtggtggaggtgtgcaccagcagcaccctgaagaccaacagcctgacagacagcacctgtgatgacagcagcgagttcaagtctgtggatgagggcagcaacaaggtgcacttcagcatcggcaaggcccccctgaaggatgagcaggagatgagggccagccccaagatcagcaggaaatgtgccaacagacacacccggcccaagaaggagaagagcagcttcctgttcaagggagatggcagcaagcccctggagcccgccaagcaggccatgagccccagcgtggctgaatgtgcccgggctgtgtttgccagcttcctgtggcatgagggcatcgtgcatgatgccatggcctgcagcagcttcctgaagttccaccctgagctgagcaaggagcacgcccccatccgcagcagcctgaacagccagcagcccacagaggagaaggagaccaagctgaagaacagacacagcctggagatcagcagcgccctgaacatgttcaacatcgcccctcatggccctgacatcagcaagatgggcagcatcaacaagaacaaggtgctgtccatgctgaaggagccccccctgcacgagaagtgtgaagatggcaagacagagaccacctttgagatgtccatgcacaacaccatgaagagcaagagccccctgcccctgaccctgcagcacctggtggccttctgggaggacatcagcctggccaccatcaaggccgccagccagaacatgatcttccccagccctggcagctgtgctgtgctgaagaagaaggaatgtgagaaggagaacaagaagagcaagaaggagaagaagaagaaggagaaggccgaggtgcggccccggggcaacctgtttggagagatggcccagctggccgtgggcggccctgagaaggacaccatctgtgagctgtgtggggagagccacccctaccctgtgacctaccacatgaggcaggcccaccctggctgcggccgctatgccggcggccagggctacaacagcatcggccacttctgtggcggctgggccggcaactgtggagatggcggcattggaggcagcacctggtacctggtgtgtgaccgctgccgggagaagtacctgcgggagaagcaggccgccgcccgggagaaggtgaagcagagcaggaggaagcccatgcaggtgaagaccccccgggccctgcccaccatggaggcccaccaggtgatcaaggccaatgccctcttcctgctgagcctgagcagcgctgctgagcccagcatcctgtgctaccacccagccaagcccttccagagccagctgcccagcgtgaaggagggcatcagcgaggacctgcctgtgaagatgccctgcctgtacctgcagaccctggcccggcaccaccacgagaactttgtgggctaccaggatgacaacctcttccaggatgagatgagatacctgcggagcacctctgtgcctgccccctacatctctgtgaccccagatgccagccccaacgtgtttgaggagcctgagagcaacatgaagtccatgccacccagcctggagaccagccccatcacagacacagacctggccaagaggacagtgttccagaggagctacagcgtggtggcctctgaatatgacaagcagcacagcatcctgcctgcccgggtgaaggccatccccaggagaagagtgaacagcggggacacagaggtgggcagcagcctgctgcggcaccccagccctgagctgagccgcctcatcagcgcccacagcagcctgagcaagggggagaggaacttccagtggcctgtgctggccttcgtcatccagcaccacgacctggagggcctggagatcgccatgaagcaggccctgaggaagagcgcctgccgggtgtttgccatggaggccttcaactggctgctgtgcaacgtcatccagaccaccagcctgcatgacatcctgtggcactttgtggccagcctgaccccagcccctgtggagcctgaggaggaggaggatgaggagaacaagaccagcaaagaaaattctgagcaggagaaggacaccagggtgtgtgagcaccccctgagtgacatcgtgattgctggggaggccgcccaccccctgccccacaccttccaccggctgctgcagaccatcagtgacctgatgatgagcctgcccagcggcagcagcctgcagcagatggccctgcgctgctggagcctgaagttcaagcagagcgaccaccagttcctgcaccagagcaatgtgttccaccacatcaacaacatcctgagcaagagtgatgatggagacagcgaggagagcttcagcatcagcatccagagcggctttgaggccatgagccaggagctgtgcatcgtgatgtgcctgaaggacctgaccagcatcgtggacatcaagaccagcagcaggcctgccatgattggcagcctgacagatggcagcacagagaccttctgggagagcggagatgaggacaagaacaagaccaagaacatcaccatcaactgtgtgaagggcatcaatgcccgctacgtgtctgtgcacgtggacaacagccgggacctgggcaacaaggtgacctccatgaccttcctgaccgggaaggctgtggaggacctgtgccgcatcaagcaggtggacctggacagccgccacatcggctgggtgaccagcgagctgcccggcggggacaaccacatcatcaagattgagctgaagggccctgagaacaccctgcgggtgcggcaggtgaaggtgctgggctggaaggatggagagagcaccaagattgctggccagatcagcgcctctgtggcccagcagaggaactgtgaggccgagaccctgcgggtcttccgcctcatcaccagccaggtgtttgggaagctgatctctggagatgctgagcccaccccagagcaggaggagaaggccctgctgagcagccctgagggggaggagaaggtgtacaatgccaccagtgatgctgacctgaaggagcacatggtgggcatcatcttcagccgcagcaagctgaccaacctgcagaagcaggtgtgtgcccacatcgtgcaggccatccgcatggaggccaccagggtgcgggaggagtgggagcacgccatcagcagcaaagaaaatgccaacagccagcccaatgatgaagatgccagcagtgatgcctactgctttgagctgctgtccatggtgctggccctgagcggcagcaatgtgggccggcagtacctggcccagcagctgaccctgctgcaggacctcttcagcctgctgcacacagccagcccccgggtgcagaggcaggtgaccagcctgctgcggcgggtgctgcctgaggtgacccccagccggctggccagcatcatcggcgtgaagagcctgcccccagctgacatcagtgacatcatccacagcacagagaagggggactggaacaagctgggcatcctggacatgttcctgggctgcatcgccaaggccctgactgtgcagctgaaggccaagggcaccaccatcactggaacagctggcaccaccgtgggcaagggcgtgaccaccgtgaccctgcccatgatcttcaacagcagctacctgcggcggggggagagccactggtggatgaagggcagcacccccacccagatcagcgagatcatcatcaagctgatcaaggacatggccgccggccacctgtctgaggcctggagccgggtgaccaagaatgccatcgccgagaccatcatcgccctgaccaagatggaggaggagttccgcagccctgtgcgctgcatcgccaccacccggctgtggctggccctggccagcctgtgtgtgctggaccaggaccacgtggaccggctgagcagcggccgctggatgggcaaggatggccagcagaagcagatgcccatgtgtgacaaccatgatgatggagaaacagctgccatcatcctgtgcaatgtgtgtggcaacctgtgcacagactgtgaccgcttcctgcacctgcacaggaggaccaagacccaccagaggcaggtgttcaaggaggaggaggaggccatcaaggtggacctgcacgagggctgcggccgcaccaagctgttctggctgatggccctggccgacagcaagaccatgaaggccatggtggagttccgggagcacacaggcaagcccaccaccagcagcagcgaggcctgccgcttctgtggcagccgctctggaacagagctgtctgctgtgggctctgtgtgcagtgatgctgactgccaggagtatgccaagatcgcctgcagcaagacccacccctgtggccacccctgtggcggcgtgaagaatgaggagcactgcctgccctgcctgcacggctgtgacaagagcgccaccagcctgaagcaggatgctgatgacatgtgcatgatctgcttcacagaggccctgtctgctgccccagccatccagctggactgcagccacatcttccacctgcagtgctgccggcgggtgctggagaaccgctggctgggcccccgcatcaccttcggcttcatcagctgccccatctgcaagaacaagatcaaccacatcgtgctgaaggacctgctggaccccatcaaggagctgtatgaagatgtgcggaggaaggccctgatgaggctggagtatgagggcctgcacaagtctgaggccatcaccaccccaggagtgcgcttctacaatgaccctgctggctacgccatgaacagatatgcctactacgtgtgctacaagtgcaggaaggcctactttggaggagaggcccgctgtgatgctgaggccggcagaggagatgattatgacccccgggagctgatctgtggggcctgcagtgatgtgtcccgggcccagatgtgccccaagcacggcacagacttcctggagtacaagtgccgctactgctgcagcgtggccgtgttcttctgcttcggcaccacccacttctgcaatgcctgccatgatgacttccagaggatgaccagcatccccaaggaggagctgccccactgcccagctggccccaagggcaagcagctggagggcacagaatgtcccctgcacgtggtgcaccccccaactggagaggagtttgccctgggctgcggcgtgtgcagaaatgcccacaccttctag

SEQ ID NO: 20665 - DNA, 1542 bp, Artificial Sequence
  Description of Artificial Sequence: Synthetic coding sequence
atgcaggagcaggacatgcccttcctgcggggcggccctggcatgtacaaggtggtgaagacaggccccagcggccacaacatccgcagctgccccaacctgcggggcatccccatcggcatgctggtgctgggcaacaaggtgaaggctgtgggggaggtgaccaacagcgagggcacctgggtgcagctggaccagaacagcatggtggagttctgtgagagtgatgaaggagaggcctggagcctggcccgggaccggggcggcaaccagtacctgcggcatgaagatgagcaggccctgctggaccagaacagccagaccccaccacccagccccttctctgtgcaggccttcaacaagggggccagctgcagcgcccagggctttgattatggcctgggcaacagcaaggtgctgactgtgctgcccacagctggggaccagctgagcgccatcctgaacagcatccagagccggcccaacctgcctgcccccagcatctttgaccaggccgccaagccacccagcagcctggtgcacagcccctttgtgtttggccagcccctgtccttccagcagccccagctgcagagcgaccggggcaacatcagcaccagcagcaagccagccagcaccagcggcaagtctgagctgagcagcaagcacagccgcagcctgaagccagatggccgcatgagcaggaccacagctgaccagaagaagccccggggcacagagagcctgagcgccagcgagagcctcatcctgaagagtgatgctgccaagctgcggagtgacagccacagccgcagcctgagccccaaccacaacaccctgcagaccctgaagagtgatggccgcatgcccagcagcagcagagctgagagccctggccctggcagccggctgagcagccccaagcccaagaccctgcctgccaacagaagcagccccagcggggccagcagccccaggagcagcagcccccatgacaagaacctgccccagaagagcacagcccctgtgaagaccaagctggaccccccccgggagaggagcaagagtgacagctacaccctggaccctgacaccctgaggaagaagaagatgcccctgacagagcccctgcggggccgcagcaccagccccaagcccaagtctgtgcccaaggacagcacagacagccctggcagcgagaacagagcccccagcccccacgtggtgcaggagaacctgcacagcgaggtggtggaggtgtgcaccagcagcaccctgaagaccaacagcctgacagacagcacctgtgatgacagcagcgagttcaagtctgtggatgagggcagcaacaaggtgcacttcagcatcggcaaggcccccctgaaggatgagcaggagatgagggccagccccaagatcagcaggaaatgtgccaacagacacacccggcccaagaggaagattgagttctccttccagaggcgctggatccaggccttccgggccagccaggccagccacgtgtccttctgtggccgctag

SEQ ID NO: 20666 - DNA, 14037 bp, Artificial Sequence
  Description of Artificial Sequence: Synthetic coding sequence
atgatgatgtgtgccgccacagccagccctgctgctgccagcagcggcctgggcggagatggcttctacccagctgccaccttcagcagcagccctgcccctggggccctcttcatgcctgtgcctgatggctctgtggccgctgctggcctgggcctgggcctgcctgctgctgacagccggggccactaccagctgctgctgagcggccgggccctggccgaccgctaccgccgcatctacacagctgccctgaatgaccgggaccagggcggcggcagcgctggccacccagccagcaggaacaagaagatcctgaacaagaagaagctgaagaggaagcagaagagcaagagcaaggtgaagaccaggagcaagtctgagaacctggagaacacagtcatcatcccagacatcaagctgcacagcaaccccagcgccttcaacatctactgcaatgtgcgccactgtgtgctggagtggcagaagaaggagatcagcctggccgccgccagcaagaacagcgtgcagagcggggagagtgacagtgatgaggaggaggagagcaaggagccccccatcaagctgcccaagatcatcgaggtgggcctgtgtgaggtgtttgagctgatcaaggagacccgcttcagccaccccagcctgtgcctgcggagcctgcaggccctgctgaatgtgctgcagggccagcagcctgagggcctgcagagcgagcccccagaggtgctggagagcctcttccagctgctgctggagatcaccgtgcgcagcacaggcatgaatgacagcacaggccagagcctgacagccctgagctgtgcctgcctcttcagcctggtggcctcctggggcgagaccggccgcaccctgcaggccatcagcgccatcctgaccaacaacggcagccacgcctgccagaccatccaggtgcccaccatcctgaacagcctgcagaggtctgtgcaggccgtgctggtgggcaagatccagatccaggactggttcagcaatggcatcaagaaggccgccctgatgcacaagtggcccctgaaggagatctctgtggatgaagatgaccagtgcctgctgcagaatgatggcttcttcctgtacctgctgtgcaaggatggcctgtacaagattggcagcggctacagcggcaccgtgcggggccacatctacaacagcaccagccgcatccggaacaggaaggagaagaagtcctggctgggctacgcccagggctacctgctgtacagagatgtgaacaaccacagcatgacagccatccgcatcagccctgagaccctggagcaggacggcaccgtgatgctgcctgactgccacacagagggccagaacatcctcttcacagatggagagtacatcaaccagattgctgccagcagagatgatggctttgtggtgcgcatctttgccaccagcacagagcctgtgctgcagcaggagctgcagctgaagctggccaggaagtgcctgcacgcctgtggcatcagcctgtttgacctggagaaggacctgcacatcatcagcactggatttgatgaggagagcgccatcctgggcgccggccgggagtttgccctgatgaagacagccaacgggaagatctactacacaggcaagtaccagagcctgggcatcaagcagggcggccccagcgctgggaagtgggtggagctgcccatcaccaagagccccaagatcgtgcacttctctgtgggccatgatggcagccacgccctgctggtggctgaagatggcagcatcttcttcaccggcagcgccagcaaaggagaagatggagagagcaccaagagccggcggcagagcaagccctacaagcccaagaagatcatcaagatggagggcaagatcgtggtgtacacagcctgcaacaacggcagcagcagcgtcatcagcaaggatggagagctgtacatgtttgggaaggatgccatctacagcgacagcagcagcctggtgacagacctgaagggccactttgtgacccaggtggccatgggcaaggcccacacctgtgtgctgatgaagaatggagaggtgtggacctttggagtgaacaacaagggccagtgtggccgggacacaggagccatgaaccagggcggcaaaggatttggagtggagaacatggccacagccatggatgaggacctggaggaggagctggatgagaaggatgagaagtccatgatgtgccccccaggcatgcacaagtggaagctggagcagtgcatggtgtgcaccgtgtgtggggactgcaccggctacggggccagctgtgtgagcagcggccgcccagacagagtgcctgggggcatctgtggctgcggcagcggggagagcggctgtgctgtgtgtggctgctgcaaggcctgtgcccgggagctggatggccaggaggcccggcagaggggcatcctggatgctgtgaaggagatgatccccctggacctgctgctggccgtgcctgtgcctggggtgaacatcgaggagcacctgcagctgcggcaggaggagaagaggcagagggtcatccgccgccaccggctggaggagggccggggccccctggtgtttgctggccccatcttcatgaaccaccgggagcaggccctggcccggctgcggagccacccagcccagctgaagcacaagagggacaagcacaaggatggcagcggggagcggggggagaaggatgccagcaagatcaccacctacccacctggctctgtgcgctttgactgtgagctgcgggctgtgcaggtgtcctgtggcttccaccacagcgtggtgctgatggagaatggagatgtgtacaccttcggctacggccagcacggccagctgggccatggagatgtgaacagccggggctgccccaccctggtgcaggccctgcccggccccagcacccaggtgacagctggcagcaaccacacagctgtgctgctgatggatggccaggtgttcaccttcggcagcttcagcaagggccagctgggccggcccatcctggatgtgccctactggaatgccaagccagcccccatgcccaacatcggcagcaaatatggcaggaaggccacctggattggagccagcggggaccagaccttcctgagaattgatgaggccctgatcaacagccacgtgctggccaccagcgagatctttgccagcaagcacatcatcggcctggtgcctgccagcatcagcgagcccccacccttcaagtgcctgctgatcaacaaggtggatggcagctgcaagaccttcaatgacagcgagcaggaggacctgcagggcttcggcgtgtgcctggaccctgtgtatgatgtgatctggaggttccggcccaacacccgggagctgtggtgctacaatgctgtggtggctgatgcccggctgcccagcgctgctgacatgcagagccgctgcagcatcctgagccctgagctggccctgcccaccggcagccgggccctgaccaccaggagccatgctgccctgcacatcctgggctgcctggacaccctggccgccatgcaggacctgaagatgggcgtggccagcacagaggaggagacccaggccgtgatgaaggtgtacagcaaagaagactacagcgtggtgaacagatttgagagccacggcggcggctggggctacagcgcccacagcgtggaggccatccgcttctctgctgacacagacatcctgctgggcggcctgggcctgtttggaggccgcggggagtacacagccaagatcaagctgtttgagctgggcccagatggaggagaccacgagacagatggagacctgctggccgagacagatgtgctggcctatgactgtgccgcccgggagaagtatgccatgatgtttgatgagcctgtgctgctgcaggccggctggtggtacgtggcctgggcccgggtgtctggccccagcagtgactgtggcagccacggccaggccagcatcaccacagatgatggagtggtgttccagttcaagagcagcaagaagagcaacaacggcacagatgtgaatgccggccagatcccccagctgctgtaccgcctgcccaccagtgatggcagcgccagcaagggcaagcagcagaccagcgagcctgtgcacatcctgaagaggagctttgccaggacagtgtctgtggagtgctttgagagcctgctgagcatcctgcactggagctggaccaccctggtgctgggcgtggaggagctgcggggcctgaagggcttccagttcaccgccaccctgctggacctggagcggctgcgctttgtgggcacctgctgcctgcggctgctgcgggtgtacacctgtgagatctaccctgtgtctgccaccgggaaggctgtggtggaggagaccagcaagctggccgagtgcatcggcaagaccaggaccctgctgaggaagatcctgtctgagggcgtggaccactgcatggtgaagctggacaatgacccccagggctacctgagccagcccctgagcctgctggaggccgtgctgcaggagtgccacaacaccttcaccgcctgcttccacagcttctaccccaccccagccctgcagtgggcctgcctgtgtgacctgctgaactgcctggaccaggacatccaggaggccaacttcaagaccagcagcagccggctgctggccgctgtgatgtctgccctgtgccacacctctgtgaagctgaccagcatcttccccatcgcctatgatggagaggtgctgctgcggagcatcgtgaagcaggtgtccacagaaaatgacagcaccctggtgcaccgcttccccctgctggtggcccacatggagaagctgagccagagcgaggagaacatcagcggcatgaccagcttccgggaggtgctggagaagatgctggtgattgtggtgctgcctgtgaggaacagcctgcggcgggagaatgaactcttcagcagccacctggtgagcaacacctgtggcctgctggccagcatcgtgtctgagctgacagccagcgccctgggcagcgaggtggatggcctgaacagcctgcacagcgtgaaggccagcgccaaccgcttcaccaagaccagccagggccgctcctggaacacaggaaatggcagcccagatgccatctgcttctctgtggacaagccaggcatcgtggtggtgggcttctctgtgtatggaggcggcggcatccacgagtatgagctggaggtgctggtggatgattctgaacatgctggggacagcacccacagccaccgctggaccagcctggagctggtgaagggcacctacaccacagatgacagccccagcgacattgctgagatccggctggacaaggtggtgcccctgaaggaaaatgtgaagtatgctgtgcggctgaggaactacggcagcaggacagccaatggagatggcggcatgaccaccgtgcagtgcccagatggagtgaccttcaccttcagcacctgcagcctgagcagcaatggcaccaaccagacccggggccagatcccccagatcctgtactacagaagtgaatttgatggagacctgcagagccagctgctgagcaaggccaatgaggaggacaagaactgcagccgggccctgtctgtggtgtccacagtggtgcgggccagcaaggacctgctgcaccgggccctggccgtggatgctgatgacatccctgagctgctgagcagcagcagcctcttctccatgctgctgcccctcatcatcgcctacatcggccctgtggccgccgccatccccaaggtggccgtggaggtgtttggcctggtgcagcagctgctgcccagcgtggccatcctgaaccagaagtatgcccccccagccttcaaccccaaccagagcacagacagcaccactggaaaccagcctgagcagggcctgagcgcctgcaccaccagcagccactatgctgtgattgaaagtgagcacccctacaagccagcctgtgtgatgcactacaaggtgaccttcccagaatgtgtgcgctggatgaccatcgagtttgacccccagtgtggcacagcccagagtgaagatgtgctgcggctgctgatccctgtgaggacagtgcagaacagcggctacggccccaagctgacctctgtgcatgagaacctgaacagctggattgagctgaagaagttcagcggcagcagcggctggcccaccatggtgctggtgctgcctggaaatgaggccctcttcagcctggagacagccagtgactatgtgaaggatgacaaggccagcttctacggcttcaagtgctttgccatcggctatgagttcagccctggcccagatgagggcgtcatccagctggagaaggagctggccaacctgggcggcgtgtgtgccgccgccctgatgaagaaggacctggccctgcccatcggaaatgagctggaggaggacctggagatcctggaggaggccgccctgcaggtgtgcaagacccacagcggcatcctgggcaagggcctggccctgagccacagccccaccatcctggaggccctggagggcaacctgcccctgcagatccagagcaatgagcagagcttcctggatgacttcatcgcctgtgtgcccggcagcagcggcggccgcctggcccgctggctgcagcctgacagctatgctgacccccagaagaccagcctcatcctgaacaaggatgacatccgctgtggctggcccaccaccatcaccgtgcagaccaaggaccagtatggagatgtggtgcacgtgcccaacatgaaggtggaggtgaaggctgtgcctgtgtcccagaagaagatgagcctgcagcaggaccaggccaagaagccccagagaattcctggcagccctgctgtgacagctgccagcagcaacacagacatgacctacggcggcctggccagccccaagctggatgtgtcctatgagcccatgattgtgaaggaggcccgctacatcgccatcaccatgatgaaggtgtatgagaactacagctttgaggagctgcgctttgccagccccacccccaagaggcccagcgagaacatgctgatccgggtgaacaatgatggcacctactgtgccaactggacccctggggccatcggcctgtacaccctgcacgtgaccattgatggcatcgagattgatgctggcctggaggtgaaggtgaaggacccccccaagggcatgatccccccaggcacccagctggtgaagcccaagtctgagccccagcccaacaaggtgaggaagtttgtggccaaggacagcgctggcctgcgcatccgcagccaccccagcctgcagagcgagcagatcggcatcgtgaaggtgaatggcaccatcaccttcattgatgagatccacaatgatgatggagtgtggctgcggctgaatgatgagaccatcaagaagtatgtgcccaacatgaatggctacacagaggcctggtgcctgtccttcaaccagcacctgggcaagagcctgctggtgcctgtggatgagagcaagaccaacacagatgacttcttcaaggacatcaacagctgctgcccccaggaggccaccatgcaggagcaggacatgcccttcctgcggggcggccctggcatgtacaaggtggtgaagacaggccccagcggccacaacatccgcagctgccccaacctgcggggcatccccatcggcatgctggtgctgggcaacaaggtgaaggctgtgggggaggtgaccaacagcgagggcacctgggtgcagctggaccagaacagcatggtggagttctgtgagagtgatgaaggagaggcctggagcctggcccgggacagaggaggcaaccagtacctgcggcatgaagatgagcaggccctgctggaccagaacagccagaccccaccacccagccccttctctgtgcaggccttcaacaagggggccagctgcagcgcccagggctttgattatggcctgggcaacagcaaaggagaccggggcaacatcagcaccagcagcaagccagccagcaccagcggcaagtctgagctgagcagcaagcacagccgcagcctgaagccagatggccgcatgagcaggaccacagctgaccagaagaagccccggggcacagagagcctgagcgccagcgagagcctcatcctgaagagtgatgctgccaagctgcggagtgacagccacagccgcagcctgagccccaaccacaacaccctgcagaccctgaagagtgatggccgcatgcccagcagcagcagagctgagagccctggccctggcagccggctgagcagccccaagcccaagaccctgcctgccaacagaagcagccccagcggggccagcagccccaggagcagcagcccccatgacaagaacctgccccagaagagcacagcccctgtgaagaccaagctggaccccccccgggagaggagcaagagtgacagctacaccctggaccctgacaccctgaggaagaagaagatgcccctgacagagcccctgcggggccgcagcaccagccccaagcccaagtctgtgcccaaggacagcacagacagccctggctctgaaaatagagcccccagcccccacgtggtgcaggagaacctgcacagcgaggtggtggaggtgtgcaccagcagcaccctgaagaccaacagcctgacagacagcacctgtgatgacagcagcgagttcaagtctgtggatgagggcagcaacaaggtgcacttcagcatcggcaaggcccccctgaaggatgagcaggagatgagggccagccccaagatcagcaggaaatgtgccaacagacacacccggcccaagaaggagaagagcagcttcctgttcaagggagatggcagcaagcccctggagcccgccaagcaggccatgagccccagcgtggctgaatgtgcccgggctgtgtttgccagcttcctgtggcatgagggcatcgtgcatgatgccatggcctgcagcagcttcctgaagttccaccctgagctgagcaaggagcacgcccccatccgcagcagcctgaacagccagcagcccacagaggagaaggagaccaagctgaagaacagacacagcctggagatcagcagcgccctgaacatgttcaacatcgcccctcatggccctgacatcagcaagatgggcagcatcaacaagaacaaggtgctgtccatgctgaaggagccccccctgcacgagaagtgtgaagatggcaagacagagaccacctttgagatgtccatgcacaacaccatgaagagcaagagccccctgcccctgaccctgcagcacctggtggccttctgggaggacatcagcctggccaccatcaaggccgccagccagaacatgatcttccccagccctggcagctgtgctgtgctgaagaagaaggaatgtgagaaggagaacaagaagagcaagaaggagaagaagaagaaggagaaggccgaggtgcggccccggggcaacctgtttggagagatggcccagctggccgtgggcggccctgagaaggacaccatctgtgagctgtgtggggagagccacccctaccctgtgacctaccacatgaggcaggcccaccctggctgcggccgctatgccggcggccagggctacaacagcatcggccacttctgtggcggctgggccggcaactgtggagatggcggcattggaggcagcacctggtacctggtgtgtgaccgctgccgggagaagtacctgcgggagaagcaggccgccgcccgggagaaggtgaagcagagcaggaggaagcccatgcaggtgaagaccccccgggccctgcccaccatggaggcccaccaggtgatcaaggccaatgccctcttcctgctgagcctgagcagcgctgctgagcccagcatcctgtgctaccacccagccaagcccttccagagccagctgcccagcgtgaaggagggcatcagcgaggacctgcctgtgaagatgccctgcctgtacctgcagaccctggcccggcaccaccacgagaactttgtgggctaccaggatgacaacctcttccaggatgagatgagatacctgcggagcacctctgtgcctgccccctacatctctgtgaccccagatgccagccccaacgtgtttgaggagcctgagagcaacatgaagtccatgccacccagcctggagaccagccccatcacagacacagacctggccaagaggacagtgttccagaggagctacagcgtggtggcctctgaatatgacaagcagcacagcatcctgcctgcccgggtgaaggccatccccaggagaagagtgaacagcggggacacagaggtgggcagcagcctgctgcggcaccccagccctgagctgagccgcctcatcagcgcccacagcagcctgagcaagggggagaggaacttccagtggcctgtgctggccttcgtcatccagcaccacgacctggagggcctggagatcgccatgaagcaggccctgaggaagagcgcctgccgggtgtttgccatggaggccttcaactggctgctgtgcaacgtcatccagaccaccagcctgcatgacatcctgtggcactttgtggccagcctgaccccagcccctgtggagcctgaggaggaggaggatgaggagaacaagaccagcaaagaaaattctgagcaggagaaggacaccagggtgtgtgagcaccccctgagtgacatcgtgattgctggggaggccgcccaccccctgccccacaccttccaccggctgctgcagaccatcagtgacctgatgatgagcctgcccagcggcagcagcctgcagcagatggccctgcgctgctggagcctgaagttcaagcagagcgaccaccagttcctgcaccagagcaatgtgttccaccacatcaacaacatcctgagcaagagtgatgatggagacagcgaggagagcttcagcatcagcatccagagcggctttgaggccatgagccaggagctgtgcatcgtgatgtgcctgaaggacctgaccagcatcgtggacatcaagaccagcagcaggcctgccatgattggcagcctgacagatggcagcacagagaccttctgggagagcggagatgaggacaagaacaagaccaagaacatcaccatcaactgtgtgaagggcatcaatgcccgctacgtgtctgtgcacgtggacaacagccgggacctgggcaacaaggtgacctccatgaccttcctgaccgggaaggctgtggaggacctgtgccgcatcaagcaggtggacctggacagccgccacatcggctgggtgaccagcgagctgcccggcggggacaaccacatcatcaagattgagctgaagggccctgagaacaccctgcgggtgcggcaggtgaaggtgctgggctggaaggatggagagagcaccaagattgctggccagatcagcgcctctgtggcccagcagaggaactgtgaggccgagaccctgcgggtcttccgcctcatcaccagccaggtgtttgggaagctgatctctggagatgctgagcccaccccagagcaggaggagaaggccctgctgagcagccctgagggggaggagaaggtgtacaatgccaccagtgatgctgacctgaaggagcacatggtgggcatcatcttcagccgcagcaagctgaccaacctgcagaagcaggtgtgtgcccacatcgtgcaggccatccgcatggaggccaccagggtgcgggaggagtgggagcacgccatcagcagcaaagaaaatgccaacagccagcccaatgatgaagatgccagcagtgatgcctactgctttgagctgctgtccatggtgctggccctgagcggcagcaatgtgggccggcagtacctggcccagcagctgaccctgctgcaggacctcttcagcctgctgcacacagccagcccccgggtgcagaggcaggtgaccagcctgctgcggcgggtgctgcctgaggtgacccccagccggctggccagcatcatcggcgtgaagagcctgcccccagctgacatcagtgacatcatccacagcacagagaagggggactggaacaagctgggcatcctggacatgttcctgggctgcatcgccaaggccctgactgtgcagctgaaggccaagggcaccaccatcactggaacagctggcaccaccgtgggcaagggcgtgaccaccgtgaccctgcccatgatcttcaacagcagctacctgcggcggggggagagccactggtggatgaagggcagcacccccacccagatcagcgagatcatcatcaagctgatcaaggacatggccgccggccacctgtctgaggcctggagccgggtgaccaagaatgccatcgccgagaccatcatcgccctgaccaagatggaggaggagttccgcagccctgtgcgctgcatcgccaccacccggctgtggctggccctggccagcctgtgtgtgctggaccaggaccacgtggaccggctgagcagcggccgctggatgggcaaggatggccagcagaagcagatgcccatgtgtgacaaccatgatgatggagaaacagctgccatcatcctgtgcaatgtgtgtggcaacctgtgcacagactgtgaccgcttcctgcacctgcacaggaggaccaagacccaccagaggcaggtgttcaaggaggaggaggaggccatcaaggtggacctgcacgagggctgcggccgcaccaagctgttctggctgatggccctggccgacagcaagaccatgaaggccatggtggagttccgggagcacacaggcaagcccaccaccagcagcagcgaggcctgccgcttctgtggcagccgctctggaacagagctgtctgctgtgggctctgtgtgcagtgatgctgactgccaggagtatgccaagatcgcctgcagcaagacccacccctgtggccacccctgtggcggcgtgaagaatgaggagcactgcctgccctgcctgcacggctgtgacaagagcgccaccagcctgaagcaggatgctgatgacatgtgcatgatctgcttcacagaggccctgtctgctgccccagccatccagctggactgcagccacatcttccacctgcagtgctgccggcgggtgctggagaaccgctggctgggcccccgcatcaccttcggcttcatcagctgccccatctgcaagaacaagatcaaccacatcgtgctgaaggacctgctggaccccatcaaggagctgtatgaagatgtgcggaggaaggccctgatgaggctggagtatgagggcctgcacaagtctgaggccatcaccaccccaggagtgcgcttctacaatgaccctgctggctacgccatgaacagatatgcctactacgtgtgctacaagtgcaggaaggcctactttggaggagaggcccgctgtgatgctgaggccggcagaggagatgattatgacccccgggagctgatctgtggggcctgcagtgatgtgtcccgggcccagatgtgccccaagcacggcacagacttcctggagtacaagtgccgctactgctgcagcgtggccgtgttcttctgcttcggcaccacccacttctgcaatgcctgccatgatgacttccagaggatgaccagcatccccaaggaggagctgccccactgcccagctggccccaagggcaagcagctggagggcacagaatgtcccctgcacgtggtgcaccccccaactggagaggagtttgccctgggctgcggcgtgtgcagaaatgcccacaccttctag

SEQ ID NO: 20667 - DNA, 13923 bp, Artificial Sequence; identical to SEQ ID NO: 20664
  Description of Artificial Sequence: Synthetic coding sequence

SEQ ID NO: 20668 - DNA, 930 bp, Artificial Sequence
  Description of Artificial Sequence: Synthetic coding sequence
atgaggccagacagagctgaggcccctggccccccagccatggccgccggcggccctggagctggcagcgctgcccctgtgagcagcaccagcagcctgcccctggccgccctgaacatgagggtgagaagaaggctgagcctcttcctgaatgtgaggacccaggtggccgctgactggacagccctggccgaggagatggactttgagtacctggagatccggcagctggagacccaggccgaccccaccggccgcctgctggatgcctggcagggccggcctggggcctctgtgggccgcctgctggagctgctgaccaagctgggcagagatgatgtgctgctggagctgggccccagcattgaggaggactgccagaagtacatcctgaagcagcagcaggaggaggccgagaagcccctgcaggtggccgctgtggacagctctgtgcccaggacagctgagctggccggcatcaccaccctggatgaccccctgggccacatgcctgagagatttgatgccttcatctgctactgccccagcgacatccagtttgtgcaggagatgatccggcagctggagcagaccaactaccgcctgaagctgtgtgtgtctgacagagatgtgctgcccggcacctgtgtgtggagcatcgccagcgagctgattgagaagcgctgcaggaggatggtggtggtggtgtctgatgactacctgcagagcaaagaatgtgacttccagaccaagtttgccctgagcctgagccctggggcccaccagaagaggctcatccccatcaagtacaaggccatgaagaaggagttccccagcatcctgcgcttcatcaccgtgtgtgactacaccaacccctgcaccaagtcctggttctggacccggctggccaaggccctgagcctgccctag

SEQ ID NO: 20669 - DNA, 858 bp, Artificial Sequence
  Description of Artificial Sequence: Synthetic coding sequence
atggctgctgggggccctggggccggcagcgctgcccctgtgagcagcaccagcagcctgcccctggccgccctgaacatgagggtgagaagaaggctgagcctcttcctgaatgtgaggacccaggtggccgctgactggacagccctggccgaggagatggactttgagtacctggagatccggcagctggagacccaggccgaccccactggagcctctgtgggccgcctgctggagctgctgaccaagctgggcagagatgatgtgctgctggagctgggccccagcattgaggaggactgccagaagtacatcctgaagcagcagcaggaggaggccgagaagcccctgcaggtggccgctgtggacagctctgtgcccaggacagctgagctggccggcatcaccaccctggatgaccccctgggccacatgcctgagagatttgatgccttcatctgctactgccccagcgacatccagtttgtgcaggagatgatccggcagctggagcagaccaactaccgcctgaagctgtgtgtgtctgacagagatgtgctgcccggcacctgtgtgtggagcatcgccagcgagctgattgagaagcgctgcaggaggatggtggtggtggtgtctgatgactacctgcagagcaaagaatgtgacttccagaccaagtttgccctgagcctgagccctggggcccaccagaagaggctcatccccatcaagtacaaggccatgaagaaggagttccccagcatcctgcgcttcatcaccgtgtgtgactacaccaacccctgcaccaagtcctggttctggacccggctggccaaggccctgagcctgccctag

SEQ ID NO: 20670 - DNA, 954 bp, Artificial Sequence
  Description of Artificial Sequence: Synthetic coding sequence
atgaggccagacagagctgaggcccctggccccccagccatggccgccggcggccctggagctggcagcgctgcccctgtgagcagcaccagcagcctgcccctggccgccctgaacatgagggtgagaagaaggctgagcctcttcctgaatgtgaggacccaggtggccgctgactggacagccctggccgaggagatggactttgagtacctggagatccggcagctggagacccaggccgaccccaccggccgcctgctggatgcctggcagggccggcctggggcctctgtgggccgcctgctggagctgctgaccaagctgggcagagatgatgtgctgctggagctgggccccagcattgaggaggactgccagaagtacatcctgaagcagcagcaggaggaggccgagaagcccctgcaggtggccgctgtggacagctctgtgcccaggacagctgagctggccggcatcaccaccctggatgaccccctgggccacatgcctgagagatttgatgccttcatctgctactgccccagcgacatccagtttgtgcaggagatgatccggcagctggagcagaccaactaccgcctgaagctgtgtgtgtctgacagagatgtgctgcccggcacctgtgtgtggagcatcgccagcgagctgattgagaagaggctggcccggcggccccggggcggctgcaggaggatggtggtggtggtgtctgatgactacctgcagagcaaagaatgtgacttccagaccaagtttgccctgagcctgagccctggggcccaccagaagaggctcatccccatcaagtacaaggccatgaagaaggagttccccagcatcctgcgcttcatcaccgtgtgtgactacaccaacccctgcaccaagtcctggttctggacccggctggccaaggccctgagcctgccctag

SEQ ID NO: 20671 - DNA, 510 bp, Artificial Sequence
  Description of Artificial Sequence: Synthetic coding sequence
atggctgctgggggccctggggccggcagcgctgcccctgtgagcagcaccagcagcctgcccctggccgccctgaacatgagggtgagaagaaggctgagcctcttcctgaatgtgaggacccaggtggccgctgactggacagccctggccgaggagatggactttgagtacctggagatccggcagctggagacccaggccgaccccaccggccgcctgctggatgcctggcagggccggcctggggcctctgtgggccgcctgctggagctgctgaccaagctgggcagagatgatgtgctgctggagctgggccccagcattgaggaggactgccagaagtacatcctgaagcagcagcaggaggaggccgagaagcccctgcaggtggccgctgtggacagctctgtgcccccccacctgatgaccccctggggcatctgcctgtctgtgtccatgcccagcagcgccatcgccccagccaccagcagcctgtgcagaagatag

SEQ ID NO: 20672 - DNA, 963 bp, Artificial Sequence
  Description of Artificial Sequence: Synthetic coding sequence
atggagctgctgagcccccccctgagagatgtggacctgacagccccagatggcagcctgtgcagctttgccaccacagatgacttctatgatgacccctgctttgacagcccagacctgcgcttctttgaggacctggacccccggctgatgcacgtgggcgccctgctgaagccagaggagcacagccacttccctgctgctgtgcacccagcccctggggccagagaagatgagcacgtgcgggcccccagcggccaccaccaggccggccgctgcctgctgtgggcctgcaaggcctgcaagaggaagaccaccaatgctgacaggaggaaggccgccaccatgagggagcggcggcggctgagcaaggtgaatgaggcctttgagaccctgaagcgctgcaccagcagcaaccccaaccagaggctgcccaaggtggagatcctgagaaatgccatccgctacatcgagggcctgcaggccctgctgcgggaccaggatgctgcccctcctggagctgctgctgccttctacgcccctggccccctgcccccaggccggggcggggagcactacagcggggacagtgatgccagcagccccaggagcaactgcagtgatggcatgatggactacagcggcccccccagcggggccaggagaagaaactgctatgagggcgcctactacaatgaggcccccagcgagcccaggcctgggaagtctgctgctgtgagcagcctggactgcctgagcagcatcgtggagcgcatcagcacagagagccctgctgccccagccctgctgctggctgatgtgcccagcgagagccccccccggcggcaggaggccgccgcccccagcgagggggagagcagcggggaccccacccagagcccagatgctgccccccagtgcccagctggggccaaccccaaccccatctaccaggtgctgtag

SEQ ID NO: 20673 - DNA, 5538 bp, Artificial Sequence
  Description of Artificial Sequence: Synthetic coding sequence
atgggagatgtgaagctggtggccagcagccacatcagcaagaccagcctgtctgtggaccccagccgggtggacagcatgcccctgacagaggccccagccttcatcctgccccccaggaacctgtgcatcaaggagggcgccacagccaagtttgagggccgggtgcggggctacccagagccccaggtgacctggcacagaaatggccagcccatcaccagcggcggccgcttcctgctggactgtggcatccggggcaccttcagcctggtgattcatgctgtgcatgaagaagatcggggcaagtacacctgtgaggccaccaacggcagcggggcccggcaggtgacagtggagctgactgtggagggcagctttgccaagcagctgggccagcctgtggtgtccaagaccctgggggaccgcttcagcgccccagctgtggagacccggcccagcatctggggcgagtgcccccccaagtttgccaccaagctgggccgggtggtggtgaaggagggccagatgggccgcttcagctgcaagatcaccggccggccccagccccaggtgacctggctgaagggaaatgtgcccctgcagcccagcgcccgggtgtctgtgtctgagaagaatggcatgcaggtgctggagatccatggagtgaaccaggatgatgtgggcgtgtacacctgcctggtggtgaatggaagtggcaaggcctccatgtctgctgagctgagcatccagggcctggacagcgccaacagaagctttgtgcgggagaccaaggccaccaacagtgatgtgaggaaggaggtgaccaacgtcatcagcaaggagagcaagctggacagcctggaggccgccgccaagagcaagaactgcagcagcccccagagaggaggcagccccccctgggccgccaacagccagccccagcccccccgggagagcaagctggagagctgcaaggacagccccaggacagccccccagacccctgtgctgcagaagaccagcagcagcatcaccctgcaggccgcccgggtgcagcctgagccccgggcccctggcctgggcgtgctgagccccagcggggaggagaggaagaggcctgccccacccaggcctgccaccttccccacccggcagcccggcctgggcagccaggatgtggtgtccaaggccgccaacagacgcatccccatggagggccagagggacagcgccttccccaagtttgagagcaagccccagagccaggaggtgaaggagaaccagacagtgaagttccgctgtgagggcctggccgtgatggaggtggcccccagcttcagctctgtgctgaaggactgtgctgtgattgagggccaggactttgtgctgcagtgcagcgtgcggggcacccctgtgccccgcatcacctggctgctgaatggccagcccatccagtatgcccggagcacctgtgaggccggcgtggccgagctgcacatccaggatgccctgcctgaagatcatggcacctacacctgcctggctgaaaatgccctgggccaggtgtcctgcagcgcctgggtgacagtgcatgagaagaagagcagcaggaagtctgagtacctgctgcctgtggcccccagcaagcccacagcccccatcttcctgcagggcctgagtgacctgaaggtgatggatggcagccaggtgaccatgacagtgcaggtgtctggcaaccccccacctgaggtgatctggctgcacaatggaaatgagatccaggagagcgaggacttccactttgagcagaggggcacccagcacagcctgtgcatccaggaggtgtttcctgaggacaccggcacctacacctgtgaggcctggaacagcgctggggaggtgaggacccaggccgtgctgactgtgcaggagccccatgatggcacccagccctggttcatcagcaagcccaggtctgtgacagccagcctgggccagagcgtgctgatcagctgtgccatcgccggggaccccttccccaccgtgcactggctgagagatggcaaggccctgtgcaaggacaccggccactttgaggtgctgcagaatgaagatgtgttcaccctggtgctgaagaaggtgcagccctggcacgccggccagtatgagatcctgctgaagaacagagtgggagaatgtagctgccaggtgtccctgatgctgcagaacagcagcgcccgggccctgccccggggccgggagcccgccagctgtgaggacctgtgtggcggcggcgtgggcgcagatggcggcggcagtgacagatatggcagcctgcggcccggctggccagcccggggccagggctggctggaggaggaggatggagaagatgtgcggggcgtgctgaagagaagagtggagacccggcagcacacagaggaggccatccggcagcaggaggtggagcagctggacttccgggacctgctgggcaagaaggtgtccaccaagaccctgtctgaagatgacctgaaggagatcccagctgagcagatggacttccgggccaacctgcagaggcaggtgaagcccaagacagtgtctgaggaggagaggaaggtgcacagcccccagcaggtggacttccgctctgtgctggccaagaagggcaccagcaagacccctgtgcctgagaaggtgcccccacccaagccagccaccccagacttccgctctgtgctgggcggcaagaagaagctgcctgcagaaaatggcagcagcagcgctgagaccctgaatgccaaggctgtggagagcagcaagcccctgagcaatgcccagcccagcggccccctgaagcctgtgggcaatgccaagccagctgagaccctgaagcccatgggaaatgccaagccagctgagaccctgaagcccatgggaaatgccaagccagatgagaacctgaagagcgccagcaaggaggagctgaagaaggatgtgaagaatgatgtgaactgcaagaggggccatgctggcaccacagacaatgagaagaggtctgagagccagggcacagccccagccttcaagcagaagctgcaggatgtgcacgtggccgagggcaagaagctgctgctgcagtgccaggtgtccagtgaccccccagccaccatcatctggaccctgaatggcaagaccctgaagaccaccaagttcatcatcctgagccaggagggcagcctgtgcagcgtgtccattgagaaggccctgcctgaggaccggggcctgtacaagtgtgtggccaagaatgatgctggccaggctgaatgtagctgccaggtgacagtggatgatgccccagccagcgagaacaccaaggcccctgagatgaagagcagaagacccaagagcagcctgccccctgtgctgggcacagaaagtgatgccaccgtgaagaagaagccagcccccaagaccccacccaaggccgccatgccaccccagatcatccagtttcctgaggaccagaaggtgcgggccggggagagcgtggagctgtttgggaaggtgacaggcacccagcccatcacctgcacctggatgaagttcaggaagcagatccaggagagcgagcacatgaaggtggagaacagtgaaaatggcagcaagctgaccatcctggccgcccggcaggagcactgcggctgctacaccctgctggtggagaacaagctgggcagccggcaggcccaggtgaacctgactgtggtggacaagccagaccccccagctggcaccccctgtgccagtgacatccgcagcagcagcctgaccctgtcctggtacggcagcagctatgatggcggcagcgctgtgcagagctacagcattgagatctgggacagcgccaacaagacctggaaggagctggccacctgccgcagcaccagcttcaacgtgcaggacctgctgcctgaccacgagtacaagttccgggtgcgggccatcaacgtgtatggcaccagcgagcccagccaggagagcgagctgaccaccgtgggggagaagccagaggagcccaaggatgaggtggaggtgtctgatgatgatgagaaggagcctgaggtggactacagaacagtgaccatcaacacagagcagaaggtgtctgacttctatgacatcgaggagcggctgggcagcggcaagtttggccaggtgttccggctggtggagaagaagaccaggaaggtgtgggccggcaagttcttcaaggcctacagcgccaaggagaaggagaacatccggcaggagatcagcatcatgaactgcctgcaccaccccaagctggtgcagtgtgtggatgcctttgaggagaaggccaacatcgtgatggtgctggagatcgtgtctggaggagagctgtttgagcgcatcattgatgaggactttgagctgacagagcgggagtgcatcaagtacatgaggcagatcagcgagggcgtggagtacatccacaagcagggcatcgtgcacctggacctgaagccagagaacatcatgtgtgtgaacaagacaggcacccgcatcaagctgattgactttggcctggcccggcggctggagaatgccggcagcctgaaggtgctgtttggcaccccagagtttgtggcccctgaggtgatcaactatgagcccatcggctacgccacagacatgtggagcattggagtcatctgctacatcctggtgtctggcctgagccccttcatgggagacaatgacaatgagaccctggccaacgtgaccagcgccacctgggactttgatgatgaggcctttgatgagatcagtgatgatgccaaggacttcatcagcaacctgctgaagaaggacatgaagaaccggctggactgcacccagtgcctgcagcacccctggctgatgaaggacaccaagaacatggaggccaagaagctgagcaaggacaggatgaagaagtacatggcccggaggaagtggcagaagacaggaaatgctgtgcgggccatcggccgcctgagctccatggccatgatcagcggcctgagcggcaggaagagcagcacaggcagccccaccagccccctgaatgctgagaagctggagagtgaagaagatgtgtcccaggccttcctggaggccgtggccgaggagaagccccacgtgaagccctacttcagcaagaccatccgggacctggaggtggtggagggcagcgctgccaggtttgactgcaagattgagggctacccagaccctgaggtggtgtggttcaaggatgaccagagcatccgggagagccgccacttccagattgattatgatgaagatggcaactgcagcctcatcatcagtgatgtgtgtggagatgatgatgccaagtacacctgcaaggctgtgaacagcctgggggaggccacctgcacagctgagctgattgtggagaccatggaggagggggagggggagggggaggaggaggaggagtag

SEQ ID NO: 20674 - DNA, 2145 bp, Artificial Sequence
  Description of Artificial Sequence: Synthetic coding sequence
atgaagagccggcggcccaagagcagcctgccccctgtgctgggcacagaaagtgatgccaccgtgaagaagaagccagcccccaagaccccacccaaggccgccatgccaccccagatcatccagtttcctgaggaccagaaggtgcgggccggggagagcgtggagctgtttgggaaggtgacaggcacccagcccatcacctgcacctggatgaagttcaggaagcagatccaggagagcgagcacatgaaggtggagaacagtgaaaatggcagcaagctgaccatcctggccgcccggcaggagcactgcggctgctacaccctgctggtggagaacaagctgggcagccggcaggcccaggtgaacctgactgtggtggacaagccagaccccccagctggcaccccctgtgccagtgacatccgcagcagcagcctgaccctgtcctggtacggcagcagctatgatggcggcagcgctgtgcagagctacagcattgagatctgggacagcgccaacaagacctggaaggagctggccacctgccgcagcaccagcttcaacgtgcaggacctgctgcctgaccacgagtacaagttccgggtgcgggccatcaacgtgtatggcaccagcgagcccagccaggagagcgagctgaccaccgtgggggagaagccagaggagcccaaggatgaggtggaggtgtctgatgatgatgagaaggagcctgaggtggactacagaacagtgaccatcaacacagagcagaaggtgtctgacttctatgacatcgaggagcggctgggcagcggcaagtttggccaggtgttccggctggtggagaagaagaccaggaaggtgtgggccggcaagttcttcaaggcctacagcgccaaggagaaggagaacatccggcaggagatcagcatcatgaactgcctgcaccaccccaagctggtgcagtgtgtggatgcctttgaggagaaggccaacatcgtgatggtgctggagatcgtgtctggaggagagctgtttgagcgcatcattgatgaagattttgagctgacagaaagagagtgcatcaagtacatgaggcagatcagcgagggcgtggagtacatccacaagcagggcatcgtgcacctggacctgaagccagagaacatcatgtgtgtgaacaagacaggcacccgcatcaagctgattgactttggcctggcccggcggctggagaatgccggcagcctgaaggtgctgtttggcaccccagagtttgtggcccctgaggtgatcaactatgagcccatcggctacgccacagacatgtggagcattggagtcatctgctacatcctggtgtctggcctgagccccttcatgggagacaatgacaatgagaccctggccaacgtgaccagcgccacctgggactttgatgatgaggcctttgatgagatcagtgatgatgccaaggacttcatcagcaacctgctgaagaaggacatgaagaaccggctggactgcacccagtgcctgcagcacccctggctgatgaaggacaccaagaacatggaggccaagaagctgagcaaggacaggatgaagaagtacatggcccggaggaagtggcagaagacaggaaatgctgtgcgggccatcggccgcctgagctccatggccatgatcagcggcctgagcggcaggaagagcagcacaggcagccccaccagccccctgaatgctgagaagctggagagcgaggaggatgtgtcccaggccttcctggaggccgtggccgaggagaagccccacgtgaagccctacttcagcaagaccatccgggacctggaggtggtggagggcagcgctgccaggtttgactgcaagattgagggctacccagaccctgaggtggtgtggttcaaggatgaccagagcatccgggagagccgccacttccagattgattatgatgaagatggcaactgcagcctcatcatcagtgatgtgtgtggagatgatgatgccaagtacacctgcaaggctgtgaacagcctgggggaggccacctgcacagctgagctgattgtggagaccatggaggagggggagggggagggggaggaggaggaggagtag

SEQ ID NO: 20675 - DNA, 5592 bp, Artificial Sequence
  Description of Artificial Sequence: Synthetic coding sequence
atgggagatgtgaagctggtggccagcagccacatcagcaagaccagcctgtctgtggaccccagccgggtggacagcatgcccctgacagaggccccagccttcatcctgccccccaggaacctgtgcatcaaggagggcgccacagccaagtttgagggccgggtgcggggctacccagagccccaggtgacctggcacagaaatggccagcccatcaccagcggcggccgcttcctgctggactgtggcatccggggcaccttcagcctggtgattcatgctgtgcatgaagaagatcggggcaagtacacctgtgaggccaccaacggcagcggggcccggcaggtgacagtggagctgactgtggagggcagctttgccaagcagctgggccagcctgtggtgtccaagaccctgggggaccgcttcagcgccccagctgtggagacccggcccagcatctggggcgagtgcccccccaagtttgccaccaagctgggccgggtggtggtgaaggagggccagatgggccgcttcagctgcaagatcaccggccggccccagccccaggtgacctggctgaagggaaatgtgcccctgcagcccagcgcccgggtgtctgtgtctgagaagaatggcatgcaggtgctggagatccatggagtgaaccaggatgatgtgggcgtgtacacctgcctggtggtgaatggaagtggcaaggcctccatgtctgctgagctgagcatccagggcctggacagcgccaacagaagctttgtgcgggagaccaaggccaccaacagtgatgtgaggaaggaggtgaccaacgtcatcagcaaggagagcaagctggacagcctggaggccgccgccaagagcaagaactgcagcagcccccagagaggaggcagccccccctgggccgccaacagccagccccagcccccccgggagagcaagctggagagctgcaaggacagccccaggacagccccccagacccctgtgctgcagaagaccagcagcagcatcaccctgcaggccgcccgggtgcagcctgagccccgggcccctggcctgggcgtgctgagccccagcggggaggagaggaagaggcctgccccacccaggcctgccaccttccccacccggcagcccggcctgggcagccaggatgtggtgtccaaggccgccaacagacgcatccccatggagggccagagggacagcgccttccccaagtttgagagcaagccccagagccaggaggtgaaggagaaccagacagtgaagttccgctgtgaggtgtctggcatccccaagccagaggtggcctggttcctggagggcacccctgtgcggcggcaggagggcagcattgaggtgtatgaagatgctggcagccactacctgtgcctgctgaaggcccggacccgggacagcggcacctacagctgcacagccagcaatgcccagggccagctgagctgctcctggaccctgcaggtggagcggctggccgtgatggaggtggcccccagcttcagctctgtgctgaaggactgtgccgtcatcgagggccaggactttgtgctgcagtgcagcgtgcggggcacccctgtgccccgcatcacctggctgctgaatggccagcccatccagtatgcccggagcacctgtgaggccggcgtggccgagctgcacatccaggatgccctgcctgaggaccacggcacctacacctgcctggccgagaatgccctgggccaggtgtcctgcagcgcctgggtgacagtgcatgagaagaagagcagcaggaagtctgagtacctgctgcctgtggcccccagcaagcccacagcccccatcttcctgcagggcctgagtgacctgaaggtgatggatggcagccaggtgaccatgacagtgcaggtgtctggcaaccccccacctgaggtgatctggctgcacaatggaaatgagatccaggagagcgaggacttccactttgagcagaggggcacccagcacagcctgtgcatccaggaggtgtttcctgaggacaccggcacctacacctgtgaggcctggaacagcgctggggaggtgaggacccaggccgtgctgactgtgcaggagccccatgatggcacccagccctggttcatcagcaagcccaggtctgtgacagccagcctgggccagagcgtgctgatcagctgtgccatcgccggggaccccttccccaccgtgcactggctgagagatggcaaggccctgtgcaaggacaccggccactttgaggtgctgcagaatgaagatgtgttcaccctggtgctgaagaaggtgcagccctggcatgctggccagtatgagatcctgctgaagaacagagtgggggagtgcagctgccaggtgtccctgatgctgcagaacagcagcgcccgggccctgccccggggccgggagcccgccagctgtgaggacctgtgtggcggcggcgtgggcgcagatggcggcggcagtgacagatatggcagcctgcggcccggctggccagcccggggccagggctggctggaggaggaggatggagaagatgtgcggggcgtgctgaagagaagagtggagacccggcagcacacagaggaggccatccggcagcaggaggtggagcagctggacttccgggacctgctgggcaagaaggtgtccaccaagaccctgtctgaagatgacctgaaggagatcccagctgagcagatggacttccgggccaacctgcagaggcaggtgaagcccaagacagtgtctgaggaggagaggaaggtgcacagcccccagcaggtggacttccgctctgtgctggccaagaagggcaccagcaagacccctgtgcctgagaaggtgcccccacccaagccagccaccccagacttccgctctgtgctgggcggcaagaagaagctgcctgcagaaaatggcagcagcagcgctgagaccctgaatgccaaggctgtggagagcagcaagcccctgagcaatgcccagcccagcggccccctgaagcctgtgggcaatgccaagccagctgagaccctgaagcccatgggaaatgccaagccagctgagaccctgaagcccatgggaaatgccaagccagatgagaacctgaagagcgccagcaaggaggagctgaagaaggatgtgaagaatgatgtgaactgcaagaggggccacgccggcaccacagacaatgagaagaggtctgagagccagggcacagccccagccttcaagcagaagctgcaggatgtgcacgtggccgagggcaagaagctgctgctgcagtgccaggtgtccagtgaccccccagccaccatcatctggaccctgaatggcaagaccctgaagaccaccaagttcatcatcctgagccaggagggcagcctgtgcagcgtgtccattgagaaggccctgcctgaagatcggggcctgtacaagtgtgtggccaagaatgatgctggccaggccgagtgcagctgccaggtgacagtggatgatgccccagccagcgagaacaccaaggcccctgagatgaagagccggcggcccaagagcagcctgccccctgtgctgggcacagaaagtgatgccaccgtgaagaagaagccagcccccaagaccccacccaaggccgccatgccaccccagatcatccagtttcctgaggaccagaaggtgcgggccggggagagcgtggagctgtttgggaaggtgacaggcacccagcccatcacctgcacctggatgaagttcaggaagcagatccaggagagcgagcacatgaaggtggagaacagtgaaaatggcagcaagctgaccatcctggccgcccggcaggagcactgcggctgctacaccctgctggtggagaacaagctgggcagccggcaggcccaggtgaacctgactgtggtggacaagccagaccccccagctggcaccccctgtgccagtgacatccgcagcagcagcctgaccctgtcctggtacggcagcagctatgatggcggcagcgctgtgcagagctacagcattgagatctgggacagcgccaacaagacctggaaggagctggccacctgccgcagcaccagcttcaacgtgcaggacctgctgcctgaccacgagtacaagttccgggtgcgggccatcaacgtgtatggcaccagcgagcccagccaggagagcgagctgaccaccgtgggggagaagccagaggagcccaaggatgaggtggaggtgtctgatgatgatgagaaggagcctgaggtggactacagaacagtgaccatcaacacagagcagaaggtgtctgacttctatgacatcgaggagcggctgggcagcggcaagtttggccaggtgttccggctggtggagaagaagaccaggaaggtgtgggccggcaagttcttcaaggcctacagcgccaaggagaaggagaacatccggcaggagatcagcatcatgaactgcctgcaccaccccaagctggtgcagtgtgtggatgcctttgaggagaaggccaacatcgtgatggtgctggagatcgtgtctggaggagagctgtttgagcgcatcattgatgaagattttgagctgacagaaagagagtgcatcaagtacatgaggcagatcagcgagggcgtggagtacatccacaagcagggcatcgtgcacctggacctgaagccagagaacatcatgtgtgtgaacaagacaggcacccgcatcaagctgattgactttggcctggcccggcggctggagaatgccggcagcctgaaggtgctgtttggcaccccagagtttgtggcccctgaggtgatcaactatgagcccatcggctacgccacagacatgtggagcattggagtcatctgctacatcctgaaccggctggactgcacccagtgcctgcagcacccctggctgatgaaggacaccaagaacatggaggccaagaagctgagcaaggacaggatgaagaagtacatggcccggaggaagtggcagaagacaggaaatgctgtgcgggccatcggccgcctgagctccatggccatgatcagcggcctgagcggcaggaagagcagcacaggcagccccaccagccccctgaatgctgagaagctggagagtgaagaagatgtgtcccaggccttcctggaggccgtggccgaggagaagccccacgtgaagccctacttcagcaagaccatccgggacctggaggtggtggagggcagcgctgccaggtttgactgcaagattgagggctacccagaccctgaggtggtgtggttcaaggatgaccagagcatccgggagagccgccacttccagattgattatgatgaagatggcaactgcagcctcatcatcagtgatgtgtgtggagatgatgatgccaagtacacctgcaaggctgtgaacagcctgggggaggccacctgcacagctgagctgattgtggagaccatggaggagggggagggggagggggaggaggaggaggagtag

SEQ ID NO: 20676 - DNA, 5745 bp, Artificial Sequence
  Description of Artificial Sequence: Synthetic coding sequence
atgggagatgtgaagctggtggccagcagccacatcagcaagaccagcctgtctgtggaccccagccgggtggacagcatgcccctgacagaggccccagccttcatcctgccccccaggaacctgtgcatcaaggagggcgccacagccaagtttgagggccgggtgcggggctacccagagccccaggtgacctggcacagaaatggccagcccatcaccagcggcggccgcttcctgctggactgtggcatccggggcaccttcagcctggtgattcatgctgtgcatgaagaagatcggggcaagtacacctgtgaggccaccaacggcagcggggcccggcaggtgacagtggagctgactgtggagggcagctttgccaagcagctgggccagcctgtggtgtccaagaccctgggggaccgcttcagcgccccagctgtggagacccggcccagcatctggggcgagtgcccccccaagtttgccaccaagctgggccgggtggtggtgaaggagggccagatgggccgcttcagctgcaagatcaccggccggccccagccccaggtgacctggctgaagggaaatgtgcccctgcagcccagcgcccgggtgtctgtgtctgagaagaatggcatgcaggtgctggagatccatggagtgaaccaggatgatgtgggcgtgtacacctgcctggtggtgaatggaagtggcaaggcctccatgtctgctgagctgagcatccagggcctggacagcgccaacagaagctttgtgcgggagaccaaggccaccaacagtgatgtgaggaaggaggtgaccaacgtcatcagcaaggagagcaagctggacagcctggaggccgccgccaagagcaagaactgcagcagcccccagagaggaggcagccccccctgggccgccaacagccagccccagcccccccgggagagcaagctggagagctgcaaggacagccccaggacagccccccagacccctgtgctgcagaagaccagcagcagcatcaccctgcaggccgcccgggtgcagcctgagccccgggcccctggcctgggcgtgctgagccccagcggggaggagaggaagaggcctgccccacccaggcctgccaccttccccacccggcagcccggcctgggcagccaggatgtggtgtccaaggccgccaacagacgcatccccatggagggccagagggacagcgccttccccaagtttgagagcaagccccagagccaggaggtgaaggagaaccagacagtgaagttccgctgtgaggtgtctggcatccccaagccagaggtggcctggttcctggagggcacccctgtgcggcggcaggagggcagcattgaggtgtatgaagatgctggcagccactacctgtgcctgctgaaggcccggacccgggacagcggcacctacagctgcacagccagcaatgcccagggccagctgagctgctcctggaccctgcaggtggagcggctggccgtgatggaggtggcccccagcttcagctctgtgctgaaggactgtgccgtcatcgagggccaggactttgtgctgcagtgcagcgtgcggggcacccctgtgccccgcatcacctggctgctgaatggccagcccatccagtatgcccggagcacctgtgaggccggcgtggccgagctgcacatccaggatgccctgcctgaggaccacggcacctacacctgcctggccgagaatgccctgggccaggtgtcctgcagcgcctgggtgacagtgcatgagaagaagagcagcaggaagtctgagtacctgctgcctgtggcccccagcaagcccacagcccccatcttcctgcagggcctgagtgacctgaaggtgatggatggcagccaggtgaccatgacagtgcaggtgtctggcaaccccccacctgaggtgatctggctgcacaatggaaatgagatccaggagagcgaggacttccactttgagcagaggggcacccagcacagcctgtgcatccaggaggtgtttcctgaggacaccggcacctacacctgtgaggcctggaacagcgctggggaggtgaggacccaggccgtgctgactgtgcaggagccccatgatggcacccagccctggttcatcagcaagcccaggtctgtgacagccagcctgggccagagcgtgctgatcagctgtgccatcgccggggaccccttccccaccgtgcactggctgagagatggcaaggccctgtgcaaggacaccggccactttgaggtgctgcagaatgaagatgtgttcaccctggtgctgaagaaggtgcagccctggcatgctggccagtatgagatcctgctgaagaacagagtgggggagtgcagctgccaggtgtccctgatgctgcagaacagcagcgcccgggccctgccccggggccgggagcccgccagctgtgaggacctgtgtggcggcggcgtgggcgcagatggcggcggcagtgacagatatggcagcctgcggcccggctggccagcccggggccagggctggctggaggaggaggatggagaagatgtgcggggcgtgctgaagagaagagtggagacccggcagcacacagaggaggccatccggcagcaggaggtggagcagctggacttccgggacctgctgggcaagaaggtgtccaccaagaccctgtctgaagatgacctgaaggagatcccagctgagcagatggacttccgggccaacctgcagaggcaggtgaagcccaagacagtgtctgaggaggagaggaaggtgcacagcccccagcaggtggacttccgctctgtgctggccaagaagggcaccagcaagacccctgtgcctgagaaggtgcccccacccaagccagccaccccagacttccgctctgtgctgggcggcaagaagaagctgcctgcagaaaatggcagcagcagcgctgagaccctgaatgccaaggctgtggagagcagcaagcccctgagcaatgcccagcccagcggccccctgaagcctgtgggcaatgccaagccagctgagaccctgaagcccatgggaaatgccaagccagctgagaccctgaagcccatgggaaatgccaagccagatgagaacctgaagagcgccagcaaggaggagctgaagaaggatgtgaagaatgatgtgaactgcaagaggggccacgccggcaccacagacaatgagaagaggtctgagagccagggcacagccccagccttcaagcagaagctgcaggatgtgcacgtggccgagggcaagaagctgctgctgcagtgccaggtgtccagtgaccccccagccaccatcatctggaccctgaatggcaagaccctgaagaccaccaagttcatcatcctgagccaggagggcagcctgtgcagcgtgtccattgagaaggccctgcctgaagatcggggcctgtacaagtgtgtggccaagaatgatgctggccaggccgagtgcagctgccaggtgacagtggatgatgccccagccagcgagaacaccaaggcccctgagatgaagagccggcggcccaagagcagcctgccccctgtgctgggcacagaaagtgatgccaccgtgaagaagaagccagcccccaagaccccacccaaggccgccatgccaccccagatcatccagtttcctgaggaccagaaggtgcgggccggggagagcgtggagctgtttgggaaggtgacaggcacccagcccatcacctgcacctggatgaagttcaggaagcagatccaggagagcgagcacatgaaggtggagaacagtgaaaatggcagcaagctgaccatcctggccgcccggcaggagcactgcggctgctacaccctgctggtggagaacaagctgggcagccggcaggcccaggtgaacctgactgtggtggacaagccagaccccccagctggcaccccctgtgccagtgacatccgcagcagcagcctgaccctgtcctggtacggcagcagctatgatggcggcagcgctgtgcagagctacagcattgagatctgggacagcgccaacaagacctggaaggagctggccacctgccgcagcaccagcttcaacgtgcaggacctgctgcctgaccacgagtacaagttccgggtgcgggccatcaacgtgtatggcaccagcgagcccagccaggagagcgagctgaccaccgtgggggagaagccagaggagcccaaggatgaggtggaggtgtctgatgatgatgagaaggagcctgaggtggactacagaacagtgaccatcaacacagagcagaaggtgtctgacttctatgacatcgaggagcggctgggcagcggcaagtttggccaggtgttccggctggtggagaagaagaccaggaaggtgtgggccggcaagttcttcaaggcctacagcgccaaggagaaggagaacatccggcaggagatcagcatcatgaactgcctgcaccaccccaagctggtgcagtgtgtggatgcctttgaggagaaggccaacatcgtgatggtgctggagatcgtgtctggaggagagctgtttgagcgcatcattgatgaagattttgagctgacagaaagagagtgcatcaagtacatgaggcagatcagcgagggcgtggagtacatccacaagcagggcatcgtgcacctggacctgaagccagagaacatcatgtgtgtgaacaagacaggcacccgcatcaagctgattgactttggcctggcccggcggctggagaatgccggcagcctgaaggtgctgtttggcaccccagagtttgtggcccctgaggtgatcaactatgagcccatcggctacgccacagacatgtggagcattggagtcatctgctacatcctggtgtctggcctgagccccttcatgggagacaatgacaatgagaccctggccaacgtgaccagcgccacctgggactttgatgatgaggcctttgatgagatcagtgatgatgccaaggacttcatcagcaacctgctgaagaaggacatgaagaaccggctggactgcacccagtgcctgcagcacccctggctgatgaaggacaccaagaacatggaggccaagaagctgagcaaggacaggatgaagaagtacatggcccggaggaagtggcagaagacaggaaatgctgtgcgggccatcggccgcctgagctccatggccatgatcagcggcctgagcggcaggaagagcagcacaggcagccccaccagccccctgaatgctgagaagctggagagcgaggaggatgtgtcccaggccttcctggaggccgtggccgaggagaagccccacgtgaagccctacttcagcaagaccatccgggacctggaggtggtggagggcagcgctgccaggtttgactgcaagattgagggctacccagaccctgaggtggtgtggttcaaggatgaccagagcatccgggagagccgccacttccagattgattatgatgaagatggcaactgcagcctcatcatcagtgatgtgtgtggagatgatgatgccaagtacacctgcaaggctgtgaacagcctgggggaggccacctgcacagctgagctgattgtggagaccatggaggagggggagggggagggggaggaggaggaggagtag

SEQ ID NO: 20677 - DNA, 231 bp, Artificial Sequence
  Description of Artificial Sequence: Synthetic coding sequence
atgggagatgtgaagctggtggccagcagccacatcagcaagaccagcctgtctgtggaccccagccgggtggacagcatgcccctgacagaggccccagccttcatcctgccccccaggaacctgtgcatcaaggagggcgccacagccaagtttgagggccgggtgcggggctacccagagccccaggtgacctggcacagaaatggccagcccatcaccagcggctag

SEQ ID NO: 20678 - DNA, 5592 bp, Artificial Sequence; identical to SEQ ID NO: 20675
  Description of Artificial Sequence: Synthetic coding sequence

SEQ ID NO: 20679 - DNA, 465 bp, Artificial Sequence
  Description of Artificial Sequence: Synthetic coding sequence
atggccatgatcagcggcctgagcggcaggaagagcagcacaggcagccccaccagccccctgaatgctgagaagctggagagcgaggaggatgtgtcccaggccttcctggaggccgtggccgaggagaagccccacgtgaagccctacttcagcaagaccatccgggacctggaggtggtggagggcagcgctgccaggtttgactgcaagattgagggctacccagaccctgaggtggtgtggttcaaggatgaccagagcatccgggagagccgccacttccagattgattatgatgaagatggcaactgcagcctcatcatcagtgatgtgtgtggagatgatgatgccaagtacacctgcaaggctgtgaacagcctgggggaggccacctgcacagctgagctgattgtggagaccatggaggagggggagggggagggggaggaggaggaggagtag

SEQ ID NO: 20680 - DNA, 5745 bp, Artificial Sequence; identical to SEQ ID NO: 20676
  Description of Artificial Sequence: Synthetic coding sequence

SEQ ID NO: 20681 - DNA, 5931 bp, Artificial Sequence
  Description of Artificial Sequence: Synthetic coding sequence
atggcccagaggacaggcctggaggaccctgagcgctacctgtttgtggacagagctgtgatctacaacccagccacccaggccgactggacagccaagaagctggtgtggatccccagcgagagacatggctttgaagctgccagcatcaaggaggagagaggagatgaggtgatggtggagctggccgagaatggcaagaaggccatggtgaacaaggatgacatccagaagatgaacccccccaagttcagcaaggtggaggacatggccgagctgacctgcctgaatgaggcctctgtgctgcacaacctgaaggaccgctactacagcggcctcatctacacctacagcggcctcttctgtgtggtgatcaacccctacaagaacctgcccatctacagcgagaacatcatcgagatgtaccggggcaagaagagacatgagatgccaccccacatctatgccatcagcgagagcgcctaccgctgcatgctgcaggaccgggaggaccagagcatcctgtgcacaggagagagcggggccggcaagacagagaacaccaagaaggtgatccagtacctggcccacgtggccagcagccacaagggcaggaaggaccacaacatccctggagagctggagcggcagctgctgcaggccaaccccatcctggagagctttggaaatgccaagacagtgaagaatgacaacagcagcagatttgggaagttcatccgcatcaactttgatgtgacaggctacatcgtgggcgccaacatcgagacctacctgctggagaagagcagagctgtgcggcaggccaaggatgagaggaccttccacatcttctaccagctgctgtctggagctggggagcacctgaagagtgacctgctgctggagggcttcaacaactaccgcttcctgagcaatggctacatccccatccctggccagcaggacaaggacaacttccaggagaccatggaggccatgcacatcatgggcttcagccatgaggagatcctgtccatgctgaaggtggtgtcctctgtgctgcagtttggaaacatctccttcaagaaggagaggaacacagaccaggcctccatgcctgagaacacagtggcccagaagctgtgccacctgctgggcatgaatgtgatggagttcacccgggccatcctgaccccccgcatcaaggtgggccgggactatgtgcagaaggcccagaccaaggagcaggccgactttgctgtggaggccctggccaaggccacctatgagcggctcttccgctggctggtgcaccgcatcaacaaggccctggacaggaccaagaggcagggcgccagcttcatcggcatcctggacattgctggctttgagatctttgagctgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgacctgattgaaagacctgccaaccccccaggagtgctggccctgctggatgaggagtgctggttccccaaggccacagacaagacctttgtggagaagctggtgcaggagcagggcagccacagcaagttccagaagccccggcagctgaaggacaaggctgacttctgcatcatccactacgccggcaaggtggactacaaggcagatgagtggctgatgaagaacatggaccccctgaatgacaacgtggccaccctgctgcaccagagcagtgacagatttgtggccgagctgtggaaggatgtggacagaattgtgggcctggaccaggtgacaggcatgacagaaacagcctttggaagtgcctacaagaccaagaagggcatgttcagaacagtgggccagctgtacaaggagagcctgaccaagctgatggccaccctgaggaacaccaaccccaactttgtgcgctgcatcatccccaaccacgagaagagagctgggaagctggacccccacctggtgctggaccagctgcgctgcaatggagtgctggagggcatccgcatctgccggcagggcttccccaacagaattgtgttccaggagttccggcagagatatgagatcctgaccccaaatgccatccccaagggcttcatggatggcaagcaggcctgtgagaggatgatccgggccctggagctggaccccaacctgtacagaattggccagagcaagatcttcttccgggccggcgtgctggcccacctggaggaggagcgggacctgaagatcacagacatcatcatcttcttccaggccgtgtgccggggctacctggccaggaaggcctttgccaagaagcagcagcagctgagcgccctgaaggtgctgcagaggaactgtgccgcctacctgaagctgcggcactggcagtggtggagggtcttcaccaaggtgaagcccctgctgcaggtgacccggcaggaggaggagctgcaggccaaggatgaggagctgctgaaggtgaaggagaagcagaccaaggtggagggggagctggaggagatggagaggaagcaccagcagctgctggaggagaagaacatcctggccgagcagctgcaggccgagacagagctgtttgctgaggccgaggagatgagggcccggctggccgccaagaagcaggagctggaggagatcctgcatgacctggagagccgggtggaggaggaggaggagaggaaccagatcctgcagaatgagaagaagaagatgcaggcccacatccaggacctggaggagcagctggatgaggaggagggcgcccggcagaagctgcagctggagaaggtgacagctgaggccaagatcaagaagatggaggaggagatcctgctgctggaggaccagaacagcaagttcatcaaggagaagaagctgatggaggacagaattgctgagtgcagcagccagctggccgaggaggaggagaaggccaagaacctggccaagatccggaacaagcaggaggtgatgatcagtgacctggaggagcggctgaagaaggaggagaagacccggcaggagctggagaaggccaagaggaagctggatggagagaccacagacctgcaggaccagattgctgagctgcaggcccagattgatgagctgaagctgcagctggccaagaaggaggaggagctgcagggcgccctggcccggggagatgatgagaccctgcacaagaacaatgccctgaaggtggtgcgggagctgcaggcccagattgctgagctgcaggaggactttgaaagtgagaaggccagcaggaacaaggccgagaagcagaagagggacctgtctgaggagctggaggccctgaagacagagctggaggacaccctggacaccacagctgcccagcaggagctgcggaccaagcgggagcaggaggtggccgagctgaagaaggccctggaggaggagaccaagaaccacgaggcccagatccaggacatgaggcagagacatgccacagccctggaggagctgtctgagcagctggagcaggccaagcgcttcaaggccaacctggagaagaacaagcagggcctggagacagacaacaaggagctggcctgtgaggtgaaggtgctgcagcaggtgaaggccgagagcgagcacaagaggaagaagctggatgcccaggtgcaggagctgcacgccaaggtgtctgagggggaccggctgcgggtggagctggccgagaaggccagcaagctgcagaatgagctggacaacgtgtccaccctgctggaggaggccgagaagaagggcatcaagtttgccaaggatgctgccagcctggagagccagctgcaggacacccaggagctgctgcaggaggagacccggcagaagctgaacctgagcagccgcatccggcagctggaggaggagaagaacagcctgcaggagcagcaggaggaggaggaggaggccaggaagaacctggagaagcaggtgctggccctgcagagccagctggccgacaccaagaagaaggtggatgatgacctgggcaccatcgagagcctggaggaggccaagaagaagctgctgaaggatgctgaggccctgagccagaggctggaggagaaggccctggcctatgacaagctggagaagaccaagaaccggctgcagcaggagctggatgacctgactgtggacctggaccaccagaggcaggtggccagcaacctggagaagaagcagaagaagtttgaccagctgctggccgaggagaagagcatcagcgcccgctatgcagaggagcgggacagagctgaggccgaggcccgggagaaggagaccaaggccctgagcctggcccgggccctggaggaggccctggaggccaaggaggagtttgagcggcagaacaagcagctgcgggctgacatggaggacctgatgagcagcaaggatgatgtgggcaagaatgtgcatgagctggagaagagcaagagggccctggagcagcaggtggaggagatgaggacccagctggaggagctggaggatgagctgcaggccacagaagatgccaagctgcggctggaggtgaacatgcaggccatgaaggcccagtttgagcgggacctgcagaccagagatgagcagaatgaggagaagaagaggctgctgatcaagcaggtgcgggagctggaggccgagctggaggatgagaggaagcagagggccctggccgtggccagcaagaagaagatggagattgacctgaaggacctggaggcccagattgaagctgccaacaaggccagagatgaagtcatcaagcagctgaggaagctgcaggcccagatgaaggactaccagcgggagctggaggaggcccgggccagcagagatgagatctttgcccagagcaaggagagcgagaagaagctgaagagcctggaggccgagatcctgcagctgcaggaggagctggccagcagcgagcgggccaggagacatgctgagcaggagagagatgagctggctgatgagatcaccaacagcgccagcggcaagagcgccctgctggatgagaagaggcggctggaggcccgcatcgcccagctggaggaggagctggaggaggagcagagcaacatggagctgctgaatgaccgcttcaggaagaccaccctgcaggtggacaccctgaatgctgagctggccgctgagaggtctgctgcccagaagagtgacaatgcccggcagcagctggagcggcagaacaaggagctgaaggccaagctgcaggagctggagggcgctgtgaagagcaagttcaaggccaccatcagcgccctggaggccaagattggccagctggaggagcagctggagcaggaggccaaggagagagctgctgccaacaagctggtgagaagaacagagaagaagctgaaggagatcttcatgcaggtggaggatgagaggagacatgctgaccagtacaaggagcagatggagaaggccaatgccaggatgaagcagctgaagaggcagctggaggaggccgaggaggaggccacccgggccaatgccagcaggaggaagctgcagcgggagctggatgatgccacagaggccaatgaaggcctgagccgggaggtgtccaccctgaagaaccggctgcggcggggcggccccatctccttcagcagcagccgctctggaagacggcagctgcacctggagggcgccagcctggagctgagtgatgatgacacagagagcaagaccagtgatgtgaatgagacccagcccccccagagcgagtag

SEQ ID NO: 20682 - DNA, 6024 bp, Artificial Sequence
  Description of Artificial Sequence: Synthetic coding sequence
atggcccagaggacaggcctggaggaccctgagcgctacctgtttgtggacagagctgtgatctacaacccagccacccaggccgactggacagccaagaagctggtgtggatccccagcgagagacatggctttgaagctgccagcatcaaggaggagagaggagatgaggtgatggtggagctggccgagaatggcaagaaggccatggtgaacaaggatgacatccagaagatgaacccccccaagttcagcaaggtggaggacatggccgagctgacctgcctgaatgaggcctctgtgctgcacaacctgaaggaccgctactacagcggcctcatctacacctacagcggcctcttctgtgtggtgatcaacccctacaagaacctgcccatctacagcgagaacatcatcgagatgtaccggggcaagaagagacatgagatgccaccccacatctatgccatcagcgagagcgcctaccgctgcatgctgcaggaccgggaggaccagagcatcctgtgcacaggagagagcggggccggcaagacagagaacaccaagaaggtgatccagtacctggcccacgtggccagcagccacaagggcaggaaggaccacaacatcccccaggagagccccaagcctgtgaagcaccagggcgagctggagcggcagctgctgcaggccaaccccatcctggagagctttggaaatgccaagacagtgaagaatgacaacagcagcagatttgggaagttcatccgcatcaactttgatgtgacaggctacatcgtgggcgccaacatcgagacctacctgctggagaagagcagagctgtgcggcaggccaaggatgagaggaccttccacatcttctaccagctgctgtctggagctggggagcacctgaagagtgacctgctgctggagggcttcaacaactaccgcttcctgagcaatggctacatccccatccctggccagcaggacaaggacaacttccaggagaccatggaggccatgcacatcatgggcttcagccatgaggagatcctgtccatgctgaaggtggtgtcctctgtgctgcagtttggaaacatctccttcaagaaggagaggaacacagaccaggcctccatgcctgagaacacagtggcccagaagctgtgccacctgctgggcatgaatgtgatggagttcacccgggccatcctgaccccccgcatcaaggtgggccgggactatgtgcagaaggcccagaccaaggagcaggccgactttgctgtggaggccctggccaaggccacctatgagcggctcttccgctggctggtgcaccgcatcaacaaggccctggacaggaccaagaggcagggcgccagcttcatcggcatcctggacattgctggctttgagatctttgagctgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgacctgattgaaagacctgccaaccccccaggagtgctggccctgctggatgaggagtgctggttccccaaggccacagacaagacctttgtggagaagctggtgcaggagcagggcagccacagcaagttccagaagccccggcagctgaaggacaaggctgacttctgcatcatccactacgccggcaaggtggactacaaggcagatgagtggctgatgaagaacatggaccccctgaatgacaacgtggccaccctgctgcaccagagcagtgacagatttgtggccgagctgtggaaggatgagatccagaacatccagagggccagcttctatgacagcgtgtctggcctgcacgagccccctgtggaccgcatcgtgggcctggaccaggtgacaggcatgacagaaacagccttcggcagcgcctacaagaccaagaagggcatgttcagaacagtgggccagctgtacaaggagagcctgaccaagctgatggccaccctgaggaacaccaaccccaactttgtgcgctgcatcatccccaaccacgagaagagagctgggaagctggacccccacctggtgctggaccagctgcgctgcaatggagtgctggagggcatccgcatctgccggcagggcttccccaaccgcatcgtgttccaggagttccggcagagatatgagatcctgaccccaaatgccatccccaagggcttcatggatggcaagcaggcctgtgagaggatgatccgggccctggagctggaccccaacctgtaccgcatcggccagagcaagatcttcttccgggccggcgtgctggcccacctggaggaggagcgggacctgaagatcacagacatcatcatcttcttccaggccgtgtgccggggctacctggccaggaaggcctttgccaagaagcagcagcagctgagcgccctgaaggtgctgcagaggaactgtgccgcctacctgaagctgcggcactggcagtggtggagggtcttcaccaaggtgaagcccctgctgcaggtgacccggcaggaggaggagctgcaggccaaggatgaggagctgctgaaggtgaaggagaagcagaccaaggtggagggggagctggaggagatggagaggaagcaccagcagctgctggaggagaagaacatcctggccgagcagctgcaggccgagacagagctgtttgctgaggccgaggagatgagggcccggctggccgccaagaagcaggagctggaggagatcctgcatgacctggagagccgggtggaggaggaggaggagaggaaccagatcctgcagaatgagaagaagaagatgcaggcccacatccaggacctggaggagcagctggatgaggaggagggcgcccggcagaagctgcagctggagaaggtgacagctgaggccaagatcaagaagatggaggaggagatcctgctgctggaggaccagaacagcaagttcatcaaggagaagaagctgatggaggacagaattgctgaatgtagcagccagctggccgaggaggaggagaaggccaagaacctggccaagatccggaacaagcaggaggtgatgatcagtgacctggaggagcggctgaagaaggaggagaagacccggcaggagctggagaaggccaagaggaagctggatggagagaccacagacctgcaggaccagattgctgagctgcaggcccagattgatgagctgaagctgcagctggccaagaaggaggaggagctgcagggcgccctggcccggggagatgatgagaccctgcacaagaacaatgccctgaaggtggtgcgggagctgcaggcccagattgctgagctgcaggaggactttgagagcgagaaggccagcaggaacaaggccgagaagcagaagagggacctgtctgaggagctggaggccctgaagacagagctggaggacaccctggacaccacagctgcccagcaggagctgcggaccaagcgggagcaggaggtggccgagctgaagaaggccctggaggaggagaccaagaaccacgaggcccagatccaggacatgaggcagagacatgccacagccctggaggagctgtctgagcagctggagcaggccaagcgcttcaaggccaacctggagaagaacaagcagggcctggagacagacaacaaggagctggcctgtgaggtgaaggtgctgcagcaggtgaaggccgagagcgagcacaagaggaagaagctggatgcccaggtgcaggagctgcacgccaaggtgtctgagggggaccggctgcgggtggagctggccgagaaggccagcaagctgcagaatgagctggacaacgtgtccaccctgctggaggaggccgagaagaagggcatcaagtttgccaaggatgctgccagcctggagagccagctgcaggacacccaggagctgctgcaggaggagacccggcagaagctgaacctgagcagccgcatccggcagctggaggaggagaagaacagcctgcaggagcagcaggaggaggaggaggaggccaggaagaacctggagaagcaggtgctggccctgcagagccagctggccgacaccaagaagaaggtggatgatgacctgggcaccatcgagagcctggaggaggccaagaagaagctgctgaaggatgctgaggccctgagccagaggctggaggagaaggccctggcctatgacaagctggagaagaccaagaaccggctgcagcaggagctggatgacctgactgtggacctggaccaccagaggcaggtggccagcaacctggagaagaagcagaagaagtttgaccagctgctggccgaggagaagagcatcagcgcccgctatgcagaggagcgggacagagctgaggccgaggcccgggagaaggagaccaaggccctgagcctggcccgggccctggaggaggccctggaggccaaggaggagtttgagcggcagaacaagcagctgcgggctgacatggaggacctgatgagcagcaaggatgatgtgggcaagaatgtgcatgagctggagaagagcaagagggccctggagcagcaggtggaggagatgaggacccagctggaggagctggaggatgagctgcaggccacagaagatgccaagctgcggctggaggtgaacatgcaggccatgaaggcccagtttgagcgggacctgcagaccagagatgagcagaatgaggagaagaagaggctgctgatcaagcaggtgcgggagctggaggccgagctggaggatgagaggaagcagagggccctggccgtggccagcaagaagaagatggagattgacctgaaggacctggaggcccagatcgaggccgccaacaaggccagagatgaggtgatcaagcagctgaggaagctgcaggcccagatgaaggactaccagcgggagctggaggaggcccgggccagcagagatgagatctttgcccagagcaaggagagcgagaagaagctgaagagcctggaggccgagatcctgcagctgcaggaggagctggccagcagcgagcgggccaggagacatgctgagcaggagagagatgagctggctgatgagatcaccaacagcgccagcggcaagagcgccctgctggatgagaagaggcggctggaggccagaattgcccagctggaggaggagctggaggaggagcagagcaacatggagctgctgaatgaccgcttcaggaagaccaccctgcaggtggacaccctgaatgctgagctggccgctgagaggtctgctgcccagaagagtgacaatgcccggcagcagctggagcggcagaacaaggagctgaaggccaagctgcaggagctggagggcgctgtgaagagcaagttcaaggccaccatcagcgccctggaggccaagattggccagctggaggagcagctggagcaggaggccaaggagagagctgctgccaacaagctggtgcggaggacagagaagaagctgaaggagatcttcatgcaggtggaggatgaaagaagacatgctgaccagtacaaggagcagatggagaaggccaatgccaggatgaagcagctgaagaggcagctggaggaggccgaggaggaggccacccgggccaatgccagcaggaggaagctgcagcgggagctggatgatgccacagaggccaatgaaggcctgagccgggaggtgtccaccctgaagaaccggctgcggcggggcggccccatctccttcagcagcagccgcagcggccggcggcagctgcacctggagggcgccagcctggagctgagtgatgatgacacagagagcaagaccagtgatgtgaatgagacccagcccccccagagcgagtag

SEQ ID NO: 20683 - DNA, 5979 bp, Artificial Sequence
  Description of Artificial Sequence: Synthetic coding sequence
atggcccagaggacaggcctggaggaccctgagcgctacctgtttgtggacagagctgtgatctacaacccagccacccaggccgactggacagccaagaagctggtgtggatccccagcgagagacatggctttgaagctgccagcatcaaggaggagagaggagatgaggtgatggtggagctggccgagaatggcaagaaggccatggtgaacaaggatgacatccagaagatgaacccccccaagttcagcaaggtggaggacatggccgagctgacctgcctgaatgaggcctctgtgctgcacaacctgaaggaccgctactacagcggcctcatctacacctacagcggcctcttctgtgtggtgatcaacccctacaagaacctgcccatctacagcgagaacatcatcgagatgtaccggggcaagaagagacatgagatgccaccccacatctatgccatcagcgagagcgcctaccgctgcatgctgcaggaccgggaggaccagagcatcctgtgcacaggagagagcggggccggcaagacagagaacaccaagaaggtgatccagtacctggcccacgtggccagcagccacaagggcaggaaggaccacaacatcccccaggagagccccaagcctgtgaagcaccaggccagcgccctgctgtatggagagctggagcggcagctgctgcaggccaaccccatcctggagagctttggaaatgccaagacagtgaagaatgacaacagcagcagatttgggaagttcatccgcatcaactttgatgtgacaggctacatcgtgggcgccaacatcgagacctacctgctggagaagagcagagctgtgcggcaggccaaggatgagaggaccttccacatcttctaccagctgctgtctggagctggggagcacctgaagagtgacctgctgctggagggcttcaacaactaccgcttcctgagcaatggctacatccccatccctggccagcaggacaaggacaacttccaggagaccatggaggccatgcacatcatgggcttcagccatgaggagatcctgtccatgctgaaggtggtgtcctctgtgctgcagtttggaaacatctccttcaagaaggagaggaacacagaccaggcctccatgcctgagaacacagtggcccagaagctgtgccacctgctgggcatgaatgtgatggagttcacccgggccatcctgaccccccgcatcaaggtgggccgggactatgtgcagaaggcccagaccaaggagcaggccgactttgctgtggaggccctggccaaggccacctatgagcggctcttccgctggctggtgcaccgcatcaacaaggccctggacaggaccaagaggcagggcgccagcttcatcggcatcctggacattgctggctttgagatctttgagctgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgacctgattgaaagacctgccaaccccccaggagtgctggccctgctggatgaggagtgctggttccccaaggccacagacaagacctttgtggagaagctggtgcaggagcagggcagccacagcaagttccagaagccccggcagctgaaggacaaggctgacttctgcatcatccactacgccggcaaggtggactacaaggcagatgagtggctgatgaagaacatggaccccctgaatgacaacgtggccaccctgctgcaccagagcagtgacagatttgtggccgagctgtggaaggatgtggacagaattgtgggcctggaccaggtgacaggcatgacagaaacagcctttggaagtgcctacaagaccaagaagggcatgttcagaacagtgggccagctgtacaaggagagcctgaccaagctgatggccaccctgaggaacaccaaccccaactttgtgcgctgcatcatccccaaccacgagaagagagctgggaagctggacccccacctggtgctggaccagctgcgctgcaatggagtgctggagggcatccgcatctgccggcagggcttccccaacagaattgtgttccaggagttccggcagagatatgagatcctgaccccaaatgccatccccaagggcttcatggatggcaagcaggcctgtgagaggatgatccgggccctggagctggaccccaacctgtacagaattggccagagcaagatcttcttccgggccggcgtgctggcccacctggaggaggagcgggacctgaagatcacagacatcatcatcttcttccaggccgtgtgccggggctacctggccaggaaggcctttgccaagaagcagcagcagctgagcgccctgaaggtgctgcagaggaactgtgccgcctacctgaagctgcggcactggcagtggtggagggtcttcaccaaggtgaagcccctgctgcaggtgacccggcaggaggaggagctgcaggccaaggatgaggagctgctgaaggtgaaggagaagcagaccaaggtggagggggagctggaggagatggagaggaagcaccagcagctgctggaggagaagaacatcctggccgagcagctgcaggccgagacagagctgtttgctgaggccgaggagatgagggcccggctggccgccaagaagcaggagctggaggagatcctgcatgacctggagagccgggtggaggaggaggaggagaggaaccagatcctgcagaatgagaagaagaagatgcaggcccacatccaggacctggaggagcagctggatgaggaggagggcgcccggcagaagctgcagctggagaaggtgacagctgaggccaagatcaagaagatggaggaggagatcctgctgctggaggaccagaacagcaagttcatcaaggagaagaagctgatggaggacagaattgctgagtgcagcagccagctggccgaggaggaggagaaggccaagaacctggccaagatccggaacaagcaggaggtgatgatcagtgacctggaggagcggctgaagaaggaggagaagacccggcaggagctggagaaggccaagaggaagctggatggagagaccacagacctgcaggaccagattgctgagctgcaggcccagattgatgagctgaagctgcagctggccaagaaggaggaggagctgcagggcgccctggcccggggagatgatgagaccctgcacaagaacaatgccctgaaggtggtgcgggagctgcaggcccagattgctgagctgcaggaggactttgaaagtgagaaggccagcaggaacaaggccgagaagcagaagagggacctgtctgaggagctggaggccctgaagacagagctggaggacaccctggacaccacagctgcccagcaggagctgcggaccaagcgggagcaggaggtggccgagctgaagaaggccctggaggaggagaccaagaaccacgaggcccagatccaggacatgaggcagagacatgccacagccctggaggagctgtctgagcagctggagcaggccaagcgcttcaaggccaacctggagaagaacaagcagggcctggagacagacaacaaggagctggcctgtgaggtgaaggtgctgcagcaggtgaaggccgagagcgagcacaagaggaagaagctggatgcccaggtgcaggagctgcacgccaaggtgtctgagggggaccggctgcgggtggagctggccgagaaggccagcaagctgcagaatgagctggacaacgtgtccaccctgctggaggaggccgagaagaagggcatcaagtttgccaaggatgctgccagcctggagagccagctgcaggacacccaggagctgctgcaggaggagacccggcagaagctgaacctgagcagccgcatccggcagctggaggaggagaagaacagcctgcaggagcagcaggaggaggaggaggaggccaggaagaacctggagaagcaggtgctggccctgcagagccagctggccgacaccaagaagaaggtggatgatgacctgggcaccatcgagagcctggaggaggccaagaagaagctgctgaaggatgctgaggccctgagccagaggctggaggagaaggccctggcctatgacaagctggagaagaccaagaaccggctgcagcaggagctggatgacctgactgtggacctggaccaccagaggcaggtggccagcaacctggagaagaagcagaagaagtttgaccagctgctggccgaggagaagagcatcagcgcccgctatgcagaggagcgggacagagctgaggccgaggcccgggagaaggagaccaaggccctgagcctggcccgggccctggaggaggccctggaggccaaggaggagtttgagcggcagaacaagcagctgcgggctgacatggaggacctgatgagcagcaaggatgatgtgggcaagaatgtgcatgagctggagaagagcaagagggccctggagcagcaggtggaggagatgaggacccagctggaggagctggaggatgagctgcaggccacagaagatgccaagctgcggctggaggtgaacatgcaggccatgaaggcccagtttgagcgggacctgcagaccagagatgagcagaatgaggagaagaagaggctgctgatcaagcaggtgcgggagctggaggccgagctggaggatgagaggaagcagagggccctggccgtggccagcaagaagaagatggagattgacctgaaggacctggaggcccagattgaagctgccaacaaggccagagatgaagtcatcaagcagctgaggaagctgcaggcccagatgaaggactaccagcgggagctggaggaggcccgggccagcagagatgagatctttgcccagagcaaggagagcgagaagaagctgaagagcctggaggccgagatcctgcagctgcaggaggagctggccagcagcgagcgggccaggagacatgctgagcaggagagagatgagctggctgatgagatcaccaacagcgccagcggcaagagcgccctgctggatgagaagaggcggctggaggcccgcatcgcccagctggaggaggagctggaggaggagcagagcaacatggagctgctgaatgaccgcttcaggaagaccaccctgcaggtggacaccctgaatgctgagctggccgctgagaggtctgctgcccagaagagtgacaatgcccggcagcagctggagcggcagaacaaggagctgaaggccaagctgcaggagctggagggcgctgtgaagagcaagttcaaggccaccatcagcgccctggaggccaagattggccagctggaggagcagctggagcaggaggccaaggagagagctgctgccaacaagctggtgagaagaacagagaagaagctgaaggagatcttcatgcaggtggaggatgagaggagacatgctgaccagtacaaggagcagatggagaaggccaatgccaggatgaagcagctgaagaggcagctggaggaggccgaggaggaggccacccgggccaatgccagcaggaggaagctgcagcgggagctggatgatgccacagaggccaatgaaggcctgagccgggaggtgtccaccctgaagaaccggctgcggcggggcggccccatctccttcagcagcagccgctctggaagacggcagctgcacctggagggcgccagcctggagctgagtgatgatgacacagagagcaagaccagtgatgtgaatgagacccagcccccccagagcgagtag

SEQ ID NO: 20684 - DNA, 5994 bp, Artificial Sequence
  Description of Artificial Sequence: Synthetic coding sequence
atggcccagaggacaggcctggaggaccctgagcgctacctgtttgtggacagagctgtgatctacaacccagccacccaggccgactggacagccaagaagctggtgtggatccccagcgagagacatggctttgaagctgccagcatcaaggaggagagaggagatgaggtgatggtggagctggccgagaatggcaagaaggccatggtgaacaaggatgacatccagaagatgaacccccccaagttcagcaaggtggaggacatggccgagctgacctgcctgaatgaggcctctgtgctgcacaacctgaaggaccgctactacagcggcctcatctacacctacagcggcctcttctgtgtggtgatcaacccctacaagaacctgcccatctacagcgagaacatcatcgagatgtaccggggcaagaagagacatgagatgccaccccacatctatgccatcagcgagagcgcctaccgctgcatgctgcaggaccgggaggaccagagcatcctgtgcacaggagagagcggggccggcaagacagagaacaccaagaaggtgatccagtacctggcccacgtggccagcagccacaagggcaggaaggaccacaacatccctggagagctggagcggcagctgctgcaggccaaccccatcctggagagctttggaaatgccaagacagtgaagaatgacaacagcagcagatttgggaagttcatccgcatcaactttgatgtgacaggctacatcgtgggcgccaacatcgagacctacctgctggagaagagcagagctgtgcggcaggccaaggatgagaggaccttccacatcttctaccagctgctgtctggagctggggagcacctgaagagtgacctgctgctggagggcttcaacaactaccgcttcctgagcaatggctacatccccatccctggccagcaggacaaggacaacttccaggagaccatggaggccatgcacatcatgggcttcagccatgaggagatcctgtccatgctgaaggtggtgtcctctgtgctgcagtttggaaacatctccttcaagaaggagaggaacacagaccaggcctccatgcctgagaacacagtggcccagaagctgtgccacctgctgggcatgaatgtgatggagttcacccgggccatcctgaccccccgcatcaaggtgggccgggactatgtgcagaaggcccagaccaaggagcaggccgactttgctgtggaggccctggccaaggccacctatgagcggctcttccgctggctggtgcaccgcatcaacaaggccctggacaggaccaagaggcagggcgccagcttcatcggcatcctggacattgctggctttgagatctttgagctgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgacctgattgaaagacctgccaaccccccaggagtgctggccctgctggatgaggagtgctggttccccaaggccacagacaagacctttgtggagaagctggtgcaggagcagggcagccacagcaagttccagaagccccggcagctgaaggacaaggctgacttctgcatcatccactacgccggcaaggtggactacaaggcagatgagtggctgatgaagaacatggaccccctgaatgacaacgtggccaccctgctgcaccagagcagtgacagatttgtggccgagctgtggaaggatgagatccagaacatccagagggccagcttctatgacagcgtgtctggcctgcacgagccccctgtggaccgcatcgtgggcctggaccaggtgacaggcatgacagaaacagccttcggcagcgcctacaagaccaagaagggcatgttcagaacagtgggccagctgtacaaggagagcctgaccaagctgatggccaccctgaggaacaccaaccccaactttgtgcgctgcatcatccccaaccacgagaagagagctgggaagctggacccccacctggtgctggaccagctgcgctgcaatggagtgctggagggcatccgcatctgccggcagggcttccccaaccgcatcgtgttccaggagttccggcagagatatgagatcctgaccccaaatgccatccccaagggcttcatggatggcaagcaggcctgtgagaggatgatccgggccctggagctggaccccaacctgtaccgcatcggccagagcaagatcttcttccgggccggcgtgctggcccacctggaggaggagcgggacctgaagatcacagacatcatcatcttcttccaggccgtgtgccggggctacctggccaggaaggcctttgccaagaagcagcagcagctgagcgccctgaaggtgctgcagaggaactgtgccgcctacctgaagctgcggcactggcagtggtggagggtcttcaccaaggtgaagcccctgctgcaggtgacccggcaggaggaggagctgcaggccaaggatgaggagctgctgaaggtgaaggagaagcagaccaaggtggagggggagctggaggagatggagaggaagcaccagcagctgctggaggagaagaacatcctggccgagcagctgcaggccgagacagagctgtttgctgaggccgaggagatgagggcccggctggccgccaagaagcaggagctggaggagatcctgcatgacctggagagccgggtggaggaggaggaggagaggaaccagatcctgcagaatgagaagaagaagatgcaggcccacatccaggacctggaggagcagctggatgaggaggagggcgcccggcagaagctgcagctggagaaggtgacagctgaggccaagatcaagaagatggaggaggagatcctgctgctggaggaccagaacagcaagttcatcaaggagaagaagctgatggaggacagaattgctgaatgtagcagccagctggccgaggaggaggagaaggccaagaacctggccaagatccggaacaagcaggaggtgatgatcagtgacctggaggagcggctgaagaaggaggagaagacccggcaggagctggagaaggccaagaggaagctggatggagagaccacagacctgcaggaccagattgctgagctgcaggcccagattgatgagctgaagctgcagctggccaagaaggaggaggagctgcagggcgccctggcccggggagatgatgagaccctgcacaagaacaatgccctgaaggtggtgcgggagctgcaggcccagattgctgagctgcaggaggactttgagagcgagaaggccagcaggaacaaggccgagaagcagaagagggacctgtctgaggagctggaggccctgaagacagagctggaggacaccctggacaccacagctgcccagcaggagctgcggaccaagcgggagcaggaggtggccgagctgaagaaggccctggaggaggagaccaagaaccacgaggcccagatccaggacatgaggcagagacatgccacagccctggaggagctgtctgagcagctggagcaggccaagcgcttcaaggccaacctggagaagaacaagcagggcctggagacagacaacaaggagctggcctgtgaggtgaaggtgctgcagcaggtgaaggccgagagcgagcacaagaggaagaagctggatgcccaggtgcaggagctgcacgccaaggtgtctgagggggaccggctgcgggtggagctggccgagaaggccagcaagctgcagaatgagctggacaacgtgtccaccctgctggaggaggccgagaagaagggcatcaagtttgccaaggatgctgccagcctggagagccagctgcaggacacccaggagctgctgcaggaggagacccggcagaagctgaacctgagcagccgcatccggcagctggaggaggagaagaacagcctgcaggagcagcaggaggaggaggaggaggccaggaagaacctggagaagcaggtgctggccctgcagagccagctggccgacaccaagaagaaggtggatgatgacctgggcaccatcgagagcctggaggaggccaagaagaagctgctgaaggatgctgaggccctgagccagaggctggaggagaaggccctggcctatgacaagctggagaagaccaagaaccggctgcagcaggagctggatgacctgactgtggacctggaccaccagaggcaggtggccagcaacctggagaagaagcagaagaagtttgaccagctgctggccgaggagaagagcatcagcgcccgctatgcagaggagcgggacagagctgaggccgaggcccgggagaaggagaccaaggccctgagcctggcccgggccctggaggaggccctggaggccaaggaggagtttgagcggcagaacaagcagctgcgggctgacatggaggacctgatgagcagcaaggatgatgtgggcaagaatgtgcatgagctggagaagagcaagagggccctggagcagcaggtggaggagatgaggacccagctggaggagctggaggatgagctgcaggccacagaagatgccaagctgcggctggaggtgaacatgcaggccatgaaggcccagtttgagcgggacctgcagaccagagatgagcagaatgaggagaagaagaggctgctgatcaagcaggtgcgggagctggaggccgagctggaggatgagaggaagcagagggccctggccgtggccagcaagaagaagatggagattgacctgaaggacctggaggcccagatcgaggccgccaacaaggccagagatgaggtgatcaagcagctgaggaagctgcaggcccagatgaaggactaccagcgggagctggaggaggcccgggccagcagagatgagatctttgcccagagcaaggagagcgagaagaagctgaagagcctggaggccgagatcctgcagctgcaggaggagctggccagcagcgagcgggccaggagacatgctgagcaggagagagatgagctggctgatgagatcaccaacagcgccagcggcaagagcgccctgctggatgagaagaggcggctggaggccagaattgcccagctggaggaggagctggaggaggagcagagcaacatggagctgctgaatgaccgcttcaggaagaccaccctgcaggtggacaccctgaatgctgagctggccgctgagaggtctgctgcccagaagagtgacaatgcccggcagcagctggagcggcagaacaaggagctgaaggccaagctgcaggagctggagggcgctgtgaagagcaagttcaaggccaccatcagcgccctggaggccaagattggccagctggaggagcagctggagcaggaggccaaggagagagctgctgccaacaagctggtgcggaggacagagaagaagctgaaggagatcttcatgcaggtggaggatgaaagaagacatgctgaccagtacaaggagcagatggagaaggccaatgccaggatgaagcagctgaagaggcagctggaggaggccgaggaggaggccacccgggccaatgccagcaggaggaagctgcagcgggagctggatgatgccacagaggccaatgaaggcctgagccgggaggtgtccaccctgaagaaccggctgcggcggggcggccccatctccttcagcagcagccgcagcggccggcggcagctgcacctggagggcgccagcctggagctgagtgatgatgacacagagagcaagaccagtgatgtgaatgagacccagcccccccagagcgagtag

SEQ ID NO: 20685 - DNA, 567 bp, Artificial Sequence
  Description of Artificial Sequence: Synthetic coding sequence
atggcccagaggacaggcctggaggaccctgagcgctacctgtttgtggacagagctgtgatctacaacccagccacccaggccgactggacagccaagaagctggtgtggatccccagcgagagacatggctttgaagctgccagcatcaaggaggagagaggagatgaggtgatggtggagctggccgagaatggcaagaaggccatggtgaacaaggatgacatccagaagatgaacccccccaagttcagcaaggtggaggacatggccgagctgacctgcctgaatgaggcctctgtgctgcacaacctgaaggaccgctactacagcggcctcatctacacctacagcggcctcttctgtgtggtgatcaacccctacaagaacctgcccatctacagcgagaacatcatcgagatgtaccggggcaagaagagacatgagatgccaccccacatctatgccatcagcgagagcgcctaccgctgcatgctgcaggaccgggaggaccagagcatcctgtgcacaggagagagcggggccggcaagacagagaacacctag

SEQ ID NO: 20686 - DNA, 1446 bp, Artificial Sequence
  Description of Artificial Sequence: Synthetic coding sequence
atgtatgatgctgagcggggctggagcctgagctttgctggctgcggcttcctgggcttctaccacgtgggcgccacccgctgcctgtctgagcacgccccccacctgctgagagatgccaggatgctgtttggagccagcgctggggccctgcactgtgtgggcgtgctgagcggcatccccctggagcagaccctgcaggtgctgagtgacctggtgaggaaggcccggagcagaaatattggcatcttccaccccagcttcaacctgagcaagttcctgcggcagggcctgtgcaagtgcctgcctgccaacgtgcaccagctgatcagcggcaagattggcatcagcctgaccagggtgtctgatggagaaaatgtgctggtgtctgacttccgcagcaaggatgaggtggtggatgccctggtgtgcagctgcttcatccccttctacagcggcctcatcccccccagcttccggggcgtgcgctacgtggatggcggcgtgtctgacaacgtgcccttcattgatgccaagaccaccatcaccgtgagccccttctacggggagtatgacatctgccccaaggtgaagagcaccaacttcctgcacgtggacatcaccaagctgagcctgcggctgtgcaccggcaacctgtacctgctgagccgggcctttgtgcccccagacctgaaggtgctgggggagatctgcctgcggggctacctggatgccttccgcttcctggaggagaagggcatctgcaaccggccccagcccggcctgaagagcagcagcgagggcatggaccctgaggtggccatgcccagctgggccaacatgagcctggacagcagccctgagagcgctgccctggccgtgcggctggagggagatgagctgctggaccacctgcggctgagcatcctgccctgggatgagagcatcctggacaccctgagcccccggctggccacagccctgtctgaggagatgaaggacaagggcggctacatgagcaagatctgcaacctgctgcccatccgcatcatgtcctatgtgatgctgccctgcaccctgcctgtggagagcgccatcgccatcgtgcagaggctggtgacctggctgcctgacatgccagatgatgtgctgtggctgcagtgggtgaccagccaggtgttcaccagggtgctgatgtgcctgctgcctgccagccgcagccagatgcctgtgagcagccagcaggccagcccctgcaccccagagcaggactggccctgctggaccccctgcagccccaagggctgcccagctgagaccaaggccgaggccacccccaggagcatcctgcggagcagcctgaacttcttcctgggcaacaaggtgcctgctggagctgagggcctgagcaccttccccagcttcagcctggagaagagcctgtag

SEQ ID NO: 20687 - DNA, 4149 bp, Artificial Sequence
  Description of Artificial Sequence: Synthetic coding sequence
atgtacaagggcaagaagagacatgagatgccaccccacatctatgccatcacagacacagcctaccgctccatgatgcaggaccgggaggaccagagcatcctgtgcacaggagagagcggggccggcaagacagagaacaccaagaaggtgatccagtacctggcctacgtggccagcagccacaagagcaagaaggaccagggcgagctggagcggcagctgctgcaggccaaccccatcctggaggcctttggaaatgccaagacagtgaagaatgacaacagcagcagatttgggaagttcatccgcatcaactttgatgtgaatggctacatcgtgggcgccaacatcgagacctacctgctggagaagagccgggccatccggcaggccaaggaggagaggaccttccacatcttctactacctgctgagcggggccggggagcacctgaagacagacctgctgctggagccctacaacaagtaccgcttcctgagcaatggacatgtgaccatccctggccagcaggacaaggacatgttccaggagaccatggaggccatgaggatcatgggcatccctgaggaggagcagatgggcctgctgcgggtcatcagcggcgtgctgcagctgggcaacatcgtgttcaagaaggagaggaacacagaccaggcctccatgccagacaacacagctgcccagaaggtgagccacctgctgggcatcaacgtgacagacttcacccggggcatcctgaccccccgcatcaaggtgggccgggactatgtgcagaaggcccagaccaaggagcaggccgactttgccatcgaggccctggccaaggccacctatgaaagaatgttccgctggctggtgctgcgcatcaacaaggccctggacaagaccaagaggcagggcgccagcttcatcggcatcctggacattgctggctttgagatctttgacctgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgacctgattgagaagccagctggccccccaggcatcctggccctgctggatgaggagtgctggttccccaaggccacagacaagagctttgtggagaaggtgatgcaggagcagggcacccaccccaagttccagaagcccaagcagctgaaggacaaggctgacttctgcatcatccactacgccggcaaggtggactacaaggcagatgagtggctgatgaagaacatggaccccctgaatgacaacatcgccaccctgctgcaccagagcagtgacaagtttgtgtctgagctgtggaaggatgtggaccgcatcatcggcctggaccaggtggccggcatgtctgaaacagccctgcccggggccttcaagaccaggaagggcatgttcagaacagtgggccagctgtacaaggagcagctggccaagctgatggccaccctgaggaacaccaaccccaactttgtgcgctgcatcatccccaaccacgagaagaaggccggcaagctggacccccacctggtgctggaccagctgcgctgcaatggagtgctggagggcatccgcatctgccggcagggcttccccaacagagtggtgttccaggagttccggcagagatatgagatcctgacccccaacagcatccccaagggcttcatggatggcaagcaggcctgtgtgctgatgatcaaggccctggagctggacagcaacctgtaccgcatcggccagagcaaggtgttcttccgggccggcgtgctggcccacctggaggaggagcgggacctgaagatcacagatgtgatcatcggcttccaggcctgctgccggggctacctggccaggaaggcctttgccaagaggcagcagcagctgacagccatgaaggtgctgcagaggaactgtgccgcctacctgaagctgaggaactggcagtggtggaggctcttcaccaaggtgaagcccctgctgcaggtgtcccggcaggaggaggagatgatggccaaggaggaggagctggtgaaggtgcgggagaagcagctggccgcagaaaatcggctgacagagatggagaccctgcagagccagctgatggccgagaagctgcagctgcaggagcagctgcaggccgagacagagctgtgtgccgaggccgaggagctgcgggcccggctgacagccaagaagcaggagctggaggagatctgccacgacctggaggcccgggtggaggaggaggaggagcgctgccagcacctgcaggccgagaagaagaagatgcagcagaacatccaggagctggaggagcagctggaggaggaggagagcgcccggcagaagctgcagctggagaaggtgaccacagaggccaagctgaagaagctggaggaggagctggatgacctgctggtggacctggaccaccagaggcagagcgcctgcaacctggagaagaagcagaagaagtttgaccagctgctggccgaggagaagaccatcagcgccaagtatgcagaggagcgggacagagctgaggccgaggcccgggagaaggagaccaaggccctgagcctggcccgggccctggaggaggccatggagcagaaggccgagctggagcggctgaacaagcagttcagaacagagatggaggacctgatgagcagcaaggatgatgtgggcaagtctgtgcatgagctggagaagagcaagagggccctggagcagcaggtggaggagatgaagacccagctggaggagctggaggatgagctgcaggccacagaagatgccaagctgcggctggaggtgaacctgcaggccatgaaggcccagtttgagcgggacctgcagggcagagatgagcagagcgaggagaagaagaagcagctggtgcggcaggtgcgggagatggaggccgagctggaggatgagaggaagcagaggtccatggctgtggccgccaggaagaagctggagatggacctgaaggacctggaggcccacatcgacagcgccaacaagaacagagatgaggccatcaagcagctgaggaagctgcaggcccagatgaaggactgcatgagggagctggatgacacccgggccagccgggaggagatcctggcccaggccaaggaaaatgagaagaagctgaagtccatggaggccgagatgatccagctgcaggaggagctggccgctgctgagcgggccaagaggcaggcccagcaggagagagatgagctggctgatgagatcgccaacagcagcggcaagggggccctggccctggaggagaagaggcggctggaggccagaattgcccagctggaggaggagctggaggaggagcagggcaacacagagctgatcaatgaccggctgaagaaggccaacctgcagattgaccagatcaacacagacctgaacctggagaggagccacgcccagaagaatgaaaatgcccggcagcagctggagcggcagaacaaggagctgaaggtgaagctgcaggagatggagggcaccgtgaagagcaagtacaaggccagcatcacagccctggaggccaagatcgcccagctggaggagcagctggacaatgagaccaaggagcggcaggccgcctgcaagcaggtgcggaggacagagaagaagctgaaggatgtgctgctgcaggtggatgatgaaagaagaaatgctgagcagtacaaggaccaggccgacaaggccagcacccggctgaagcagctgaagaggcagctggaggaggccgaggaggaggcccagagggccaatgccagcaggaggaagctgcagcgggagctggaggatgccacagaaacagcagatgccatgaaccgggaggtgagcagcctgaagaacaagctgcggcggggggacctgccctttgtggtgcccaggaggatggccaggaaaggagctggagatggcagtgatgaggaggtggatggcaaggcagatggagctgaggccaagccagctgagtag

SEQ ID NO: 20688 - DNA, 1689 bp, Artificial Sequence
  Description of Artificial Sequence: Synthetic coding sequence
gccagcggcacccggcggcgctggccacccaccacctcctggaggcggccccggcggggctgcagccgctcctggaccacctgctggtggacctggaccaccagcgcccgggcccgggccacctggaggaggagccgccgcagcctgaccagctcctggaggagaagaagacccagcctgcccagcatgcagaggtctgccaccggcctgcggcggcggcctgagaggagaagaccccggctgtgccgctggccaggccctgaggaggccatggagcagaaggccgagctggagcggctgaacaagcagttcagaacagagatggaggacctgatgagcagcaaggatgatgtgggcaagtctgtgcatgagctggagaagagcaagagggccctggagcagcaggtggaggagatgaagacccagctggaggagctggaggatgagctgcaggccacagaagatgccaagctgcggctggaggtgaacctgcaggccatgaaggcccagtttgagcgggacctgcagggcagagatgagcagagcgaggagaagaagaagcagctggtgcggcaggtgcgggagatggaggccgagctggaggatgagaggaagcagaggtccatggctgtggccgccaggaagaagctggagatggacctgaaggacctggaggcccacatcgacagcgccaacaagaacagagatgaggccatcaagcagctgaggaagctgcaggcccagatgaaggactgcatgagggagctggatgacacccgggccagccgggaggagatcctggcccaggccaaggaaaatgagaagaagctgaagtccatggaggccgagatgatccagctgcaggaggagctggccgctgctgagcgggccaagaggcaggcccagcaggagagagatgagctggctgatgagatcgccaacagcagcggcaagggggccctggccctggaggagaagaggcggctggaggccagaattgcccagctggaggaggagctggaggaggagcagggcaacacagagctgatcaatgaccggctgaagaaggccaacctgcagattgaccagatcaacacagacctgaacctggagaggagccacgcccagaagaatgaaaatgcccggcagcagctggagcggcagaacaaggagctgaaggtgaagctgcaggagatggagggcaccgtgaagagcaagtacaaggccagcatcacagccctggaggccaagatcgcccagctggaggagcagctggacaatgagaccaaggagcggcaggccgcctgcaagcaggtgcggaggacagagaagaagctgaaggatgtgctgctgcaggtggatgatgaaagaagaaatgctgagcagtacaaggaccaggccgacaaggccagcacccggctgaagcagctgaagaggcagctggaggaggccgaggaggaggcccagagggccaatgccagcaggaggaagctgcagcgggagctggaggatgccacagaaacagcagatgccatgaaccgggaggtgagcagcctgaagaacaagctgcggcggggggacctgccctttgtggtgcccaggaggatggccaggaaaggagctggagatggcagtgatgaggaggtggatggcaaggcagatggagctgaggccaagccagctgagtag

SEQ ID NO: 20689 - DNA, 657 bp, Artificial Sequence
  Description of Artificial Sequence: Synthetic coding sequence
atggcccagcaggccgctgacaagtacctgtatgtggacaagaacttcatcaacaaccccctggcccaggccgactgggccgccaagaagctggtgtgggtgcccagcgacaagagcggctttgagcccgccagcctgaaggaggaggtgggggaggaggccatcgtggagctggtggagaatggcaagaaggtgaaggtgaacaaggatgacatccagaagatgaacccccccaagttcagcaaggtggaggacatggccgagctgacctgcctgaatgaggcctctgtgctgcacaacctgaaggagcgctactacagcggcctcatctacacctacagcggcctcttctgtgtggtgatcaacccctacaagaacctgcccatctacagcgaggagatcgtggagatgtacaagggcaagaagagacatgagatgccaccccacatctatgccatcacagacacagcctaccgctccatgatgcaggaccgggaggaccagagcatcctgtgcacaggagagagcggggccggcaagacagagaacaccaagaaggtgatccagtacctggcctacgtggccagcagccacaagagcaagaaggaccaggaggcctacttcaagaacagagctgtgcggctgggcgtgctgtag

SEQ ID NO: 20690 - DNA, 312 bp, Artificial Sequence
  Description of Artificial Sequence: Synthetic coding sequence
atggcccagcaggccgctgacaagtacctgtatgtggacaagaacttcatcaacaaccccctggcccaggccgactgggccgccaagaagctggtgtgggtgcccagcgacaagagcggctttgagcccgccagcctgaaggaggaggtgggggaggaggccatcgtggagctggtggagaatggcaagaaggtgaaggtgaacaaggatgacatccagaagatgaacccccccaagttcagcaaggtggaggacatggccgagctgacctgcctgaatgaggcctctgtgctgcacaacctgaaggagtag

SEQ ID NO: 20691 - DNA, 519 bp, Artificial Sequence
  Description of Artificial Sequence: Synthetic coding sequence
atgagcagcaagagggccaaggccaagaccaccaagaagaggccccagagggccaccagcaatgtgtttgccatgtttgaccagagccagatccaggagttcaaggaggccttcaacatgattgaccagaacagagatggcttcatcgacaaggaggacctgcatgacatgctggccagcctgggcaagaaccccacagatgagtacctggagggcatgatgtctgaggcccctggccccatcaacttcaccatgttcctgaccatgtttggagagaagctgaatggaacagatcctgaagatgtgatcagaaatgcctttgcctgctttgatgaggaggccagcggcttcatccacgaggaccacctgcgggagctgctgaccaccatgggagaccgcttcacagatgaggaggtggatgagatgtaccgggaggcccccatcgacaagaagggcaacttcaactacgtggagttcacccgcatcctgaagcatggagccaaggacaaggatgactag

SEQ ID NO: 20692 - DNA, 357 bp, Artificial Sequence
  Description of Artificial Sequence: Synthetic coding sequence
atgagcagcaagagggccaaggccaagaccaccaagaagaggccccagagggccaccagcaatgtgtttgccatgtttgaccagagccagatccaggagttcaaggaggccttcaacatgattgaccagaacagagatggcttcatcgacaaggaggacctgcatgacatgctggccagcctgggcttcatccacgaggaccacctgcgggagctgctgaccaccatgggagaccgcttcacagatgaggaggtggatgagatgtaccgggaggcccccatcgacaagaagggcaacttcaactacgtggagttcacccgcatcctgaagcatggagccaaggacaaggatgactag

SEQ ID NO: 20693 - DNA, 927 bp, Artificial Sequence
  Description of Artificial Sequence: Synthetic coding sequence
atgcaggagctgaccctgagccctggccctgccaagctgacccccaccctggaccccacccacaggatggagctgatcctgagcaccagccctgctgagctgaccctggaccctgcctgccagcccaagctgcccctggacagcacctgccagcctgagatgaccttcaaccctggccccacagagctgaccctggaccctgagcaccagcctgaggagaccccagcccccagcctggccgagctgaccctggagcctgtgcacagaagacctgagctgctggatgcctgtgccgacctgatcaatgaccagtggcccaggagcaggaccagccggctgcacagcctgggccagagcagtgatgccttccccctgtgcctgatgctgctgagcccccaccccaccctggaggccgcccctgtggtggtgggccacgcccggctgagccgggtgctgaaccagccccagagcctgctggtggagaccgtggtggtggcccgggccctgcggggccggggcttcggccggcggctgatggagggcctggaggtgtttgcccgggcccggggcttcaggaagctgcacctgaccacccatgaccaggtgcacttctacacccacctgggctaccagctgggggagcctgtgcagggcctggtgttcaccagccggcggctgcctgccaccctgctgaatgccttccccacagcccccagcccccggccccccaggaaggcccccaacctgacagcccaggccgccccccggggccccaagggcccccccctgcccccacctccacccctgcctgaatgtctgaccatcagcccccctgtgcccagcggcccccccagcaagagcctgctggagacccagtaccagaatgtgcggggccggcccatcttctggatggagaaggacatctag

SEQ ID NO: 20694 - DNA, 861 bp, Artificial Sequence
  Description of Artificial Sequence: Synthetic coding sequence
atggagctgatcctgagcaccagccctgctgagctgaccctggaccctgcctgccagcccaagctgcccctggacagcacctgccagcctgagatgaccttcaaccctggccccacagagctgaccctggaccctgagcaccagcctgaggagaccccagcccccagcctggccgagctgaccctggagcctgtgcacagaagacctgagctgctggatgcctgtgccgacctgatcaatgaccagtggcccaggagcaggaccagccggctgcacagcctgggccagagcagtgatgccttccccctgtgcctgatgctgctgagcccccaccccaccctggaggccgcccctgtggtggtgggccacgcccggctgagccgggtgctgaaccagccccagagcctgctggtggagaccgtggtggtggcccgggccctgcggggccggggcttcggccggcggctgatggagggcctggaggtgtttgcccgggcccggggcttcaggaagctgcacctgaccacccatgaccaggtgcacttctacacccacctgggctaccagctgggggagcctgtgcagggcctggtgttcaccagccggcggctgcctgccaccctgctgaatgccttccccacagcccccagcccccggccccccaggaaggcccccaacctgacagcccaggccgccccccggggccccaagggcccccccctgcccccacctccacccctgcctgaatgtctgaccatcagcccccctgtgcccagcggcccccccagcaagagcctgctggagacccagtaccagaatgtgcggggccggcccatcttctggatggagaaggacatctag

SEQ ID NO: 20695 - DNA, 174 bp, Artificial Sequence
  Description of Artificial Sequence: Synthetic coding sequence
atggagctgatcctgagcaccagccctgctgagctgaccctggaccctgcctgccagcccaagctgcccctggacagcacctgccagcctgagatgaccttcaaccctggccccacagagctgaccctggaccctgagcaccagcctgaggagaccccagcccccagcctgtag

SEQ ID NO: 20696 - DNA, 861 bp, Artificial Sequence; identical to SEQ ID NO: 20694
  Description of Artificial Sequence: Synthetic coding sequence

SEQ ID NO: 20697 - DNA, 861 bp, Artificial Sequence; identical to SEQ ID NO: 20694
  Description of Artificial Sequence: Synthetic coding sequence

SEQ ID NO: 20698 - DNA, 261 bp, Artificial Sequence
  Description of Artificial Sequence: Synthetic coding sequence
atggagctgatcctgagcaccagccctgctgagctgaccctggaccctgcctgccagcccaagctgcccctggacagcacctgccagcctgagatgaccttcaaccctggccccacagagctgaccctggaccctgagcaccagcctgaggagaccccagcccccagcctggccgagctgaccctggagcctgtgcacagaagacctgagctgctggatgcctgtgccgacctgatcaatgaccagtggcccaggagctag

SEQ ID NO: 20699 - DNA, 30 bp, Artificial Sequence; identical to SEQ ID NO: 11723
  Description of Artificial Sequence: Synthetic coding sequence

SEQ ID NO: 20700 - DNA, 987 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaactttgagcggggcggggacatcaccctgcgctgccctgtgatgctggtggtgggggaccaggcccctcatgaagatgctgtggtggagtgcaacagcaagctggaccccacccagaccagcttcctgaagatggctgacagcggcggccagccccagctgacccagcccgggaagctgacagaggccttcaagtacttcctgcagggcatgggctacatggccagcagctgcatgacccggctgagccgcagcaggacagccagcctgaccagcgctgcctctgtggatggcaacagaagccgcagcaggaccctgagccagagcagcgagagcggcaccctgagcagcggccccccaggccacaccatggaggtgtcctgctag

SEQ ID NO: 20701 - DNA, 1116 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaactttgagcggggcggggacatcaccctgcgctgccctgtgatgctggtggtgggggaccaggcccctcatgaagatgctgtggtggagtgcaacagcaagctggaccccacccagaccagcttcctgaagatggctgacagcggcggccagccccagctgacccagcccgggaagctgacagaggccttcaagtacttcctgcagggcatgggctacatggccagcagctgcatgacccggctgagccgcagcaggacagccagcctgaccagcgctgcctctgtggatggcaacagaagccgcagcaggaccctgagccagagcagcgagagcggcaccctgagcagcggccccccaggccacaccatggaggtgtcctgctag

SEQ ID NO: 20702 - DNA, 1074 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaactttgagcggggcggggacatcaccctgcgctgccctgtgatgctggtggtgggggaccaggcccctcatgaagatgctgtggtggagtgcaacagcaagctggaccccacccagaccagcttcctgaagatggctgacagcggcggccagccccagctgacccagcccgggaagctgacagaggccttcaagtacttcctgcagggcatgggctacatggccagcagctgcatgacccggctgagccgcagcaggacagccagcctgaccagcgctgcctctgtggatggcaacagaagccgcagcaggaccctgagccagagcagcgagagcggcaccctgagcagcggccccccaggccacaccatggaggtgtcctgctag

SEQ ID NO: 20703 - DNA, 1074 bp, Artificial Sequence; identical to SEQ ID NO: 20702
  Description of Artificial Sequence: Synthetic coding sequence

SEQ ID NO: 20704 - DNA, 1026 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaactttgagcggggcggggacatcaccctgcgctgccctgtgatgctggtggtgggggaccaggcccctcatgaagatgctgtgatggctgacagcggcggccagccccagctgacccagcccgggaagctgacagaggccttcaagtacttcctgcagggcatgggctacatggccagcagctgcatgacccggctgagccgcagcaggacagccagcctgaccagcgctgcctctgtggatggcaacagaagccgcagcaggaccctgagccagagcagcgagagcggcaccctgagcagcggccccccaggccacaccatggaggtgtcctgctag

SEQ ID NO: 20705 - DNA, 1083 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaactttgagcggggcggggacatcaccctgcgctgccctgtgatgctggtggtggagtgcaacagcaagctggaccccacccagaccagcttcctgaagatggctgacagcggcggccagccccagctgacccagcccgggaagctgacagaggccttcaagtacttcctgcagggcatgggctacatggccagcagctgcatgacccggctgagccgcagcaggacagccagcctgaccagcgctgcctctgtggatggcaacagaagccgcagcaggaccctgagccagagcagcgagagcggcaccctgagcagcggccccccaggccacaccatggaggtgtcctgctag

SEQ ID NO: 20706 - DNA, 1116 bp, Artificial Sequence; identical to SEQ ID NO: 20701
  Description of Artificial Sequence: Synthetic coding sequence

SEQ ID NO: 20707 - DNA, 1116 bp, Artificial Sequence; identical to SEQ ID NO: 20701
  Description of Artificial Sequence: Synthetic coding sequence

SEQ ID NO: 20708 - DNA, 987 bp, Artificial Sequence; identical to SEQ ID NO: 20700
  Description of Artificial Sequence: Synthetic coding sequence

SEQ ID NO: 20709 - DNA, 1026 bp, Artificial Sequence; identical to SEQ ID NO: 20704
  Description of Artificial Sequence: Synthetic coding sequence

SEQ ID NO: 20710 - DNA, 1116 bp, Artificial Sequence; identical to SEQ ID NO: 20701
  Description of Artificial Sequence: Synthetic coding sequence

SEQ ID NO: 20711 - DNA, 1104 bp, Artificial Sequence
  Description of Artificial Sequence: Synthetic coding sequence
atggagaatggaggctccatgcaggccaccatggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaactttgagcggggcggggacatcaccctgcgctgccctgtgatgctggtggtgggggaccaggcccctcatgaagatgctgtggtggagtgcaacagcaagctggaccccacccagaccagcttcctgaagatggctgacagcggcggccagccccagctgacccagcccgggaagctgacagaggccttcaagtacttcctgcagggcatgggctacatggccagcagctgcatgacccggctgagccgcagcaggacagccagcctgaccagcgctgcctctgtggatggcaacagaagccgcagcaggaccctgagccagagcagcgagagcggcaccctgagcagcggccccccaggccacaccatggaggtgtcctgctag

SEQ ID NO: 20712 - DNA, 504 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactggtag

SEQ ID NO: 20713 - DNA, 1074 bp, Artificial Sequence; identical to SEQ ID NO: 20702
  Description of Artificial Sequence: Synthetic coding sequence

SEQ ID NO: 20714 - DNA, 522 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgacccctag

SEQ ID NO: 20715 - DNA, 759 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaacagctacaacaacagaagagacctgaactttgagcggggcggggacatcacctag

SEQ ID NO: 20716 - DNA, 525 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgactggatag

SEQ ID NO: 20717 - DNA, 1074 bp, Artificial Sequence; identical to SEQ ID NO: 20702
  Description of Artificial Sequence: Synthetic coding sequence

SEQ ID NO: 20718 - DNA, 450 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctag

SEQ ID NO: 20719 - DNA, 261 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaatag

SEQ ID NO: 20720 - DNA, 390 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctag

SEQ ID NO: 20721 - DNA, 447 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgccggctag

SEQ ID NO: 20722 - DNA, 405 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgccggctag

SEQ ID NO: 20723 - DNA, 327 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggactag

SEQ ID NO: 20724 - DNA, 363 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtactag

SEQ ID NO: 20725 - DNA, 300 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcactag

SEQ ID NO: 20726 - DNA, 279 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggagtag

SEQ ID NO: 20727 - DNA, 462 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgtag

SEQ ID NO: 20728 - DNA, 1074 bp, Artificial Sequence; identical to SEQ ID NO: 20702
  Description of Artificial Sequence: Synthetic coding sequence

SEQ ID NO: 20729 - DNA, 585 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatcccctag

SEQ ID NO: 20730 - DNA, 387 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggatag

SEQ ID NO: 20731 - DNA, 660 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaattag

SEQ ID NO: 20732 - DNA, 666 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaactag

SEQ ID NO: 20733 - DNA, 1116 bp, Artificial Sequence; identical to SEQ ID NO: 20701
  Description of Artificial Sequence: Synthetic coding sequence

SEQ ID NO: 20734 - DNA, 432 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgtag

SEQ ID NO: 20735 - DNA, 483 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaactag

SEQ ID NO: 20736 - DNA, 426 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcatctag

SEQ ID NO: 20737 - DNA, 357 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtactag

SEQ ID NO: 20738 - DNA, 423 bp, Artificial Sequence
  Description of Artificial Sequence: Synthetic coding sequence
atggccgagctgcaggaggtgcagatcacagaggagaagcccctgctgcccggccagaccccagaggccgccaaggaggccgagctggccgcccgcatcctgctggaccagggccagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatctag

SEQ ID NO: 20739 - DNA, 435 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaactag

SEQ ID NO: 20740 - DNA, 462 bp, Artificial Sequence; identical to SEQ ID NO: 20727
  Description of Artificial Sequence: Synthetic coding sequence

SEQ ID NO: 20741 - DNA, 675 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagggcctggtgctgatcaacatcgaccccaatgccaagggctggatggactgggccgcccacaagctgaccggcctgaccagcagcatccctgagatgatcctgggccacctgttcagccaggaggagctgagcggcaacagcgagctgatccagaagtacagaaacatcatcacccacgcccccaacctggacaacatcgagctgtactggaacagctacaactag

SEQ ID NO: 20742 - DNA, 453 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtggagtag

SEQ ID NO: 20743 - DNA, 384 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcatctag

SEQ ID NO: 20744 - DNA, 450 bp, Artificial Sequence
  Description of Artificial Sequence: Synthetic coding sequence
atggccgagctgcaggaggtgcagatcacagaggagaagcccctgctgcccggccagaccccagaggccgccaagacccacagcgtggagaccccctacggctctgtgaccttcaccgtgtatggcacccccaagcccaagaggcctgccatcctgacctaccatgatgtgggcctgaactacaagagctgcttccagcccctcttccagtttgaggacatgcaggagatcatccagaactttgtgcgggtgcacgtggatgcccctggcatggaggagggcgcccctgtgttccccctgggctaccagtaccccagcctggaccagctggccgacatgatcccctgtgtgctgcagtacctgaacttcagcaccatcattggagtgggcgtgggcgctggggcctacatcctggcccgctatgccctgaaccacccagacacagtgtag

SEQ ID NO: 20745 - DNA, 1128 bp, Artificial Sequence
  Description of Artificial Sequence: Synthetic coding sequence
atggatgagctgcaggatgtgcagctgacagagatcaagcccctgctgaatgacaagaatggcaccaggaacttccaggactttgactgccaggagcatgacatcgagaccacccatggagtggtgcacgtgaccatccggggcctgcccaagggcaacagacctgtgatcctgacctaccatgacatcggcctgaaccacaagagctgcttcaatgccttcttcaactttgaggacatgcaggagatcacccagcactttgctgtgtgccacgtggatgcccctggccagcaggagggcgcccccagcttccccaccggctaccagtaccccaccatggatgagctggccgagatgctgccccctgtgctgacccacctgagcctgaagagcatcattggaattggagtgggcgctggggcctacatcctgagcagatttgccctgaaccaccctgagctggtggagggcctggtgctgatcaacgtggacccctgtgccaagggctggattgactgggccgccagcaagctgagcggcctgaccaccaacgtggtggacatcatcctggcccaccacttcggccaggaggagctgcaggccaacctggacctgatccagacctacaggatgcacatcgcccaggacatcaaccaggacaacctgcagctgttcctgaacagctacaacggccggcgggacctggagattgagcggcccatcctgggccagaatgacaacaagagcaagaccctgaagtgcagcaccctgctggtggtgggggacaacagccctgctgtggaggccgtggtggagtgcaacagccggctgaaccccatcaacaccaccctgctgaagatggctgactgtggcggcctgccccaggtggtgcagcccgggaagctgacagaggccttcaagtacttcctgcagggcatgggctacatccccagcgcctccatgacccggctggcccggagcaggacccacagcaccagcagcagcctgggcagcggggagagccccttcagccgctctgtgaccagcaaccagagtgatggcacccaggagagctgtgagagcccagatgtgctggacagacaccagaccatggaggtgtcctgctag

SEQ ID NO: 20746 - DNA, 1092 bp, Artificial Sequence
  Description of Artificial Sequence: Synthetic coding sequence
atggatgagctgcaggatgtgcagctgacagagatcaagcccctgctgaatgacaaggagcatgacatcgagaccacccatggagtggtgcacgtgaccatccggggcctgcccaagggcaacagacctgtgatcctgacctaccatgacatcggcctgaaccacaagagctgcttcaatgccttcttcaactttgaggacatgcaggagatcacccagcactttgctgtgtgccacgtggatgcccctggccagcaggagggcgcccccagcttccccaccggctaccagtaccccaccatggatgagctggccgagatgctgccccctgtgctgacccacctgagcctgaagagcatcattggaattggagtgggcgctggggcctacatcctgagcagatttgccctgaaccaccctgagctggtggagggcctggtgctgatcaacgtggacccctgtgccaagggctggattgactgggccgccagcaagctgagcggcctgaccaccaacgtggtggacatcatcctggcccaccacttcggccaggaggagctgcaggccaacctggacctgatccagacctacaggatgcacatcgcccaggacatcaaccaggacaacctgcagctgttcctgaacagctacaacggccggcgggacctggagattgagcggcccatcctgggccagaatgacaacaagagcaagaccctgaagtgcagcaccctgctggtggtgggggacaacagccctgctgtggaggccgtggtggagtgcaacagccggctgaaccccatcaacaccaccctgctgaagatggctgactgtggcggcctgccccaggtggtgcagcccgggaagctgacagaggccttcaagtacttcctgcagggcatgggctacatccccagcgcctccatgacccggctggcccggagcaggacccacagcaccagcagcagcctgggcagcggggagagccccttcagccgctctgtgaccagcaaccagagtgatggcacccaggagagctgtgagagcccagatgtgctggacagacaccagaccatggaggtgtcctgctag

SEQ ID NO: 20747 - DNA, 843 bp, Artificial Sequence
  Description of Artificial Sequence: Synthetic coding sequence
atggtgcaggagaccagcaggaccctgactgtgcgctaccagtaccccaccatggatgagctggccgagatgctgccccctgtgctgacccacctgagcctgaagagcatcatcggcatcggcgtgggcgctggggcctacatcctgagcagatttgccctgaaccaccctgagctggtggagggcctggtgctgatcaacgtggacccctgtgccaagggctggattgactgggccgccagcaagctgagcggcctgaccaccaacgtggtggacatcatcctggcccaccacttcggccaggaggagctgcaggccaacctggacctgatccagacctacaggatgcacatcgcccaggacatcaaccaggacaacctgcagctgttcctgaacagctacaatggaagaagagacctggagattgaaagacccatcctgggccagaatgacaacaagagcaagaccctgaagtgcagcaccctgctggtggtgggggacaacagccctgctgtggaggccgtggtggagtgcaacagccggctgaaccccatcaacaccaccctgctgaagatggctgactgtggcggcctgccccaggtggtgcagcccgggaagctgacagaggccttcaagtacttcctgcagggcatgggctacatccccagcgcctccatgacccggctggcccggagcaggacccacagcaccagcagcagcctgggcagcggggagagccccttcagccgctctgtgaccagcaaccagagtgatggcacccaggagagctgtgagagcccagatgtgctggacagacaccagaccatggaggtgtcctgctag

SEQ ID NO: 20748 - DNA, 816 bp, Artificial Sequence
  Description of Artificial Sequence: Synthetic coding sequence
atgatccgctaccagtaccccaccatggatgagctggccgagatgctgccccctgtgctgacccacctgagcctgaagagcatcattggaattggagtgggcgctggggcctacatcctgagcagatttgccctgaaccaccctgagctggtggagggcctggtgctgatcaacgtggacccctgtgccaagggctggattgactgggccgccagcaagctgagcggcctgaccaccaacgtggtggacatcatcctggcccaccacttcggccaggaggagctgcaggccaacctggacctgatccagacctacaggatgcacatcgcccaggacatcaaccaggacaacctgcagctgttcctgaacagctacaacggccggcgggacctggagattgagcggcccatcctgggccagaatgacaacaagagcaagaccctgaagtgcagcaccctgctggtggtgggggacaacagccctgctgtggaggccgtggtggagtgcaacagccggctgaaccccatcaacaccaccctgctgaagatggctgactgtggcggcctgccccaggtggtgcagcccgggaagctgacagaggccttcaagtacttcctgcagggcatgggctacatccccagcgcctccatgacccggctggcccggagcaggacccacagcaccagcagcagcctgggcagcggggagagccccttcagccgctctgtgaccagcaaccagagtgatggcacccaggagagctgtgagagcccagatgtgctggacagacaccagaccatggaggtgtcctgctag

SEQ ID NO: 20749 - DNA, 420 bp, Artificial Sequence
  Description of Artificial Sequence: Synthetic coding sequence
atgcctgagggccctgagctgcacctggccagccagtttgtgaatgaggcctgccgggccctggtgtttggaggctgtgtggagaagagctctgtgtccaggaaccctgaggtgccctttgagagcagcgcctaccgcatcagcgccagcgcccggggcaaggagctgcggctcatcctgagccccctgcccggggcccagccccagcaggagccccgggcccccaggggggccgccaccccctgccccccagccctgctgcacggccctgcctggcccccagcccggcccatgttccggggccacccccctgtgcggcccctgggcccctggggcaaggtggccgccggcccccgggccctgtgcctggccggcgtgcctgctgtgcagggagaatgtgccaccaagcccagcggctag

SEQ ID NO: 20750 - DNA, 1173 bp, Artificial Sequence
  Description of Artificial Sequence: Synthetic coding sequence
atgcctgagggccctgagctgcacctggccagccagtttgtgaatgaggcctgccgggccctggtgtttggaggctgtgtggagaagagctctgtgtccaggaaccctgaggtgccctttgagagcagcgcctaccgcatcagcgccagcgcccggggcaaggagctgcggctcatcctgagccccctgcccggggcccagccccagcaggagcccctggccctggtgttccgcttcggcatgagcggcagcttccagctggtgccccgggaggagctgcccaggcatgcccacctgcgcttctacacagcccctcctggcccccggctggccctgtgctttgtggacatccgccgcttcggccgctgggacctgggcggcaagtggcagcccggccggggcccctgtgtgctgcaggagtaccagcagttccgggagaatgtgctgaggaacctggccgacaaggcctttgaccggcccatctgtgaggccctgctggaccagcgcttcttcaacggcatcggcaactacctgcgggcagagatcctgtaccgcctgaagatccccccatttgagaaggcccggtctgtgctggaggccctgcagcagcaccggcccagccctgagctgaccctgagccagaagatccgcaccaagctgcagaacccagacctgctggagctgtgccacagcgtgcccaaggaggtggtgcagctgggcggcaagggctacggcagcgagagcggggaggaggactttgctgccttccgggcctggctgcgctgctacggcatgcctggcatgagcagcctgcaggacagacatggccgcaccatctggttccagggcgaccccggccccctggcccccaagggcaggaagagcaggaagaagaagagcaaggccacccagctgagccctgaggacagagtggaggatgccctgccccccagcaaggcccccagcaggacccggcgggccaagagggacctgcccaagaggacagccacccagaggcctgagggcaccagcctgcagcaggaccctgaggcccccaccgtgcccaagaagggccgcaggaagggccggcaggccgccagcggccactgccggcccaggaaggtgaaggctgacatccccagcctggagcctgagggcaccagcgccagctag

SEQ ID NO: 20751 - DNA, 1173 bp, Artificial Sequence; identical to SEQ ID NO: 20750
  Description of Artificial Sequence: Synthetic coding sequence

SEQ ID NO: 20752 - DNA, 999 bp, Artificial Sequence
  Description of Artificial Sequence: Synthetic coding sequence
atgcctgagggccccctggtgaggaagttccaccacctggtgagcccctttgtgggccagcaggtggtgaagacaggaggcagcagcaagaagctgcagcctgccagcctgcagagcctgtggctgcaggacacccaggtgcacggcaagaagctgttcctgcgctttgacctggatgaggagatgggccccccaggcagcagccccaccccagagcccccccagaaggaggtgcagaaggagggcgctgctgaccccaagcaggtgggggagcccagcggccagaagaccctggatggcagcagccgctctgctgagctggtgccccagggagaagatgattctgagtacctggagagagatgccccagctggagatgctggccgctggctgcgggtgtcctttggcctgtttggatctgtgtgggtgaatgacttcagccgggccaagaaggccaacaagagaggagactggagggaccccagcccccggctggtgctgcactttggaggcggcggcttcctggccttctacaactgccagctgtcctggagcagcagccctgtggtgacccccacctgtgacatcctgtctgagaagttccaccggggccaggccctggaggccctgggccaggcccagcctgtgtgctacaccctgctggaccagcgctacttcagcggcctgggcaacatcatcaagaatgaggccctgtacagagctggcatccaccccctgagcctgggctctgtgctgagcgccagccggcgggaggtgctggtggaccacgtggtggagttcagcacagcctggctgcagggcaagttccagggccggccccagcacacccaggtgtaccagaaggagcagtgcccagctggccaccaggtgatgaaggaggccttcggcccagaagatggcctgcagaggctgacctggtggtgcccccagtgccagccccagctgtctgaggagcctgagcagtgccagttctcctag

SEQ ID NO: 20753 - DNA, 954 bp, Artificial Sequence
  Description of Artificial Sequence: Synthetic coding sequence
atgcctgagggccccctggtgaggaagttccaccacctggtgagcccctttgtgggccagcaggtggtgaagacaggaggcagcagcaagaagctgcagcctgccagcctgcagagcctgtggctgcaggacacccaggtgcacggcaagaagctgttcctgcgctttgacctggatgaggagatgggccccccaggcagcagccccaccccagagcccccccagaaggaggtgcagaagaagaccctggatggcagcagccgctctgctgagctggtgccccagggagaagatgacagcgagtacctggagagagatgccccagctggagatgctggccgctggctgcgggtgtcctttggcctgtttggatctgtgtgggtgaatgacttcagccgggccaagaaggccaacaagagaggagactggagggaccccagcccccggctggtgctgcactttggaggcggcggcttcctggccttctacaactgccagctgtcctggagcagcagccctgtggtgacccccacctgtgacatcctgtctgagaagttccaccggggccaggccctggaggccctgggccaggcccagcctgtgtgctacaccctgctggaccagcgctacttcagcggcctgggcaacatcatcaagaatgaggccctgtaccgggccggcatccaccccctgagcctgggctctgtgctgagcgccagcagaagagaggtgctggtggaccacgtggtggagttcagcacagcctggctgcagggcaagttccagggccggccccagcacacccaggtgtaccagaaggagcagtgcccagctggccaccaggtgatgaaggaggcctttggaccagaagatggcctgcagaggctgacctggtggtgcccccagtgccagccccagctgtctgaggagcctgagcagtgccagttctcctag

SEQ ID NO: 20754 - DNA, 816 bp, Artificial Sequence
  Description of Artificial Sequence: Synthetic coding sequence
atgggccccccaggcagcagccccaccccagagcccccccagaaggaggtgcagaaggagggcgctgctgaccccaagcaggtgggggagcccagcggccagaagaccctggatggcagcagccgctctgctgagctggtgccccagggagaagatgacagcgagtacctggagagagatgccccagctggagatgctggccgctggctgcgggtgtcctttggcctgtttggatctgtgtgggtgaatgacttcagccgggccaagaaggccaacaagagaggagactggagggaccccagcccccggctggtgctgcactttggaggcggcggcttcctggccttctacaactgccagctgtcctggagcagcagccctgtggtgacccccacctgtgacatcctgtctgagaagttccaccggggccaggccctggaggccctgggccaggcccagcctgtgtgctacaccctgctggaccagcgctacttcagcggcctgggcaacatcatcaagaatgaggccctgtaccgggccggcatccaccccctgagcctgggctctgtgctgagcgccagcagaagagaggtgctggtggaccacgtggtggagttcagcacagcctggctgcagggcaagttccagggccggccccagcacacccaggtgtaccagaaggagcagtgcccagctggccaccaggtgatgaaggaggcctttggaccagaagatggcctgcagaggctgacctggtggtgcccccagtgccagccccagctgtctgaggagcctgagcagtgccagttctcctag

SEQ ID NO: 20755 - DNA, 999 bp, Artificial Sequence; identical to SEQ ID NO: 20752
  Description of Artificial Sequence: Synthetic coding sequence

SEQ ID NO: 20756 - DNA, 999 bp, Artificial Sequence; identical to SEQ ID NO: 20752
  Description of Artificial Sequence: Synthetic coding sequence

SEQ ID NO: 20757 - DNA, 651 bp, Artificial Sequence
  Description of Artificial Sequence: Synthetic coding sequence
atgcctgagggccccctggtgaggaagttccaccacctggtgagcccctttgtgggccagcaggtggtgaagacaggaggcagcagcaagaagctgcagcctgccagcctgcagagcctgtggctgcaggacacccaggtgcggctggtgctgcactttggaggcggcggcttcctggccttctacaactgccagctgtcctggagcagcagccctgtggtgacccccacctgtgacatcctgtctgagaagttccaccggggccaggccctggaggccctgggccaggcccagcctgtgtgctacaccctgctggaccagcgctacttcagcggcctgggcaacatcatcaagaatgaggccctgtacagagctggcatccaccccctgagcctgggctctgtgctgagcgccagccggcgggaggtgctggtggaccacgtggtggagttcagcacagcctggctgcagggcaagttccagggccggccccagcacacccaggtgtaccagaaggagcagtgcccagctggccaccaggtgatgaaggaggccttcggcccagaagatggcctgcagaggctgacctggtggtgcccccagtgccagccccagctgtctgaggagcctgagcagtgccagttctcctag

SEQ ID NO: 20758 - DNA, 1818 bp, Artificial Sequence
  Description of Artificial Sequence: Synthetic coding sequence
atggtggagggccctggctgcaccctgaatggagagaagatccgggcccgggtgctgcccggccaggccgtgactggagtgcggggcagcgccctgcggagcctgcagggccgggccctgcggctggccgccagcacagtggtggtgagcccccaggccgccgccctgaacaatgacagcagccagaatgtgctgagcctcttcaacggctacgtgtacagcggcgtggagaccctgggcaaggagctgttcatgtacttcggccccaaggccctgcgcatccacttcggcatgaagggcttcatcatgatcaaccccctggagtacaagtacaagaatggagccagccctgtgctggaggtgcagctgaccaaggacctgatctgcttctttgacagctctgtggagctgaggaacagcatggagagccagcagaggatccgcatgatgaaggagctggatgtgtgcagccctgagttctccttcctgcgggcagagagcgaggtgaagaagcagaagggccgcatgctgggagatgtgctgatggaccagaatgtgctgcccggggtgggcaacatcatcaagaatgaggccctgtttgacagcggcctgcaccctgctgtgaaggtgtgccagctgacagatgagcagatccaccacctgatgaagatgatccgggacttcagcatcctcttctaccgctgcaggaaggccggcctggccctgagcaagcactacaaggtgtacaagaggcccaactgtggccagtgccactgccgcatcaccgtgtgccgctttggagacaacaacaggatgacctacttctgcccccactgccagaaggagaacccccagcacgtggacatctgcaagctgcccaccaggaacaccatcatctcctggaccagcagccgggtggaccacgtgatggacagcgtggccaggaagtctgaggagcactggacctgtgtggtgtgcaccctcatcaacaagcccagcagcaaggcctgtgatgcctgcctgaccagccggcccatcgacagcgtgctgaagtctgaggagaacagcacagtgttcagccacctgatgaagtacccctgcaacaccttcggcaagccccacacagaggtgaagatcaacaggaagacagccttcggcaccaccaccctggtgctgacagacttcagcaacaagagcagcaccctggagaggaagaccaagcagaaccagatcctggatgaggagttccagaacagccccccagcctctgtgtgcctgaatgacatccagcaccccagcaagaagaccaccaatgacatcacccagcccagcagcaaggtgaacatcagccccaccatcagcagcgagagcaagctgttcagccctgcccacaagaagcccaagacagcccagtacagcagccctgagctgaagagctgcaaccctggctacagcaacagcgagctgcagatcaacatgacagatggccccaggaccctgaacccagacagcccccgctgcagcaagcacaaccggctgtgcatcctgcgggtggtgggcaaggatggagagaacaagggccggcagttctacgcctgccccctgccccgggaggcccagtgtggcttctttgagtgggccgacctgtccttccccttctgcaaccacggcaagaggagcaccatgaagacagtgctgaagattggccccaacaacgggaagaacttctttgtgtgccccctgggcaaggagaagcagtgcaacttcttccagtgggccgagaatggacctggcatcaagatcatccctggctgctag

SEQ ID NO: 20759 - DNA, 1743 bp, Artificial Sequence
  Description of Artificial Sequence: Synthetic coding sequence
atgcctggctggccctggggcctgctgctgacagctggcaccctgtttgctgccctgagccctggccccccagccccagctgacccctgccatgatgagggcggggccccccggggctgtgtgcccggcctggtgaatgctgccctgggccgggaggtgctggccagcagcacctgtggccggcctgccacccgggcctgtgatgccagtgacccccggcgggcccacagccctgccctgctgaccagccctgggggcacagccagccccctgtgctggaggtctgagagcctgccccgggcccccctgaatgtgaccctgactgtgcccctgggcaaggcctttgagctggtgtttgtgtccctgcgcttctgcagcgcccccccagcctctgtggccctgctgaagagccaggaccacggccgctcctgggcccccctgggcttcttcagcagccactgtgacctggactatggccgcctgcctgccccagccaacggccctgctggccctggccctgaggccctgtgcttccctgcccccctggcccagccagatggcagcggcctgctggccttctccatgcaggacagcagccccccaggcctggacctggacagcagccctgtgctgcaggactgggtgacagccacagatgtgcgggtggtgctgacccggcccagcacagctggggacccccgggacatggaggccgtggtgccctacagctatgctgccacagacctgcaggtgggcggccgctgcaagtgcaatggccacgccagccgctgcctgctggacacccagggccacctgatctgtgactgccgccacggcacagagggccctgactgtggccgctgcaagcccttctactgtgaccggccctggcagagggccacagcccgggagagccacgcctgcctggcctgcagctgcaatggccacgcccggcgctgccgcttcaacatggagctgtaccgcctgagcggccgccgcagcggcggcgtgtgcctgaactgccgccacaacacagctggccgccactgccactactgccgggagggcttctacagagatcctggccgggccctgagtgaccggcgggcctgccgggcctgtgactgccaccctgtgggcgccgccggcaagacctgcaaccagaccaccggccagtgcccctgcaaggatggagtgacaggcctgacctgcaacagatgtgcccctggcttccagcagagccgcagccctgtggccccctgtgtgaagacccccatccctggccccacagaggacagcagccctgtgcagccccaggactgtgacagccactgcaagccagcccggggcagctaccgcatcagcctgaagaagttctgcaagaaggactatgctgtgcaggtggccgtgggcgcccggggggaggcccggggggcctggacccgcttccctgtggccgtgctggccgtgttccgctctggagaggagcgggcccggcggggcagcagcgccctgtgggtgcctgctggagatgctgcctgtggctgcccccggctgctgcctggaagacgctacctgctgctgggcggcggccctggagctgctgctgggggcgccggcggccggggccctggcctgattgctgcccggggcagcctggtgctgccctggagagatgcctggacccggcggctgcggcggctgcagaggcgggagcggcggggccgctgcagcgctgcctag

SEQ ID NO: 20760 - DNA, 2547 bp, Artificial Sequence
  Description of Artificial Sequence: Synthetic coding sequence
ctcttctgctttgtgttttctgtgtccctgcaggtggacatcgtgcccagccagggcgagatctctgtgggggagagcaagttcttcctgtgccaggtggccggagatgccaaggacaaggacatctcctggttcagccccaacggggagaagctgacccccaaccagcagaggatctctgtggtgtggaatgatgacagcagcagcaccctgaccatctacaatgccaacattgatgatgctggcatctacaagtgtgtggtgactggagaagatggcagcgagagcgaggccaccgtgaatgtgaagatcttccagaagctgatgttcaagaatgcccccaccccccaggagttccgggagggagaagatgctgtgattgtgtgtgatgtggtgagcagcctgccccccaccatcatctggaagcacaagggcagagatgtgatcctgaagaaggatgtgcgcttcatcgtgctgagcaacaactacctgcagatccggggcatcaagaagacagatgagggcacctaccgctgtgagggccgcatcctggcccggggggagatcaacttcaaggacatccaggtgattgtgaatgtgccccccaccatccaggcccggcagaacatcgtgaatgccacagccaacctgggccagagcgtgaccctggtgtgtgatgctgagggcttccctgagcccaccatgtcctggaccaaggatggagagcagatcgagcaggaggaggatgatgagaagtacatcttcagtgatgacagcagccagctgaccatcaagaaggtggacaagaatgatgaagctgagtacatctgcatcgccgagaacaaggccggggagcaggatgccaccatccacctgaaggtgtttgccaagcccaagatcacctacgtggagaaccagacagccatggagctggaggagcaggtgaccctgacctgtgaggccagcggggaccccatccccagcatcacctggaggaccagcaccaggaacatcagcagcgaggagaaggcctcctggaccaggcctgagaagcaggagaccctggatggccacatggtggtgcgcagccacgcccgggtgagcagcctgaccctgaagagcatccagtacacagatgctggggagtacatctgcacagccagcaacaccatcggccaggacagccagagcatgtacctggaggtgcagtatgcccccaagctgcagggccctgtggccgtgtacacctgggagggcaaccaggtgaacatcacctgtgaggtgtttgcctaccccagcgccaccatctcctggttcagagatggccagctgctgcccagcagcaactacagcaacatcaagatctacaacacccccagcgccagctacctggaggtgaccccagacagtgaaaatgactttggaaactacaactgcacagctgtgaacagaattggccaggagagcctggagttcatcctggtgcaggccgacacccccagcagccccagcattgaccaggtggagccctacagcagcacagcccaggtgcagtttgatgagcctgaggccactggaggagtgcccatcctgaagtacaaggccgagtggagggctgtgggggaggaggtgtggcacagcaagtggtatgatgccaaggaggcctccatggagggcatcgtgaccatcgtgggcctgaagccagagaccacctatgctgtgcggctggccgccctgaatggcaagggcctgggggagatctctgctgccagcgagttcaagacccagcctgtgcctggagagcccagcgcccccaagctggagggccagatgggagaagatggcaacagcatcaaggtgaacctgatcaagcaggatgatggcggcagccccatccgccactacctggtgcgctaccgggccctgagcagcgagtggaagccagagatccggctgcccagcggcagtgaccacgtgatgctgaagagcctggactggaatgcagaatatgaggtgtatgtggtggccgagaaccagcagggcaagagcaaggccgcccactttgtgttccgcaccagcgcccagcccacagccatcccagccaacggcagccccaccagcggcctgagcactggagccatcgtgggcatcctgattgtcatctttgtgctgctgctggtggtggtggacatcacctgctacttcctgaacaagtgtggcctcttcatgtgcatcgctgtgaacctgtgtgggaaggccggccctggggccaagggcaaggacatggaggagggcaaggccgccttcagcaaggatgagagcaaggagcccatcgtggaggtgaggacagaggaggagaggacccccaaccatgatggcggcaagcacacagagcccaatgagaccacccccctgacagagcctgagaagggccctgtggaggccaagccagagtgccaggagacagagaccaagccagccccagctgaggtgaagacagtgcccaatgatgccacccagaccaaggaaaatgaaagcaaggcctag

SEQ ID NO: 20761 - DNA, 1995 bp, Artificial Sequence
  Description of Artificial Sequence: Synthetic coding sequence
atcaccatcagagatgagatctgggtgctcttctgctttgtgttttctgtgtccctgcaggtggacatcgtgcccagccagggcgagatctctgtgggggagagcaagttcttcctgtgccaggtggccggagatgccaaggacaaggacatctcctggttcagccccaatggagagaagctgacccccaaccagcagaggatctctgtggtgtggaatgatgacagcagcagcaccctgaccatctacaatgccaacattgatgatgctggcatctacaagtgtgtggtgactggagaagatggcagcgagagcgaggccaccgtgaatgtgaagatcttccagaagctgatgttcaagaatgcccccaccccccaggagttccgggagggggaggatgctgtgattgtgtgtgatgtggtgagcagcctgccccccaccatcatctggaagcacaagggcagagatgtgatcctgaagaaggatgtgcgcttcatcgtgctgagcaacaactacctgcagatccggggcatcaagaagacagatgagggcacctaccgctgtgagggccgcatcctggcccggggggagatcaacttcaaggacatccaggtgattgtgaatgtgccccccaccatccaggcccggcagaacatcgtgaatgccacagccaacctgggccagagcgtgaccctggtgtgtgatgctgagggcttccctgagcccaccatgtcctggaccaaggatggagagcagatcgagcaggaggaggatgatgagaagtacatcttcagtgatgacagcagccagctgaccatcaagaaggtggacaagaatgatgaggccgagtacatctgcatcgccgagaacaaggccggggagcaggatgccaccatccacctgaaggtgtttgccaagcccaagatcacctacgtggagaaccagacagccatggagctggaggagcaggtgaccctgacctgtgaggccagcggggaccccatccccagcatcacctggaggaccagcaccaggaacatcagcagcgaggagaaggcctcctggaccaggcctgagaagcaggagaccctggatggccacatggtggtgcgcagccacgcccgggtgagcagcctgaccctgaagagcatccagtacacagatgctggggagtacatctgcacagccagcaacaccatcggccaggacagccagagcatgtacctggaggtgcagtatgcccccaagctgcagggccctgtggccgtgtacacctgggagggcaaccaggtgaacatcacctgtgaggtgtttgcctaccccagcgccaccatctcctggttcagagatggccagctgctgcccagcagcaactacagcaacatcaagatctacaacaccccatctgccagctacctggaggtgaccccagattctgaaaatgactttggaaactacaactgcacagctgtgaaccgcatcggccaggagagcctggagttcatcctggtgcaggccgacacccccagcagccccagcattgaccaggtggagccctacagcagcacagcccaggtgcagtttgatgagcctgaggccaccggcggcgtgcccatcctgaagtacaaggccgagtggagggctgtgggggaggaggtgtggcacagcaagtggtatgatgccaaggaggcctccatggagggcatcgtgaccatcgtgggcctgaagccagagaccacctatgctgtgcggctggccgccctgaatggcaagggcctgggggagatctctgctgccagcgagttcaagacccagcctgtgcaggcccccccacccacagccagcgccagcagcagcacccctgtgcccctgagccccccagacaccacctggcccctgcctgccctggccaccacagagcccgccaagaacatcgcccagaaccactgctgcaacatgttccaggccggcctgcacaatgccctgatgaagtag

SEQ ID NO: 20762 - DNA, 942 bp, Artificial Sequence
  Description of Artificial Sequence: Synthetic coding sequence
atggagggcatcgtgaccatcgtgggcctgaagccagagaccacctatgctgtgcggctggccgccctgaatggcaagggcctgggggagatctctgctgccagcgagttcaagacccagcctgtgcacagccccccacctccagccagcgccagcagcagcacccctgtgcccctgagccccccagacaccggggagcccagcgcccccaagctggagggccagatgggagaagatggcaacagcatcaaggtgaacctgatcaagcaggatgatggcggcagccccatccgccactacctggtgcgctaccgggccctgagcagcgagtggaagccagagatccggctgcccagcggcagtgaccacgtgatgctgaagagcctggactggaatgcagaatatgaggtgtatgtggtggccgagaaccagcagggcaagagcaaggccgcccactttgtgttccgcaccagcgcccagcccacagccatcccagccaacggcagccccaccagcggcctgagcactggagccatcgtgggcatcctgattgtcatctttgtgctgctgctggtggtggtggacatcacctgctacttcctgaacaagtgtggcctcttcatgtgcatcgctgtgaacctgtgtgggaaggccggccctggggccaagggcaaggacatggaggagggcaaggccgccttcagcaaggatgagagcaaggagcccatcgtggaggtgaggacagaggaggagaggacccccaaccatgatggcggcaagcacacagagcccaatgagaccacccccctgacagagcctgagaagggccctgtggaggccaagccagagtgccaggagacagagaccaagccagccccagctgaggtgaagacagtgcccaatgatgccacccagaccaaggaaaatgaaagcaaggcctag

SEQ ID NO: 20763 - DNA, 570 bp, Artificial Sequence
  Description of Artificial Sequence: Synthetic coding sequence
atgacagagtacaagctggtggtggtgggcgctgggggcgtgggcaagagcgccctgaccatccagctgatccagaaccactttgtggatgaatatgaccccaccattgaagattcctacaggaagcaggtggtgattgatggagagacctgcctgctggacatcctggacacagctggccaggaggagtacagcgccatgagggaccagtacatgaggactggagagggcttcctgtgtgtgtttgccatcaacaacagcaagagctttgctgacatcaacctgtaccgggagcagatcaagagggtgaaggacagtgatgatgtgcccatggtgctggtgggcaacaagtgtgacctgcccaccaggacagtggacaccaagcaggcccacgagctggccaagagctatggcatccccttcatcgagaccagcgccaagacccggcagggcgtggaggatgccttctacaccctggtgcgggagatccggcagtacaggatgaagaagctgaacagcagtgatgatggcacccagggctgcatgggcctgccctgtgtggtgatgtag

SEQ ID NO: 20764 - DNA, 651 bp, Artificial Sequence
  Description of Artificial Sequence: Synthetic coding sequence
atgcctggcaacctgatgagccagaccagcagagctgtgtccatctggaagtttcctgccaagctgggcaagacccacggccaccgggccctggaggccaccggcatgatgctgcgggtgctggtgggcgctgtgctgcctgccatgctgctggccgcccccccacccatcaacaagctggccctcttcccagacaagagcgcctggtgtgaggccaagaacatcacccagatcgtgggccacagcggctgtgaggccaagagcatccagaacagagcctgcctgggccagtgcttctcctacagcgtgcccaacaccttcccccagagcacagagagcctggtgcactgtgacagctgcatgcctgcccagagcatgtgggagatcgtgaccctggagtgccccggccacgaggaggtgccccgggtggacaagctggtggagaagatcctgcactgcagctgccaggcctgtgggaaggagcccagccatgagggcctgtctgtgtatgtgcagggagaagatggccctggcagccagcccggcacccacccccacccccacccccacccccaccctgggggccagaccccagagccagaagatcctcctggggccccccacacagaggaggagggcgcagaagattag

SEQ ID NO: 20765 - DNA, 546 bp, Artificial Sequence
  Description of Artificial Sequence: Synthetic coding sequence
atgatgctgcgggtgctggtgggcgctgtgctgcctgccatgctgctggccgcccccccacccatcaacaagctggccctcttcccagacaagagcgcctggtgtgaggccaagaacatcacccagatcgtgggccacagcggctgtgaggccaagagcatccagaacagagcctgcctgggccagtgcttctcctacagcgtgcccaacaccttcccccagagcacagagagcctggtgcactgtgacagctgcatgcctgcccagagcatgtgggagatcgtgaccctggagtgccccggccacgaggaggtgccccgggtggacaagctggtggagaagatcctgcactgcagctgccaggcctgtgggaaggagcccagccatgagggcctgtctgtgtatgtgcagggagaagatggccctggcagccagcccggcacccacccccacccccacccccacccccaccctgggggccagaccccagagcctgaggaccccccaggggccccccacacagaggaggagggcgctgaggactag

SEQ ID NO: 20766 - DNA, 351 bp, Artificial Sequence
  Description of Artificial Sequence: Synthetic coding sequence
atgatgctgcgggtgctggtgggcgctgtgctgcctgccatgctgctggccgcccccccacccatcaacaagctggccctcttcccagacaagagcgcctggtgtgaggccaagaacatcacccagatcgtgggccacagcggctgtgaggccaagagcatccagaacagagcctgcctgggccagtgcttctcctacagcgtgcccaacaccttcccccagagcacagagagcctggtgcactgtgacagctgcatgcctgcccagagcatgtgggagatcgtgaccctggagtgccccggccacgaggaggtgccccgggtggacaagctggtggagaagatcctgtag

SEQ ID NO: 20767 - DNA, 492 bp, Artificial Sequence
  Description of Artificial Sequence: Synthetic coding sequence
atgctgcgggtgctggtgggcgctgtgctgcctgccatgctgctggccgcccccccacccatcaacaagctggccctcttcccagacaagagcgcctggtgtgaggccaagaacatcacccagatcgtgggccacagcggctgtgaggccaagagcatccagaacagagcctgcctgggccagtgcttctcctacagcgtgcccaacaccttcccccagagcacagagagcctggtgcactgtgacagctgcatgcctgcccagagcatgtgggagatcgtgaccctggagtgccccggccacgaggaggtgccccgggtggacaagctggtggagaagatcctgcactgcagctgccaggcctgtgggaaggagcccagccatgagggcctgtctgtgtatgtgcagggagaagatggccctggcagccagcccggcacccacccccacccccacccccacccccaccctgggggccagaccccagagtag

SEQ ID NO: 20768 - DNA, 354 bp, Artificial Sequence
  Description of Artificial Sequence: Synthetic coding sequence
atgatgctgcgggtgctggtgggcgctgtgctgcctgccatgctgctggccgcccccccacccatcaacaagctggccctcttcccagacaagagcgcctggtgtgaggccaagaacatcacccagatcgtgggccacagcggctgtgaggccaagagcatccagaacagagcctgcctgggccagtgcttctcctacagcgtgcccaacaccttcccccagagcacagagagcctggtgcactgtgacagctgcatgcctgcccagagcatgtgggagatcgtgaccctggagtgccccggccacgaggaggtgccccgggtggacaagctggtggagaagatcctgcactag

SEQ ID NO: 20769 - DNA, 330 bp, Artificial Sequence
  Description of Artificial Sequence: Synthetic coding sequence
atgatgctgcgggtgctggtgggcgctgtgctgcctgccatgctgctggccgcccccccacccatcaacaagctggccctcttcccagacaagagcgcctggtgtgaggccaagaacatcacccagatcgtgggccacagcggctgtgaggccaagagcatccagaacagagcctgcctgggccagtgcttctcctacagcgtgcccaacaccttcccccagagcacagagagcctggtgcactgtgacagctgcatgcctgcccagagcatgtgggagatcgtgaccctggagtgccccggccacgaggaggtgccccgggtggactag

SEQ ID NO: 20770 - DNA, 387 bp, Artificial Sequence
  Description of Artificial Sequence: Synthetic coding sequence
atgatgctgcgggtgctggtgggcgctgtgctgcctgccatgctgctggccgcccccccacccatcaacaagctggccctcttcccagacaagagcgcctggtgtgaggccaagaacatcacccagatcgtgggccacagcggctgtgaggccaagagcatccagaacagagcctgcctgggccagtgcttctcctacagcgtgcccaacaccttcccccagagcacagagagcctggtgcactgtgacagctgcatgcctgcccagagcatgtgggagatcgtgaccctggagtgccccggccacgaggaggtgccccgggtggacaagctggtggagaagatcctgcactgcagctgccaggcctgtgggaaggagcccagctag

SEQ ID NO: 20771 - DNA, 543 bp, Artificial Sequence
  Description of Artificial Sequence: Synthetic coding sequence
atgctgcgggtgctggtgggcgctgtgctgcctgccatgctgctggccgcccccccacccatcaacaagctggccctcttcccagacaagagcgcctggtgtgaggccaagaacatcacccagatcgtgggccacagcggctgtgaggccaagagcatccagaacagagcctgcctgggccagtgcttctcctacagcgtgcccaacaccttcccccagagcacagagagcctggtgcactgtgacagctgcatgcctgcccagagcatgtgggagatcgtgaccctggagtgccccggccacgaggaggtgccccgggtggacaagctggtggagaagatcctgcactgcagctgccaggcctgtgggaaggagcccagccatgagggcctgtctgtgtatgtgcagggagaagatggccctggcagccagcccggcacccacccccacccccacccccacccccaccctgggggccagaccccagagccagaagatcctcctggggccccccacacagaggaggagggcgcagaagattag

SEQ ID NO: 20772 - DNA, 8457 bp, Artificial Sequence
  Description of Artificial Sequence: Synthetic coding sequence
atggccgcccacaggcctgtggagtgggtgcaggccgtggtgtccagatttgatgagcagctgcccatcaagacaggccagcagaacacccacaccaaggtgtccacagagcacaacaaggaatgtctcatcaacatcagcaagtacaagttcagcctggtgatcagcggcctgaccaccatcctgaagaatgtgaacaacatgaggatctttggagaggccgctgagaagaacctgtacctgagccagctgatcatcctggacaccctggagaagtgcctggccggccagcccaaggacaccatgaggctggatgagaccatgctggtgaagcagctgctgcctgagatctgccacttcctgcacacctgccgggagggcaaccagcacgccgctgagctgagaaattctgccagcggcgtgctcttcagcctgagctgcaacaacttcaatgctgtgttcagccgcatcagcacccggctgcaggagctgactgtgtgcagtgaagataatgtggatgtgcatgacatcgagctgctgcagtacatcaacgtggactgtgccaagctgaagaggctgctgaaggagacagccttcaagttcaaggccctgaagaaggtggcccagctggccgtcatcaacagcctggagaaggccttctggaactgggtggagaactacccagatgagttcaccaagctgtaccagatcccccagacagacatggccgagtgtgccgagaagctgtttgacctggtggatggctttgctgagagcaccaagaggaaggctgctgtgtggcccctgcagatcatcctgctgatcctgtgcccagagatcatccaggacatcagcaaggatgtggtggatgagaacaacatgaacaagaagctgttcctggacagcctgaggaaggccctggccggccacggcggcagccggcagctgacagaatctgctgccatcgcctgtgtgaagctgtgcaaggccagcacctacatcaactgggaggacaacagcgtcatcttcctgctggtgcagagcatggtggtggacctgaagaacctgctcttcaaccccagcaagcccttcagccggggcagccagcctgcagatgtggacctgatgattgactgcctggtgtcctgcttccgcatcagcccccacaacaaccagcacttcaagatctgcctggcccagaacagccccagcaccttccactacgtgctggtgaacagcctgcaccgcatcatcaccaacagcgccctggactggtggcccaagattgatgctgtgtactgccacagcgtggagctgaggaacatgtttggagagaccctgcacaaggctgtgcagggctgtggggcccacccagccatccgcatggcccccagcctgaccttcaaggagaaggtgaccagcctgaagttcaaggagaagcccacagacctggagaccaggagctacaagtacctgctgctgtccatggtgaagctgattcatgctgaccccaagctgctgctgtgcaaccccaggaagcagggccctgagacccagggcagcacagctgagctgatcaccggcctggtgcagctggtgccccagagccacatgcctgagatcgcccaggaggccatggaggccctgctggtgctgcaccagctggacagcattgacctgtggaacccagatgcccctgtggagaccttctgggagatcagcagccagatgctgttctacatctgcaagaagctgaccagccaccagatgctgagcagcacagagatcctgaagtggctgcgggagatcctgatctgcaggaacaagttcctgctgaagaacaagcaggccgacaggagcagctgccacttcctgctcttctacggcgtgggctgtgacatccccagcagcggcaacaccagccagatgtccatggaccacgaggagctgctgcggacccctggggccagcctgaggaagggcaagggcaacagctccatggattctgctgctggctgcagcggcaccccacccatctgccggcaggcccagaccaagctggaggtggccctgtacatgttcctgtggaacccagacacagaggccgtgctggtggccatgagctgcttccgccacctgtgtgaggaggccgacatccgctgtggggtggatgaggtgtctgtgcacaacctgctgcccaactacaacaccttcatggagtttgcctctgtgagcaacatgatgagcacaggccgggccgccctgcagaagagggtgatggccctgctgcggcgcatcgagcaccccacagctggcaacacagaggcctgggaggacacccacgccaagtgggagcaggccaccaagctgatcctgaactaccccaaggccaagatggaggatggccaggccgctgagagcctgcacaagaccatcgtgaagaggaggatgagccacgtgtctgggggcggcagcattgacctgagtgacacagacagcctgcaggagtggatcaacatgacaggcttcctgtgtgccctgggcggcgtgtgcctgcagcagaggagcaacagcggcctggccacctacagcccccccatgggccctgtgtctgagaggaagggctccatgatctctgtgatgagcagcgagggcaatgctgacacccctgtgtccaagttcatggaccggctgctgagcctgatggtgtgcaaccacgagaaggtgggcctgcagatccgcaccaacgtgaaggacctggtgggcctggagctgagccctgccctgtaccccatgctgttcaacaagctgaagaacaccatcagcaagttctttgacagccagggccaggtgctgctgacagacaccaacacccagtttgtggagcagaccatcgccatcatgaagaacctgctggacaaccacacagagggcagcagcgagcacctgggccaggccagcattgagaccatgatgctgaacctggtgcgctacgtgcgggtgctgggcaacatggtgcacgccatccagatcaagaccaagctgtgccagctggtggaggtgatgatggccaggagagatgacctgtccttctgccaggagatgaagttcaggaacaagatggtggagtacctgacagactgggtgatgggcaccagcaaccaggccgcagatgatgatgtgaagtgcctgacccgggacctggaccaggcctccatggaggccgtggtgtccctgctggccggcctgcccctgcagcctgaggagggagatggagtggagctgatggaggccaagagccagctgttcctgaagtacttcaccctcttcatgaacctgctgaatgactgcagcgaggtggaggatgagagcgcccagacaggaggcaggaagaggggcatgagccggcggctggccagcctgcggcactgcaccgtgctggccatgagcaacctgctgaatgccaacgtggacagcggcctgatgcacagcatcggcctgggctaccacaaggacctgcagacccgggccaccttcatggaggtgctgaccaagatcctgcagcagggcacagaatttgacaccctggccgagaccgtgctggccgacagatttgagcggctggtggagctggtgaccatgatgggagaccagggcgagctgcccatcgccatggccctggccaacgtggtgccctgcagccagtgggatgagctggcccgggtgctggtgaccctgtttgacagccgccacctgctgtaccagctgctgtggaacatgttcagcaaggaggtggagctggccgacagcatgcagaccctcttccggggcaacagcctggccagcaagatcatgaccttctgcttcaaggtgtatggagccacctacctgcagaagctgctggaccccctgctgagaattgtcatcaccagcagtgactggcagcacgtgtcctttgaggtggaccccacccggctggagcccagcgagagcctggaggagaaccagaggaacctgctgcagatgacagagaagttcttccacgccatcatcagcagcagcagcgagttccccccccagctgcggtctgtgtgccactgcctgtaccaggtggtgtcccagcgcttcccccagaacagcattggagctgtgggcagcgccatgttcctgcgcttcatcaacccagccatcgtgagcccctatgaagctggcatcctggacaagaagcccccaccccgcatcgagcggggcctgaagctgatgagcaagatcctgcagagcatcgccaaccacgtgctcttcaccaaggaggagcacatgaggcccttcaatgactttgtgaagagcaactttgatgctgcccggcgcttcttcctggacatcgccagtgactgccccaccagtgatgctgtgaaccacagcctgtccttcatcagtgatggaaatgtgctggccctgcaccggctgctgtggaacaaccaggagaagattggccagtacctgagcagcaacagagaccacaaggctgtgggccggcggccctttgacaagatggccaccctgctggcctacctgggccccccagagcacaagcctgtggccgacacccactggagcagcctgaacctgaccagcagcaagtttgaggagttcatgaccaggcaccaggtgcatgagaaggaggagttcaaggccctgaagaccctgagcatcttctaccaggccggcaccagcaaggccggcaaccccatcttctactacgtggcccggcgcttcaagacaggccagatcaacggggacctgctgatctaccacgtgctgctgaccctgaagccctactatgccaagccctatgagatcgtggtggacctgacccacacaggccccagcaaccgcttcaagacagacttcctgagcaagtggtttgtggtgtttcctggctttgcctatgacaacgtgtctgctgtgtacatctacaactgcaacagctgggtgcgggagtacaccaagtaccacgagcggctgctgaccggcctgaagggcagcaagaggctggtgttcatcgactgccctgggaagctggccgagcacatcgagcacgagcagcagaagctgcctgctgccaccctggccctggaggaggacctgaaggtgttccacaatgccctgaagctggcccacaaggacaccaaggtgtccatcaaggtgggcagcacagctgtgcaggtgaccagcgctgagaggaccaaggtgctgggccagagcgtcttcctgaatgacatctactatgccagcgagattgaggagatctgcctggtggatgagaaccagttcaccctgaccatcgccaaccagggcacccccctgaccttcatgcaccaggagtgtgaggccatcgtgcagagcatcatccacatccgcacccgctgggagctgagccagcctgacagcatcccccagcacaccaagatccggcccaaggatgtgcccggcaccctgctgaacatcgccctgctgaacctgggcagcagtgaccccagcctgcggtctgctgcctacaacctgctgtgtgccctgacctgcaccttcaacctgaagattgagggccagctgctggagaccagcggcctgtgcatcccagccaacaacaccctcttcatcgtgtccatcagcaagaccctggccgccaatgagccccacctgaccctggagttcctggaggagtgcatcagcggcttcagcaagagcagcattgagctgaagcacctgtgcctggagtacatgaccccctggctgagcaacctggtgcgcttctgcaagcacaatgatgatgccaagaggcagagggtgacagccatcctggacaagctgatcaccatgaccatcaatgagaagcagatgtaccccagcatccaggccaagatctggggcagcctgggccagatcacagacctgctggatgtggtgctggacagcttcatcaagaccagcgccactggaggcctgggcagcatcaaggccgaggtgatggctgacacagctgtggccctggccagcggaaatgtgaagctggtgagcagcaaggtgattggccgcatgtgcaagatcatcgacaagacctgcctgagccccacccccaccctggagcagcacctgatgtgggatgacatcgccatcctggcccgctacatgctgatgctgtccttcaacaacagcctggatgtggccgcccacctgccctacctgttccacgtggtgaccttcctggtggccaccggccccctgagcctgcgggccagcacccacggcctggtgatcaacatcatccacagcctgtgcacctgcagccagctgcacttcagcgaggagaccaagcaggtgctgcggctgagcctgacagagttcagcctgcccaagttctacctgctgtttggcatcagcaaggtgaagtctgctgctgtgattgccttccgcagcagctacagagaccgctccttcagccctggcagctatgagcgggagacctttgccctgaccagcctggagaccgtgacagaggccctgctggagatcatggaggcctgcatgagggacatccccacctgcaagtggctggaccagtggacagagctggcccagagatttgccttccagtacaaccccagcctgcagccccgggccctggtggtgtttggctgcatcagcaagagggtgagccacggccagatcaagcagatcatccgcatcctgagcaaggccctggagagctgcctgaagggccctgacacctacaacagccaggtgctgattgaggccaccgtgattgccctgaccaagctgcagcccctgctgaacaaggacagccccctgcacaaggccctcttctgggtggccgtggccgtgctgcagctggatgaggtgaacctgtacagcgctggaacagccctgctggagcagaacctgcacaccctggacagcctgcgcatcttcaatgacaagagccctgaggaggtgttcatggccatccggaaccccctggagtggcactgcaagcagatggaccactttgtgggcctgaacttcaacagcaacttcaactttgccctggtgggccacctgctgaagggctaccgccaccccagccctgccatcgtggccaggacagtgcgcatcctgcacaccctgctgaccctggtgaacaagcacaggaactgtgacaagtttgaggtgaacacccagagcgtggcctacctggccgccctgctgactgtgtctgaggaggtgcgcagccgctgcagcctgaagcacaggaagagcctgctgctgacagacatctccatggagaatgtgcccatggacacctaccccatccaccacggggaccccagctaccgcaccctgaaggagacccagccctggagcagccccaagggcagcgagggctacctggccgccacctaccccaccgtgggccagaccagcccccgggccaggaagtccatgagcctggacatgggccagcccagccaggccaacaccaagaagctgctgggcaccaggaagagctttgaccacctgatcagtgacaccaaggcccccaagaggcaggagatggagagcggcatcaccaccccacccaagatgagaagagtggccgagacagattatgagatggagacccagaggatcagcagcagccagcagcacccccacctgaggaaggtgtctgtgtctgagagcaatgtgctgctggatgaggaggtgctgacagaccccaagatccaggccctgctgctgactgtgctggccaccctggtgaagtacaccacagatgaatttgaccagaggatcctgtatgagtacctggccgaggcctctgtggtgttccccaaggtgtttcctgtggtgcacaacctgctggacagcaagatcaacaccctgctgagcctgtgccaggaccccaacctgctgaaccccatccatggaattgtgcagagcgtggtgtaccacgaggagagccccccccagtaccagaccagctacctgcagagctttggcttcaacggcctgtggaggtttgctggccccttcagcaagcagacccagatcccagactatgcagagctgattgtgaagttcctggatgccctgattgacacctacctgcccggcattgatgaggagaccagcgaggagagcctgctgacccccaccagcccctaccccccagccctgcagagccagctgagcatcacagccaacctgaacctgagcaacagcatgaccagcctggccaccagccagcacagccctggcatcgacaaggaaaatgtggagctgagccccaccaccggccactgcaacagcggccgcaccaggcatggcagcgccagccaggtgcagaagcagaggtctgctggcagcttcaagagaaattccatcaagaagatcgtgtag

SEQ ID NO: 20773 - DNA, 8520 bp, Artificial Sequence
  Description of Artificial Sequence: Synthetic coding sequence
atggccgcccacaggcctgtggagtgggtgcaggccgtggtgtccagatttgatgagcagctgcccatcaagacaggccagcagaacacccacaccaaggtgtccacagagcacaacaaggaatgtctcatcaacatcagcaagtacaagttcagcctggtgatcagcggcctgaccaccatcctgaagaatgtgaacaacatgaggatctttggagaggccgctgagaagaacctgtacctgagccagctgatcatcctggacaccctggagaagtgcctggccggccagcccaaggacaccatgaggctggatgagaccatgctggtgaagcagctgctgcctgagatctgccacttcctgcacacctgccgggagggcaaccagcacgccgctgagctgagaaattctgccagcggcgtgctcttcagcctgagctgcaacaacttcaatgctgtgttcagccgcatcagcacccggctgcaggagctgactgtgtgcagtgaagataatgtggatgtgcatgacatcgagctgctgcagtacatcaacgtggactgtgccaagctgaagaggctgctgaaggagacagccttcaagttcaaggccctgaagaaggtggcccagctggccgtcatcaacagcctggagaaggccttctggaactgggtggagaactacccagatgagttcaccaagctgtaccagatcccccagacagacatggccgagtgtgccgagaagctgtttgacctggtggatggctttgctgagagcaccaagaggaaggctgctgtgtggcccctgcagatcatcctgctgatcctgtgcccagagatcatccaggacatcagcaaggatgtggtggatgagaacaacatgaacaagaagctgttcctggacagcctgaggaaggccctggccggccacggcggcagccggcagctgacagaatctgctgccatcgcctgtgtgaagctgtgcaaggccagcacctacatcaactgggaggacaacagcgtcatcttcctgctggtgcagagcatggtggtggacctgaagaacctgctcttcaaccccagcaagcccttcagccggggcagccagcctgcagatgtggacctgatgattgactgcctggtgtcctgcttccgcatcagcccccacaacaaccagcacttcaagatctgcctggcccagaacagccccagcaccttccactacgtgctggtgaacagcctgcaccgcatcatcaccaacagcgccctggactggtggcccaagattgatgctgtgtactgccacagcgtggagctgaggaacatgtttggagagaccctgcacaaggctgtgcagggctgtggggcccacccagccatccgcatggcccccagcctgaccttcaaggagaaggtgaccagcctgaagttcaaggagaagcccacagacctggagaccaggagctacaagtacctgctgctgtccatggtgaagctgattcatgctgaccccaagctgctgctgtgcaaccccaggaagcagggccctgagacccagggcagcacagctgagctgatcaccggcctggtgcagctggtgccccagagccacatgcctgagatcgcccaggaggccatggaggccctgctggtgctgcaccagctggacagcattgacctgtggaacccagatgcccctgtggagaccttctgggagatcagcagccagatgctgttctacatctgcaagaagctgaccagccaccagatgctgagcagcacagagatcctgaagtggctgcgggagatcctgatctgcaggaacaagttcctgctgaagaacaagcaggccgacaggagcagctgccacttcctgctcttctacggcgtgggctgtgacatccccagcagcggcaacaccagccagatgtccatggaccacgaggagctgctgcggacccctggggccagcctgaggaagggcaagggcaacagctccatggattctgctgctggctgcagcggcaccccacccatctgccggcaggcccagaccaagctggaggtggccctgtacatgttcctgtggaacccagacacagaggccgtgctggtggccatgagctgcttccgccacctgtgtgaggaggccgacatccgctgtggggtggatgaggtgtctgtgcacaacctgctgcccaactacaacaccttcatggagtttgcctctgtgagcaacatgatgagcacaggccgggccgccctgcagaagagggtgatggccctgctgcggcgcatcgagcaccccacagctggcaacacagaggcctgggaggacacccacgccaagtgggagcaggccaccaagctgatcctgaactaccccaaggccaagatggaggatggccaggccgctgagagcctgcacaagaccatcgtgaagaggaggatgagccacgtgtctgggggcggcagcattgacctgagtgacacagacagcctgcaggagtggatcaacatgacaggcttcctgtgtgccctgggcggcgtgtgcctgcagcagaggagcaacagcggcctggccacctacagcccccccatgggccctgtgtctgagaggaagggctccatgatctctgtgatgagcagcgagggcaatgctgacacccctgtgtccaagttcatggaccggctgctgagcctgatggtgtgcaaccacgagaaggtgggcctgcagatccgcaccaacgtgaaggacctggtgggcctggagctgagccctgccctgtaccccatgctgttcaacaagctgaagaacaccatcagcaagttctttgacagccagggccaggtgctgctgacagacaccaacacccagtttgtggagcagaccatcgccatcatgaagaacctgctggacaaccacacagagggcagcagcgagcacctgggccaggccagcattgagaccatgatgctgaacctggtgcgctacgtgcgggtgctgggcaacatggtgcacgccatccagatcaagaccaagctgtgccagctggtggaggtgatgatggccaggagagatgacctgtccttctgccaggagatgaagttcaggaacaagatggtggagtacctgacagactgggtgatgggcaccagcaaccaggccgcagatgatgatgtgaagtgcctgacccgggacctggaccaggcctccatggaggccgtggtgtccctgctggccggcctgcccctgcagcctgaggagggagatggagtggagctgatggaggccaagagccagctgttcctgaagtacttcaccctcttcatgaacctgctgaatgactgcagcgaggtggaggatgagagcgcccagacaggaggcaggaagaggggcatgagccggcggctggccagcctgcggcactgcaccgtgctggccatgagcaacctgctgaatgccaacgtggacagcggcctgatgcacagcatcggcctgggctaccacaaggacctgcagacccgggccaccttcatggaggtgctgaccaagatcctgcagcagggcacagaatttgacaccctggccgagaccgtgctggccgacagatttgagcggctggtggagctggtgaccatgatgggagaccagggcgagctgcccatcgccatggccctggccaacgtggtgccctgcagccagtgggatgagctggcccgggtgctggtgaccctgtttgacagccgccacctgctgtaccagctgctgtggaacatgttcagcaaggaggtggagctggccgacagcatgcagaccctcttccggggcaacagcctggccagcaagatcatgaccttctgcttcaaggtgtatggagccacctacctgcagaagctgctggaccccctgctgagaattgtcatcaccagcagtgactggcagcacgtgtcctttgaggtggaccccacccggctggagcccagcgagagcctggaggagaaccagaggaacctgctgcagatgacagagaagttcttccacgccatcatcagcagcagcagcgagttccccccccagctgcggtctgtgtgccactgcctgtaccaggccacctgccacagcctgctgaacaaggccaccgtgaaggagaagaaggagaacaagaagtctgtggtgtcccagcgcttcccccagaacagcatcggggctgtgggcagcgccatgttcctgcgcttcatcaacccagccatcgtgagcccctatgaggccggcatcctggacaagaagcccccaccaagaattgagcggggcctgaagctgatgagcaagatcctgcagagcatcgccaaccacgtgctcttcaccaaggaggagcacatgaggcccttcaatgactttgtgaagagcaactttgatgctgcccggcgcttcttcctggacatcgccagtgactgccccaccagtgatgctgtgaaccacagcctgtccttcatcagtgatggaaatgtgctggccctgcaccggctgctgtggaacaaccaggagaagattggccagtacctgagcagcaacagagaccacaaggctgtgggcagaagaccatttgacaagatggccaccctgctggcctacctgggccccccagagcacaagcctgtggccgacacccactggagcagcctgaacctgaccagcagcaagtttgaggagttcatgaccaggcaccaggtgcatgagaaggaggagttcaaggccctgaagaccctgagcatcttctaccaggccggcaccagcaaggccggcaaccccatcttctactacgtggcccggcgcttcaagacaggccagatcaatggagacctgctgatctaccacgtgctgctgaccctgaagccctactatgccaagccctatgaaattgtggtggacctgacccacacaggccccagcaaccgcttcaagacagacttcctgagcaagtggtttgtggtgtttcctggctttgcctatgacaacgtgtctgctgtgtacatctacaactgcaacagctgggtgcgggagtacaccaagtaccacgagcggctgctgaccggcctgaagggcagcaagaggctggtgttcatcgactgccctgggaagctggccgagcacattgaacatgagcagcagaagctgcctgctgccaccctggccctggaggaggacctgaaggtgttccacaatgccctgaagctggcccacaaggacaccaaggtgtccatcaaggtgggcagcacagctgtgcaggtgaccagcgctgagaggaccaaggtgctgggccagagcgtcttcctgaatgacatctactatgccagcgagattgaggagatctgcctggtggatgagaaccagttcaccctgaccatcgccaaccagggcacccccctgaccttcatgcaccaggagtgtgaggccatcgtgcagagcatcatccacatccgcacccgctgggagctgagccagcctgacagcatcccccagcacaccaagatccggcccaaggatgtgcccggcaccctgctgaacatcgccctgctgaacctgggcagcagtgaccccagcctgcggtctgctgcctacaacctgctgtgtgccctgacctgcaccttcaacctgaagattgagggccagctgctggagaccagcggcctgtgcatcccagccaacaacaccctcttcatcgtgtccatcagcaagaccctggccgccaatgagccccacctgaccctggagttcctggaggagtgcatcagcggcttcagcaagagcagcattgagctgaagcacctgtgcctggagtacatgaccccctggctgagcaacctggtgcgcttctgcaagcacaatgatgatgccaagaggcagagggtgacagccatcctggacaagctgatcaccatgaccatcaatgagaagcagatgtaccccagcatccaggccaagatctggggcagcctgggccagatcacagacctgctggatgtggtgctggacagcttcatcaagaccagcgccaccggcggcctgggcagcatcaaggccgaggtgatggctgacacagctgtggccctggccagcggaaatgtgaagctggtgagcagcaaggtgattggaaggatgtgcaagatcatcgacaagacctgcctgagccccacccccaccctggagcagcacctgatgtgggatgacatcgccatcctggcccgctacatgctgatgctgtccttcaacaacagcctggatgtggccgcccacctgccctacctgttccacgtggtgaccttcctggtggccaccggccccctgagcctgcgggccagcacccacggcctggtgatcaacatcatccacagcctgtgcacctgcagccagctgcacttcagcgaggagaccaagcaggtgctgcggctgagcctgacagagttcagcctgcccaagttctacctgctgtttggcatcagcaaggtgaagtctgctgctgtgattgccttccgcagcagctacagagacaggagcttcagccctggcagctatgaaagagagacctttgccctgaccagcctggagaccgtgacagaggccctgctggagatcatggaggcctgcatgagggacatccccacctgcaagtggctggaccagtggacagagctggcccagagatttgccttccagtacaaccccagcctgcagccccgggccctggtggtgtttggctgcatcagcaagagggtgagccacggccagatcaagcagatcatccgcatcctgagcaaggccctggagagctgcctgaagggccctgacacctacaacagccaggtgctgattgaggccaccgtcatcgccctgaccaagctgcagcccctgctgaacaaggacagccccctgcacaaggccctcttctgggtggccgtggccgtgctgcagctggatgaggtgaacctgtacagcgctggaacagccctgctggagcagaacctgcacaccctggacagcctgcgcatcttcaatgacaagagccctgaggaggtgttcatggccatccggaaccccctggagtggcactgcaagcagatggaccactttgtgggcctgaacttcaacagcaacttcaactttgccctggtgggccacctgctgaagggctaccgccaccccagccctgccatcgtggccaggacagtgcgcatcctgcacaccctgctgaccctggtgaacaagcacaggaactgtgacaagtttgaggtgaacacccagagcgtggcctacctggccgccctgctgactgtgtctgaggaggtgcgcagccgctgcagcctgaagcacaggaagagcctgctgctgacagacatctccatggagaatgtgcccatggacacctaccccatccaccacggggaccccagctaccgcaccctgaaggagacccagccctggagcagccccaagggcagcgagggctacctggccgccacctaccccaccgtgggccagaccagcccccgggccaggaagtccatgagcctggacatgggccagcccagccaggccaacaccaagaagctgctgggcaccaggaagagctttgaccacctgatcagtgacaccaaggcccccaagaggcaggagatggagagcggcatcaccaccccacccaagatgagaagagtggccgagacagattatgagatggagacccagaggatcagcagcagccagcagcacccccacctgaggaaggtgtctgtgtctgagagcaatgtgctgctggatgaggaggtgctgacagaccccaagatccaggccctgctgctgactgtgctggccaccctggtgaagtacaccacagatgaatttgaccagaggatcctgtatgagtacctggccgaggcctctgtggtgttccccaaggtgtttcctgtggtgcacaacctgctggacagcaagatcaacaccctgctgagcctgtgccaggaccccaacctgctgaaccccatccacggcatcgtgcagagcgtggtgtaccacgaggagagccccccccagtaccagaccagctacctgcagagctttggcttcaacggcctgtggaggtttgctggccccttcagcaagcagacccagatcccagactatgcagagctgattgtgaagttcctggatgccctgattgacacctacctgcccggcattgatgaggagaccagcgaggagagcctgctgacccccaccagcccctaccccccagccctgcagagccagctgagcatcacagccaacctgaacctgagcaacagcatgaccagcctggccaccagccagcacagccctggcatcgacaaggaaaatgtggagctgagccccaccaccggccactgcaacagcggccgcaccaggcatggcagcgccagccaggtgcagaagcagaggtctgctggcagcttcaagaggaacagcatcaagaagatcgtgtag

SEQ ID NO: 20774 - DNA, 615 bp, Artificial Sequence
  Description of Artificial Sequence: Synthetic coding sequence
atgcatgagcgctacagcaatgtgcaggtggccggccctgtggacaggaccagcagcaaggacagccccctgcacaaggccctcttctgggtggccgtggccgtgctgcagctggatgaggtgaacctgtacagcgctggaacagccctgctggagcagaacctgcacaccctggacagcctgcgcatcttcaatgacaagagccctgaggaggtgttcatggccatccggaaccccctggagtggcactgcaagcagatggaccactttgtgggcctgaacttcaacagcaacttcaactttgccctggtgggccacctgctgaagggctaccgccaccccagccctgccatcgtggccaggacagtgcgcatcctgcacaccctgctgaccctggtgaacaagcacaggaactgtgacaagtttgaggtgaacacccagagcgtggcctacctggccgccctgctgactgtgtctgaggaggtgcgcagccgctgcagcctgaagcacaggaagagcctgctgctgacagacatctccatggagaatgtgcccatggacacctaccccatccaccacggggaccccagctacagaaacaaggagaagttctag

SEQ ID NO: 20775 - DNA, 1782 bp, Artificial Sequence
  Description of Artificial Sequence: Synthetic coding sequence
atggccgcccacaggcctgtggagtgggtgcaggccgtggtgtccagatttgatgagcagctgcccatcaagacaggccagcagaacacccacaccaaggtgtccacagagcacaacaaggaatgtctcatcaacatcagcaagtacaagttcagcctggtgatcagcggcctgaccaccatcctgaagaatgtgaacaacatgaggatctttggagaggccgctgagaagaacctgtacctgagccagctgatcatcctggacaccctggagaagtgcctggccggccagcccaaggacaccatgaggctggatgagaccatgctggtgaagcagctgctgcctgagatctgccacttcctgcacacctgccgggagggcaaccagcacgccgctgagctgagaaattctgccagcggcgtgctcttcagcctgagctgcaacaacttcaatgctgtgttcagccgcatcagcacccggctgcaggagctgactgtgtgcagtgaagataatgtggatgtgcatgacatcgagctgctgcagtacatcaacgtggactgtgccaagctgaagaggctgctgaaggagacagccttcaagttcaaggccctgaagaaggtggcccagctggccgtcatcaacagcctggagaaggccttctggaactgggtggagaactacccagatgagttcaccaagctgtaccagatcccccagacagacatggccgagtgtgccgagaagctgtttgacctggtggatggctttgctgagagcaccaagaggaaggctgctgtgtggcccctgcagatcatcctgctgatcctgtgcccagagatcatccaggacatcagcaaggatgtggtggatgagaacaacatgaacaagaagctgttcctggacagcctgaggaaggccctggccggccacggcggcagccggcagctgacagaatctgctgccatcgcctgtgtgaagctgtgcaaggccagcacctacatcaactgggaggacaacagcgtcatcttcctgctggtgcagagcatggtggtggacctgaagaacctgctcttcaaccccagcaagcccttcagccggggcagccagcctgcagatgtggacctgatgattgactgcctggtgtcctgcttccgcatcagcccccacaacaaccagcacttcaagatctgcctggcccagaacagccccagcaccttccactacgtgctggtgaacagcctgcaccgcatcatcaccaacagcgccctggactggtggcccaagattgatgctgtgtactgccacagcgtggagctgaggaacatgtttggagagaccctgcacaaggctgtgcagggctgtggggcccacccagccatccgcatggcccccagcctgaccttcaaggagaaggtgaccagcctgaagttcaaggagaagcccacagacctggagaccaggagctacaagtacctgctgctgtccatggtgaagctgattcatgctgaccccaagctgctgctgtgcaaccccaggaagcagggccctgagacccagggcagcacagctgagctgatcaccggcctggtgcagctggtgccccagagccacatgcctgagatcgcccaggaggccatggaggccctgctggtgctgcaccagctggacagcattgacctgtggaacccagatgcccctgtggagaccttctgggagatccgctacatgtacttctacttcctgaacagcaccttcaagttctactttgtgttcctgtcctag

SEQ ID NO: 20776 - DNA, 1917 bp, Artificial Sequence
  Description of Artificial Sequence: Synthetic coding sequence
atgcatgagcgctacagcaatgtgcaggtggccggccctgtggacaggaccagcagcaagttctgtggcagcttcaactgccgctttgccttccagtacaaccccagcctgcagccccgggccctggtggtgtttggctgcatcagcaagagggtgagccacggccagatcaagcagatcatccgcatcctgagcaaggccctggagagctgcctgaagggccctgacacctacaacagccaggtgctgattgaggccaccgtgattgccctgaccaagctgcagcccctgctgaacaaggacagccccctgcacaaggccctcttctgggtggccgtggccgtgctgcagctggatgaggtgaacctgtacagcgctggaacagccctgctggagcagaacctgcacaccctggacagcctgcgcatcttcaatgacaagagccctgaggaggtgttcatggccatccggaaccccctggagtggcactgcaagcagatggaccactttgtgggcctgaacttcaacagcaacttcaactttgccctggtgggccacctgctgaagggctaccgccaccccagccctgccatcgtggccaggacagtgcgcatcctgcacaccctgctgaccctggtgaacaagcacaggaactgtgacaagtttgaggtgaacacccagagcgtggcctacctggccgccctgctgactgtgtctgaggaggtgcgcagccgctgcagcctgaagcacaggaagagcctgctgctgacagacatctccatggagaatgtgcccatggacacctaccccatccaccacggggaccccagctaccgcaccctgaaggagacccagccctggagcagccccaagggcagcgagggctacctggccgccacctaccccaccgtgggccagaccagcccccgggccaggaagtccatgagcctggacatgggccagcccagccaggccaacaccaagaagctgctgggcaccaggaagagctttgaccacctgatcagtgacaccaaggcccccaagaggcaggagatggagagcggcatcaccaccccacccaagatgagaagagtggccgagacagattatgagatggagacccagaggatcagcagcagccagcagcacccccacctgaggaaggtgtctgtgtctgagagcaatgtgctgctggatgaggaggtgctgacagaccccaagatccaggccctgctgctgactgtgctggccaccctggtgaagtacaccacagatgaatttgaccagaggatcctgtatgagtacctggccgaggcctctgtggtgttccccaaggtgtttcctgtggtgcacaacctgctggacagcaagatcaacaccctgctgagcctgtgccaggaccccaacctgctgaaccccatccatggaattgtgcagagcgtggtgtaccacgaggagagccccccccagtaccagaccagctacctgcagagctttggcttcaacggcctgtggaggtttgctggccccttcagcaagcagacccagatcccagactatgcagagctgattgtgaagttcctggatgccctgattgacacctacctgcccggcattgatgaggagaccagcgaggagagcctgctgacccccaccagcccctaccccccagccctgcagagccagctgagcatcacagccaacctgaacctgagcaacagcatgaccagcctggccaccagccagcacagccctggcatcgacaaggaaaatgtggagctgagccccaccaccggccactgcaacagcggccgcaccaggcatggcagcgccagccaggtgcagaagcagaggtctgctggcagcttcaagctggccctgctgaacctgctgacagcccaccagaacagcctgtag

SEQ ID NO: 20777 - DNA, 7509 bp, Artificial Sequence
  Description of Artificial Sequence: Synthetic coding sequence
aactgggaggacaacagcgtcatcttcctgctggtgcagagcatggtggtggacctgaagaacctgctcttcaaccccagcaagcccttcagccggggcagccagcctgcagatgtggacctgatgattgactgcctggtgtcctgcttccgcatcagcccccacaacaaccagcacttcaagatctgcctggcccagaacagccccagcaccttccactacgtgctggtgaacagcctgcaccgcatcatcaccaacagcgccctggactggtggcccaagattgatgctgtgtactgccacagcgtggagctgaggaacatgtttggagagaccctgcacaaggctgtgcagggctgtggggcccacccagccatccgcatggcccccagcctgaccttcaaggagaaggtgaccagcctgaagttcaaggagaagcccacagacctggagaccaggagctacaagtacctgctgctgtccatggtgaagctgattcatgctgaccccaagctgctgctgtgcaaccccaggaagcagggccctgagacccagggcagcacagctgagctgatcaccggcctggtgcagctggtgccccagagccacatgcctgagatcgcccaggaggccatggaggccctgctggtgctgcaccagctggacagcattgacctgtggaacccagatgcccctgtggagaccttctgggagatcagcagccagatgctgttctacatctgcaagaagctgaccagccaccagatgctgagcagcacagagatcctgaagtggctgcgggagatcctgatctgcaggaacaagttcctgctgaagaacaagcaggccgacaggagcagctgccacttcctgctcttctacggcgtgggctgtgacatccccagcagcggcaacaccagccagatgtccatggaccacgaggagctgctgcggacccctggggccagcctgaggaagggcaagggcaacagctccatggattctgctgctggctgcagcggcaccccacccatctgccggcaggcccagaccaagctggaggtggccctgtacatgttcctgtggaacccagacacagaggccgtgctggtggccatgagctgcttccgccacctgtgtgaggaggccgacatccgctgtggggtggatgaggtgtctgtgcacaacctgctgcccaactacaacaccttcatggagtttgcctctgtgagcaacatgatgagcacaggccgggccgccctgcagaagagggtgatggccctgctgcggcgcatcgagcaccccacagctggcaacacagaggcctgggaggacacccacgccaagtgggagcaggccaccaagctgatcctgaactaccccaaggccaagatggaggatggccaggccgctgagagcctgcacaagaccatcgtgaagaggaggatgagccacgtgtctgggggcggcagcattgacctgagtgacacagacagcctgcaggagtggatcaacatgacaggcttcctgtgtgccctgggcggcgtgtgcctgcagcagaggagcaacagcggcctggccacctacagcccccccatgggccctgtgtctgagaggaagggctccatgatctctgtgatgagcagcgagggcaatgctgacacccctgtgtccaagttcatggaccggctgctgagcctgatggtgtgcaaccacgagaaggtgggcctgcagatccgcaccaacgtgaaggacctggtgggcctggagctgagccctgccctgtaccccatgctgttcaacaagctgaagaacaccatcagcaagttctttgacagccagggccaggtgctgctgacagacaccaacacccagtttgtggagcagaccatcgccatcatgaagaacctgctggacaaccacacagagggcagcagcgagcacctgggccaggccagcattgagaccatgatgctgaacctggtgcgctacgtgcgggtgctgggcaacatggtgcacgccatccagatcaagaccaagctgtgccagctggtggaggtgatgatggccaggagagatgacctgtccttctgccaggagatgaagttcaggaacaagatggtggagtacctgacagactgggtgatgggcaccagcaaccaggccgcagatgatgatgtgaagtgcctgacccgggacctggaccaggcctccatggaggccgtggtgtccctgctggccggcctgcccctgcagcctgaggagggagatggagtggagctgatggaggccaagagccagctgttcctgaagtacttcaccctcttcatgaacctgctgaatgactgcagcgaggtggaggatgagagcgcccagacaggaggcaggaagaggggcatgagccggcggctggccagcctgcggcactgcaccgtgctggccatgagcaacctgctgaatgccaacgtggacagcggcctgatgcacagcatcggcctgggctaccacaaggacctgcagacccgggccaccttcatggaggtgctgaccaagatcctgcagcagggcacagaatttgacaccctggccgagaccgtgctggccgacagatttgagcggctggtggagctggtgaccatgatgggagaccagggcgagctgcccatcgccatggccctggccaacgtggtgccctgcagccagtgggatgagctggcccgggtgctggtgaccctgtttgacagccgccacctgctgtaccagctgctgtggaacatgttcagcaaggaggtggagctggccgacagcatgcagaccctcttccggggcaacagcctggccagcaagatcatgaccttctgcttcaaggtgtatggagccacctacctgcagaagctgctggaccccctgctgagaattgtcatcaccagcagtgactggcagcacgtgtcctttgaggtggaccccacccggctggagcccagcgagagcctggaggagaaccagaggaacctgctgcagatgacagagaagttcttccacgccatcatcagcagcagcagcgagttccccccccagctgcggtctgtgtgccactgcctgtaccaggtggtgtcccagcgcttcccccagaacagcattggagctgtgggcagcgccatgttcctgcgcttcatcaacccagccatcgtgagcccctatgaagctggcatcctggacaagaagcccccaccccgcatcgagcggggcctgaagctgatgagcaagatcctgcagagcatcgccaaccacgtgctcttcaccaaggaggagcacatgaggcccttcaatgactttgtgaagagcaactttgatgctgcccggcgcttcttcctggacatcgccagtgactgccccaccagtgatgctgtgaaccacagcctgtccttcatcagtgatggaaatgtgctggccctgcaccggctgctgtggaacaaccaggagaagattggccagtacctgagcagcaacagagaccacaaggctgtgggccggcggccctttgacaagatggccaccctgctggcctacctgggccccccagagcacaagcctgtggccgacacccactggagcagcctgaacctgaccagcagcaagtttgaggagttcatgaccaggcaccaggtgcatgagaaggaggagttcaaggccctgaagaccctgagcatcttctaccaggccggcaccagcaaggccggcaaccccatcttctactacgtggcccggcgcttcaagacaggccagatcaacggggacctgctgatctaccacgtgctgctgaccctgaagccctactatgccaagccctatgagatcgtggtggacctgacccacacaggccccagcaaccgcttcaagacagacttcctgagcaagtggtttgtggtgtttcctggctttgcctatgacaacgtgtctgctgtgtacatctacaactgcaacagctgggtgcgggagtacaccaagtaccacgagcggctgctgaccggcctgaagggcagcaagaggctggtgttcatcgactgccctgggaagctggccgagcacatcgagcacgagcagcagaagctgcctgctgccaccctggccctggaggaggacctgaaggtgttccacaatgccctgaagctggcccacaaggacaccaaggtgtccatcaaggtgggcagcacagctgtgcaggtgaccagcgctgagaggaccaaggtgctgggccagagcgtcttcctgaatgacatctactatgccagcgagattgaggagatctgcctggtggatgagaaccagttcaccctgaccatcgccaaccagggcacccccctgaccttcatgcaccaggagtgtgaggccatcgtgcagagcatcatccacatccgcacccgctgggagctgagccagcctgacagcatcccccagcacaccaagatccggcccaaggatgtgcccggcaccctgctgaacatcgccctgctgaacctgggcagcagtgaccccagcctgcggtctgctgcctacaacctgctgtgtgccctgacctgcaccttcaacctgaagattgagggccagctgctggagaccagcggcctgtgcatcccagccaacaacaccctcttcatcgtgtccatcagcaagaccctggccgccaatgagccccacctgaccctggagttcctggaggagtgcatcagcggcttcagcaagagcagcattgagctgaagcacctgtgcctggagtacatgaccccctggctgagcaacctggtgcgcttctgcaagcacaatgatgatgccaagaggcagagggtgacagccatcctggacaagctgatcaccatgaccatcaatgagaagcagatgtaccccagcatccaggccaagatctggggcagcctgggccagatcacagacctgctggatgtggtgctggacagcttcatcaagaccagcgccactggaggcctgggcagcatcaaggccgaggtgatggctgacacagctgtggccctggccagcggaaatgtgaagctggtgagcagcaaggtgattggccgcatgtgcaagatcatcgacaagacctgcctgagccccacccccaccctggagcagcacctgatgtgggatgacatcgccatcctggcccgctacatgctgatgctgtccttcaacaacagcctggatgtggccgcccacctgccctacctgttccacgtggtgaccttcctggtggccaccggccccctgagcctgcgggccagcacccacggcctggtgatcaacatcatccacagcctgtgcacctgcagccagctgcacttcagcgaggagaccaagcaggtgctgcggctgagcctgacagagttcagcctgcccaagttctacctgctgtttggcatcagcaaggtgaagtctgctgctgtgattgccttccgcagcagctacagagaccgctccttcagccctggcagctatgagcgggagacctttgccctgaccagcctggagaccgtgacagaggccctgctggagatcatggaggcctgcatgagggacatccccacctgcaagtggctggaccagtggacagagctggcccagagatttgccttccagtacaaccccagcctgcagccccgggccctggtggtgtttggctgcatcagcaagagggtgagccacggccagatcaagcagatcatccgcatcctgagcaaggccctggagagctgcctgaagggccctgacacctacaacagccaggtgctgattgaggccaccgtgattgccctgaccaagctgcagcccctgctgaacaaggacagccccctgcacaaggccctcttctgggtggccgtggccgtgctgcagctggatgaggtgaacctgtacagcgctggaacagccctgctggagcagaacctgcacaccctggacagcctgcgcatcttcaatgacaagagccctgaggaggtgttcatggccatccggaaccccctggagtggcactgcaagcagatggaccactttgtgggcctgaacttcaacagcaacttcaactttgccctggtgggccacctgctgaagggctaccgccaccccagccctgccatcgtggccaggacagtgcgcatcctgcacaccctgctgaccctggtgaacaagcacaggaactgtgacaagtttgaggtgaacacccagagcgtggcctacctggccgccctgctgactgtgtctgaggaggtgcgcagccgctgcagcctgaagcacaggaagagcctgctgctgacagacatctccatggagaatgtgcccatggacacctaccccatccaccacggggaccccagctaccgcaccctgaaggagacccagccctggagcagccccaagggcagcgagggctacctggccgccacctaccccaccgtgggccagaccagcccccgggccaggaagtccatgagcctggacatgggccagcccagccaggccaacaccaagaagctgctgggcaccaggaagagctttgaccacctgatcagtgacaccaaggcccccaagaggcaggagatggagagcggcatcaccaccccacccaagatgagaagagtggccgagacagattatgagatggagacccagaggatcagcagcagccagcagcacccccacctgaggaaggtgtctgtgtctgagagcaatgtgctgctggatgaggaggtgctgacagaccccaagatccaggccctgctgctgactgtgctggccaccctggtgaagtacaccacagatgaatttgaccagaggatcctgtatgagtacctggccgaggcctctgtggtgttccccaaggtgtttcctgtggtgcacaacctgctggacagcaagatcaacaccctgctgagcctgtgccaggaccccaacctgctgaaccccatccatggaattgtgcagagcgtggtgtaccacgaggagagccccccccagtaccagaccagctacctgcagagctttggcttcaacggcctgtggaggtttgctggccccttcagcaagcagacccagatcccagactatgcagagctgattgtgaagttcctggatgccctgattgacacctacctgcccggcattgatgaggagaccagcgaggagagcctgctgacccccaccagcccctaccccccagccctgcagagccagctgagcatcacagccaacctgaacctgagcaacagcatgaccagcctggccaccagccagcacagccctgccagcctgccctgcagcaagtctgctgtgttcatgcagctgttcccccaccagggcatcgacaaggaaaatgtggagctgagccccaccaccggccactgcaacagcggccgcaccaggcatggcagcgccagccaggtgcagaagcagaggtctgctggcagcttcaagagaaattccatcaagaagatcgtgtag

SEQ ID NO: 20778 - DNA, 1524 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgaggtgaagaagcagatcctggatgagaagatctactgccccccagaggcctctgtgctgctggccagctatgctgtgcaggccaagtatggagactatgaccccagcgtgcacaagaggggcttcctggcccaggaggagctgctgcccaagagggtcatcaacctgtaccagatgaccccagagatgtgggaggagcgcatcacagcctggtacgccgagcaccggggccgggccagagatgaggccgagatggagtacctgaagatcgcccaggacctggagatgtatggagtgaactactttgccatccggaacaagaagggcacagagctgctgctgggcgtggatgccctgggcctgcacatctatgaccctgagaaccggctgacccccaagatctccttcccctggaatgagatccggaacatctcctacagcgacaaggagttcaccatcaagcccctggacaagaagattgatgtgttcaagttcaacagcagcaagctgcgggtgaacaagctgatcctgcagctgtgcatcggcaaccacgacctcttcatgagaagaaggaaggctgacagcctggaggtgcagcagatgaaggcccaggcccgggaggagaaggccaggaagcagatggagcggcagaggctggcccgggagaagcagatgagggaggaggccgagaggaccagagatgagctggagcggcggctgctgcagatgaaggaggaggccaccatggccaatgaggccctgatgaggtctgaggagacagctgacctgctggccgagaaggcccagatcacagaggaggaggccaagctgctggcccagaaggctgctgaggccgagcaggagatgcagaggatcaaggccacagccatcagaacagaggaggagaagaggctgatggagcagaaggtgctggaggccgaggtgctggccctgaagatggccgaggagagcgagcggcgggccaaggaggccgaccagctgaagcaggacctgcaggaggcccgggaggccgagcggcgggccaagcagaagctgctggagatcgccaccaagcccacctacccacccatgaaccccatcccagcccccctgcccccagacatccccagcttcaacctgattggagacagcctgagctttgacttcaaggacacagacatgaagaggctgtccatggagattgagaaggagaaggtggagtacatggagaagagcaagcacctgcaggagcagctgaatgagctgaagacagaaattgaggccctgaagctgaaggagcgggagacagccctggacatcctgcacaatgaaaattctgaccggggcggcagcagcaagcacaacaccatcaagaagccccaggcccagggccggcggcccatctgcatctag

SEQ ID NO: 20779 - DNA, 1788 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgagatgaagtggaagggcaaggacctgtttgacctggtgtgcaggaccctgggcctgcgggagacctggttcttcggcctgcagtacaccatcaaggacacagtggcctggctgaagatggacaagaaggtgctggaccatgatgtgtccaaggaggagcctgtgaccttccacttcctggccaagttctacccagaaaatgctgaggaggagctggtgcaggagatcacccagcacctgttcttcctgcaggtgaagaagcagatcctggatgagaagatctactgccccccagaggcctctgtgctgctggccagctatgctgtgcaggccaagtacggggactatgaccccagcgtgcacaagaggggcttcctggcccaggaggagctgctgcccaagagggtcatcaacctgtaccagatgaccccagagatgtgggaggagcgcatcacagcctggtatgcagagcaccggggccgggccagagatgaagctgagatggagtacctgaagatcgcccaggacctggagatgtatggagtgaactactttgccatccggaacaagaagggcacagagctgctgctgggcgtggatgccctgggcctgcacatctatgaccctgaaaatcggctgacccccaagatctccttcccctggaatgagatccggaacatctcctacagcgacaaggagttcaccatcaagcccctggacaagaagattgatgtgttcaagttcaacagcagcaagctgcgggtgaacaagctgatcctgcagctgtgcatcggcaaccacgacctcttcatgagaagaaggaaggctgacagcctggaggtgcagcagatgaaggcccaggcccgggaggagaaggccaggaagcagatggagcggcagaggctggcccgggagaagcagatgagggaggaggccgagaggaccagagatgagctggagcggcggctgctgcagatgaaggaggaggccaccatggccaatgaggccctgatgaggtctgaggagacagctgacctgctggccgagaaggcccagatcacagaggaggaggccaagctgctggcccagaaggctgctgaggccgagcaggagatgcagaggatcaaggccacagccatcagaacagaggaggagaagaggctgatggagcagaaggtgctggaggccgaggtgctggccctgaagatggccgaggagagcgagcggcgggccaaggaggccgaccagctgaagcaggacctgcaggaggcccgggaggccgagcggcgggccaagcagaagctgctggagatcgccaccaagcccacctacccacccatgaaccccatcccagcccccctgcccccagacatccccagcttcaacctgattggagacagcctgagctttgacttcaaggacacagacatgaagaggctgtccatggagattgagaaggagaaggtggagtacatggagaagagcaagcacctgcaggagcagctgaatgagctgaagacagaaattgaggccctgaagctgaaggagcgggagacagccctggacatcctgcacaatgaaaacagcgacagaggaggcagcagcaagcacaacaccatcaagaagctgaccctgcagagcgccaagagccgggtggccttctttgaggagctgtag

SEQ ID NO: 20780 - DNA, 663 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgaggtgaagaagcagatcctggatgagaagatctactgccccccagaggcctctgtgctgctggccagctatgctgtgcaggccaagaacaagaagggcacagagctgctgctgggcgtggatgccctgggcctgcacatctatgaccctgagaaccggctgacccccaagatctccttcccctggaatgagatccggaacatctcctacagcgacaaggagttcaccatcaagcccctggacaagaagattgatgtgttcaagttcaacagcagcaagctgcgggtgaacaagctgatcctgcagctgtgcatcggcaaccacgacctcttcatgagaagaaggaaggctgacagcctggaggtgcagcagatgaaggcccaggcccgggaggagaaggccaggaagcagggccagaggggccgctctgctgaggccggccctgctggcagcacccggggcggggccaagagccaggccgaggcccctggggactgccaccaggcccacgtgcctgcccacgagcccaacagcagcacagtggccagctag

SEQ ID NO: 20781 - DNA, 1524 bp, Artificial Sequence; identical to SEQ ID NO: 20778
  Description of Artificial Sequence: Synthetic coding sequence

SEQ ID NO: 20782 - DNA, 1773 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgagatgaagtggaagggcaaggacctgtttgacctggtgtgcaggaccctgggcctgcgggagacctggttcttcggcctgcagtacaccatcaaggacacagtggcctggctgaagatggacaagaaggtgctggaccatgatgtgtccaaggaggagcctgtgaccttccacttcctggccaagttctacccagaaaatgctgaggaggagctggtgcaggagatcacccagcacctgttcttcctgcaggtgaagaagcagatcctggatgagaagatctactgccccccagaggcctctgtgctgctggccagctatgctgtgcaggccaagtacggggactatgaccccagcgtgcacaagaggggcttcctggcccaggaggagctgctgcccaagagggtcatcaacctgtaccagatgaccccagagatgtgggaggagcgcatcacagcctggtatgcagagcaccggggccgggccagagatgaagctgagatggagtacctgaagatcgcccaggacctggagatgtatggagtgaactactttgccatccggaacaagaagggcacagagctgctgctgggcgtggatgccctgggcctgcacatctatgaccctgaaaatcggctgacccccaagatctccttcccctggaatgagatccggaacatctcctacagcgacaaggagttcaccatcaagcccctggacaagaagattgatgtgttcaagttcaacagcagcaagctgcgggtgaacaagctgatcctgcagctgtgcatcggcaaccacgacctcttcatgagaagaaggaaggctgacagcctggaggtgcagcagatgaaggcccaggcccgggaggagaaggccaggaagcagatggagcggcagaggctggcccgggagaagcagatgagggaggaggccgagaggaccagagatgagctggagcggcggctgctgcagatgaaggaggaggccaccatggccaatgaggccctgatgaggtctgaggagacagctgacctgctggccgagaaggcccagatcacagaggaggaggccaagctgctggcccagaaggctgctgaggccgagcaggagatgcagaggatcaaggccacagccatcagaacagaggaggagaagaggctgatggagcagaaggtgctggaggccgaggtgctggccctgaagatggccgaggagagcgagcggcgggccaaggaggccgaccagctgaagcaggacctgcaggaggcccgggaggccgagcggcgggccaagcagaagctgctggagatcgccaccaagcccacctacccacccatgaaccccatcccagcccccctgcccccagacatccccagcttcaacctgattggagacagcctgagctttgacttcaaggacacagacatgaagaggctgtccatggagattgagaaggagaaggtggagtacatggagaagagcaagcacctgcaggagcagctgaatgagctgaagacagaaattgaggccctgaagctgaaggagcgggagacagccctggacatcctgcacaatgaaaacagcgacagaggaggcagcagcaagcacaacaccatcaagaagccccaggcccagggcagaagacccatctgcatctag

SEQ ID NO: 20783 - DNA, 1650 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgagatgaagtggaagggcaaggacctgtttgacctggtgtgcaggaccctgggcctgcgggagacctggttcttcggcctgcagtacaccatcaaggacacagtggcctggctgaagatggacaagaaggtgaagaagcagatcctggatgagaagatctactgccccccagaggcctctgtgctgctggccagctatgctgtgcaggccaagtatggagactatgaccccagcgtgcacaagaggggcttcctggcccaggaggagctgctgcccaagagggtcatcaacctgtaccagatgaccccagagatgtgggaggagcgcatcacagcctggtacgccgagcaccggggccgggccagagatgaggccgagatggagtacctgaagatcgcccaggacctggagatgtatggagtgaactactttgccatccggaacaagaagggcacagagctgctgctgggcgtggatgccctgggcctgcacatctatgaccctgagaaccggctgacccccaagatctccttcccctggaatgagatccggaacatctcctacagcgacaaggagttcaccatcaagcccctggacaagaagattgatgtgttcaagttcaacagcagcaagctgcgggtgaacaagctgatcctgcagctgtgcatcggcaaccacgacctcttcatgagaagaaggaaggctgacagcctggaggtgcagcagatgaaggcccaggcccgggaggagaaggccaggaagcagatggagcggcagaggctggcccgggagaagcagatgagggaggaggccgagaggaccagagatgagctggagcggcggctgctgcagatgaaggaggaggccaccatggccaatgaggccctgatgaggtctgaggagacagctgacctgctggccgagaaggcccagatcacagaggaggaggccaagctgctggcccagaaggctgctgaggccgagcaggagatgcagaggatcaaggccacagccatcagaacagaggaggagaagaggctgatggagcagaaggtgctggaggccgaggtgctggccctgaagatggccgaggagagcgagcggcgggccaaggaggccgaccagctgaagcaggacctgcaggaggcccgggaggccgagcggcgggccaagcagaagctgctggagatcgccaccaagcccacctacccacccatgaaccccatcccagcccccctgcccccagacatccccagcttcaacctgattggagacagcctgagctttgacttcaaggacacagacatgaagaggctgtccatggagattgagaaggagaaggtggagtacatggagaagagcaagcacctgcaggagcagctgaatgagctgaagacagaaattgaggccctgaagctgaaggagcgggagacagccctggacatcctgcacaatgaaaattctgaccggggcggcagcagcaagcacaacaccatcaagaagccccaggcccagggccggcggcccatctgcatctag

SEQ ID NO: 20784 - DNA, 1647 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgaggtgctggaccatgatgtgtccaaggaggagcctgtgaccttccacttcctggccaagttctacccagaaaatgctgaggaggagctggtgcaggagatcacccagcacctgttcttcctgcaggtgaagaagcagatcctggatgagaagatctactgccccccagaggcctctgtgctgctggccagctatgctgtgcaggccaagtacggggactatgaccccagcgtgcacaagaggggcttcctggcccaggaggagctgctgcccaagagggtcatcaacctgtaccagatgaccccagagatgtgggaggagcgcatcacagcctggtatgcagagcaccggggccgggccagagatgaagctgagatggagtacctgaagatcgcccaggacctggagatgtatggagtgaactactttgccatccggaacaagaagggcacagagctgctgctgggcgtggatgccctgggcctgcacatctatgaccctgaaaatcggctgacccccaagatctccttcccctggaatgagatccggaacatctcctacagcgacaaggagttcaccatcaagcccctggacaagaagattgatgtgttcaagttcaacagcagcaagctgcgggtgaacaagctgatcctgcagctgtgcatcggcaaccacgacctcttcatgagaagaaggaaggctgacagcctggaggtgcagcagatgaaggcccaggcccgggaggagaaggccaggaagcagatggagcggcagaggctggcccgggagaagcagatgagggaggaggccgagaggaccagagatgagctggagcggcggctgctgcagatgaaggaggaggccaccatggccaatgaggccctgatgaggtctgaggagacagctgacctgctggccgagaaggcccagatcacagaggaggaggccaagctgctggcccagaaggctgctgaggccgagcaggagatgcagaggatcaaggccacagccatcagaacagaggaggagaagaggctgatggagcagaaggtgctggaggccgaggtgctggccctgaagatggccgaggagagcgagcggcgggccaaggaggccgaccagctgaagcaggacctgcaggaggcccgggaggccgagcggcgggccaagcagaagctgctggagatcgccaccaagcccacctacccacccatgaaccccatcccagcccccctgcccccagacatccccagcttcaacctgattggagacagcctgagctttgacttcaaggacacagacatgaagaggctgtccatggagattgagaaggagaaggtggagtacatggagaagagcaagcacctgcaggagcagctgaatgagctgaagacagaaattgaggccctgaagctgaaggagcgggagacagccctggacatcctgcacaatgaaaacagcgacagaggaggcagcagcaagcacaacaccatcaagaagccccaggcccagggcagaagacccatctgcatctag

SEQ ID NO: 20785 - DNA, 1773 bp, Artificial Sequence; identical to SEQ ID NO: 20782
  Description of Artificial Sequence: Synthetic coding sequence

SEQ ID NO: 20786 - DNA, 1806 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgagatgaagtggaagggcaaggacctgtttgacctggtgtgcaggaccctgggcctgcgggagacctggttcttcggcctgcagtacaccatcaaggacacagtggcctggctgaagatggacaagaaggtgctggaccatgatgtgtccaaggaggagcctgtgaccttccacttcctggccaagttctacccagaaaatgctgaggaggagctggtgcaggagatcacccagcacctgttcttcctgcaggtgaagaagcagatcctggatgagaagatctactgccccccagaggcctctgtgctgctggccagctatgctgtgcaggccaagtacggggactatgaccccagcgtgcacaagaggggcttcctggcccaggaggagctgctgcccaagagggtcatcaacctgtaccagatgaccccagagatgtgggaggagcgcatcacagcctggtatgcagagcaccggggccgggccagagatgaagctgagatggagtacctgaagatcgcccaggacctggagatgtatggagtgaactactttgccatccggaacaagaagggcacagagctgctgctgggcgtggatgccctgggcctgcacatctatgaccctgaaaatcggctgacccccaagatctccttcccctggaatgagatccggaacatctcctacagcgacaaggagttcaccatcaagcccctggacaagaagattgatgtgttcaagttcaacagcagcaagctgcgggtgaacaagctgatcctgcagctgtgcatcggcaaccacgacctcttcatgagaagaaggaaggctgacagcctggaggtgcagcagatgaaggcccaggcccgggaggagaaggccaggaagcagatggagcggcagaggctggcccgggagaagcagatgagggaggaggccgagaggaccagagatgagctggagcggcggctgctgcagatgaaggaggaggccaccatggccaatgaggccctgatgaggtctgaggaggccgagcaggagatgcagaggatcaaggccacagccatcagaacagaggaggagaagaggctgatggagcagaaggtgctggaggccgaggtgctggccctgaagatggccgaggagagcgagcggcgggccaaggaggccgaccagctgaagcaggacctgcaggaggcccgggaggccgagcggcgggccaagcagaagctgctggagatcgccaccaagcccacctacccacccatgaaccccatcccagcccccctgcccccagacatccccagcttcaacctgattggagacagcctgagctttgacttcaaggacacagacatgaagaggctgtccatggagattgagaaggagaaggtggagtacatggagaagagcaagcacctgcaggagcagctgaatgagctgaagacagaaattgaggccctgaagctgaaggagcgggagacagccctggacatcctgcacaatgaaaattctgaccggggcggcagcagcaagcacaacaccatcaagaagggcatgttcctgttcttcttcatcctcttctgctggttcagcctgaagcccaaggccgaggacctgagcgcctttgagcccagcaacagcccctgccgggcccccagccctgagtggcccagcctgaagagcagcagcaggtag

SEQ ID NO: 20787 - DNA, 1686 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgagatgaagtggaagggcaaggacctgtttgacctggtgtgcaggaccctgggcctgcgggagacctggttcttcggcctgcagtacaccatcaaggacacagtggcctggctgaagatggacaagaaggtgctggaccatgatgtgtccaaggaggagcctgtgaccttccacttcctggccaagttctacccagaaaatgctgaggaggagctggtgcaggagatcacccagcacctgttcttcctgcaggtgaagaagcagatcctggatgagaagatctactgccccccagaggcctctgtgctgctggccagctatgctgtgcaggccaagtacggggactatgaccccagcgtgcacaagaggggcttcctggcccaggaggagctgctgcccaagagggtcatcaacctgtaccagatgaccccagagatgtgggaggagcgcatcacagcctggtatgcagagcaccggggccgggccagagatgaagctgagatggagtacctgaagatcgcccaggacctggagatgtatggagtgaactactttgccatccggaacaagaagggcacagagctgctgctgggcgtggatgccctgggcctgcacatctatgaccctgaaaatcggctgacccccaagatctccttcccctggaatgagatccggaacatctcctacagcgacaaggagttcaccatcaagcccctggacaagaagattgatgtgttcaagttcaacagcagcaagctgcgggtgaacaagctgatcctgcagctgtgcatcggcaaccacgacctcttcatgagaagaaggaaggctgacagcctggaggtgcagcagatgaaggcccaggcccgggaggagaaggccaggaagcagatgaaggaggaggccaccatggccaatgaggccctgatgaggtctgaggagacagctgacctgctggccgagaaggcccagatcacagaggaggaggccaagctgctggcccagaaggctgctgaggccgagcaggagatgcagaggatcaaggccacagccatcagaacagaggaggagaagaggctgatggagcagaaggtgctggaggccgaggtgctggccctgaagatggccgaggagagcgagcggcgggccaaggaggccgaccagctgaagcaggacctgcaggaggcccgggaggccgagcggcgggccaagcagaagctgctggagatcgccaccaagcccacctacccacccatgaaccccatcccagcccccctgcccccagacatccccagcttcaacctgattggagacagcctgagctttgacttcaaggacacagacatgaagaggctgtccatggagattgagaaggagaaggtggagtacatggagaagagcaagcacctgcaggagcagctgaatgagctgaagacagaaattgaggccctgaagctgaaggagcgggagacagccctggacatcctgcacaatgaaaattctgaccggggcggcagcagcaagcacaacaccatcaagaagccccaggcccagggccggcggcccatctgcatctag

SEQ ID NO: 20788 - DNA, 1773 bp, Artificial Sequence; identical to SEQ ID NO: 20782
  Description of Artificial Sequence: Synthetic coding sequence

SEQ ID NO: 20789 - DNA, 498 bp, Artificial Sequence
  Description of Artificial Sequence: Synthetic coding sequence
atggccggggccatcgccagcaggatgtccttcagcagcctgaagaggaagcagcccaagaccttcaccgtgcgcatcgtgaccatggatgctgagatggagttcaactgtgagatgaagtggaagggcaaggacctgtttgacctggtgtgcaggaccctgggcctgcgggagacctggttcttcggcctgcagtacaccatcaaggacacagtggcctggctgaagatggacaagaaggtgctggaccatgatgtgtccaaggaggagcctgtgaccttccacttcctggccaagttctacccagaaaatgctgaggaggagctggtgcaggagatcacccagcacctgttcttcctgcaggtgaagaagcagatcctggatgagaagatctactgccccccagaggcctctgtgctgctggccagctatgctgtgcaggccaagctgaccctgcagagcgccaagagccgggtggccttctttgaggagctgtag

SEQ ID NO: 20790 - DNA, 663 bp, Artificial Sequence; identical to SEQ ID NO: 20780
  Description of Artificial Sequence: Synthetic coding sequence

SEQ ID NO: 20791 - DNA, 2772 bp, Artificial Sequence
  Description of Artificial Sequence: Synthetic coding sequence
atggagcggggcctgcccctgctgtgtgctgtgctggccctggtgctggccccagctggggccttcagaaatgacaagtgtggggacaccatcaagattgagagccctggctacctgaccagccctggctacccccacagctaccaccccagcgagaagtgtgagtggctgatccaggccccagacccctaccagaggatcatgatcaacttcaacccccactttgacctggaggaccgggactgcaagtatgactatgtggaggtgtttgatggagaaaatgaaaatggccacttccggggcaagttctgtgggaagatcgcccctcctcctgtggtgagcagcggccccttcctgttcatcaagtttgtgtctgactatgagacccacggggccggcttcagcatccgctatgagatcttcaagaggggccctgagtgcagccagaactacaccaccccatctggagtcatcaagagccctggcttccctgagaagtaccccaacagcctggagtgcacctacatcgtgtttgtgcccaagatgtctgagatcatcctggagtttgagagctttgacctggagccagacagcaaccccccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagattctgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaagattcctaccgggagtggatccaggtggacctgggcctgctgcgctttgtgacagctgtgggcacccagggcgccatcagcaaggagaccaagaagaagtactacgtgaagacctacaagattgatgtgagcagcaatggagaggactggatcaccatcaaggagggcaacaagcctgtgctcttccagggcaacaccaaccccacagatgtggtggtggccgtgttccccaagcccctcatcaccaggtttgtgcgcatcaagccagccacctgggagaccggcatctccatgagatttgaggtgtatggctgcaagatcacagactacccctgcagcggcatgctgggcatggtgtctggcctcatcagtgacagccagatcaccagcagcaaccagggcgacaggaactggatgcctgagaacatccggctggtgaccagccgcagcggctgggccctgcccccagccccccacagctacatcaatgagtggctgcagattgacctgggggaggagaagatcgtgcggggcatcatcatccagggcggcaagcaccgggagaacaaggtgttcatgaggaagttcaagattggctacagcaacaacggcagtgactggaagatgatcatggatgacagcaagaggaaggccaagagctttgagggcaacaacaactatgacaccccagagctgcggaccttccctgccctgagcacccgcttcatccgcatctacccagagcgggccacccatggaggcctgggcctgaggatggagctgctgggctgtgaggtggaggcccccacagctggccccaccacccccaacggcaacctggtggatgaatgtgatgatgaccaggccaactgccacagcggcactggagatgacttccagctgactggaggcaccaccgtgctggccacagagaagcccaccgtgattgacagcaccatccagagcgagttccccacctacggcttcaactgtgaatttggctggggcagccacaagaccttctgccactgggagcatgacaaccacgtgcagctgaagtggagcgtgctgaccagcaagacaggccccatccaggaccacactggagatggcaacttcatctacagccaggctgatgagaaccagaagggcaaggtggcccggctggtgtcccctgtggtgtacagccagaacagcgcccactgcatgaccttctggtaccacatgagcggcagccacgtgggcaccctgcgggtgaagctgcgctaccagaagccagaggagtatgaccagctggtgtggatggccatcggccaccagggcgaccactggaaggagggccgggtgctgctgcacaagagcctgaagctgtaccaggtgatctttgaaggagaaattggaaaaggaaacctgggcggcattgctgtggatgacatcagcatcaacaaccacatcagccaggaggactgtgccaagccagctgacctggacaagaagaaccctgagatcaagattgatgaaacaggcagcaccccaggctatgaaggagagggggagggggacaagaacatcagcaggaagccaggaaatgtgctgaagaccctggaccccatcctgatcaccatcatcgccatgtctgccctgggcgtgctgctgggcgctgtgtgtggggtggtgctgtactgtgcctgctggcacaacggcatgtctgaaagaaacctgagcgccctggagaactacaactttgagctggtggatggagtgaagctgaagaaggacaagctgaacacccagagcacctacagcgaggcctag

SEQ ID NO: 20792 - DNA, 420 bp, Artificial Sequence
  Description of Artificial Sequence: Synthetic coding sequence
atggatgacagcaagaggaaggccaagagctttgagggcaacaacaactatgacaccccagagctgcggaccttccctgccctgagcacccgcttcatccgcatctacccagagcgggccacccacggcggcctgggcctgaggatggagctgctgggctgtgaggtggaggcccccacagctggccccaccaccccaaatggaaacctggtggatgaatgtgatgatgaccaggccaactgccacagcggcactggagatgacttccagctgaccggcggcaccaccgtgctggccacagagaagcccaccgtcatcgacagcaccatccagagcggcagccgcttcttcaagcaccaccacaagcagcagagcatgaggccccagaacctgcaccacaacagcatcctgctgctgtag

SEQ ID NO: 20793 - DNA, 1926 bp, Artificial Sequence
  Description of Artificial Sequence: Synthetic coding sequence
atggagcggggcctgcccctgctgtgtgctgtgctggccctggtgctggccccagctggggccttcagaaatgacaagtgtggggacaccatcaagattgagagccctggctacctgaccagccctggctacccccacagctaccaccccagcgagaagtgtgagtggctgatccaggccccagacccctaccagaggatcatgatcaacttcaacccccactttgacctggaggaccgggactgcaagtatgactatgtggaggtgtttgatggagaaaatgaaaatggccacttccggggcaagttctgtgggaagatcgcccctcctcctgtggtgagcagcggccccttcctgttcatcaagtttgtgtctgactatgagacccacggggccggcttcagcatccgctatgagatcttcaagaggggccctgagtgcagccagaactacaccaccccatctggagtcatcaagagccctggcttccctgagaagtaccccaacagcctggagtgcacctacatcgtgtttgtgcccaagatgtctgagatcatcctggagtttgagagctttgacctggagccagacagcaaccccccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagattctgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaagattcctaccgggagtggatccaggtggacctgggcctgctgcgctttgtgacagctgtgggcacccagggcgccatcagcaaggagaccaagaagaagtactacgtgaagacctacaagattgatgtgagcagcaatggagaggactggatcaccatcaaggagggcaacaagcctgtgctcttccagggcaacaccaaccccacagatgtggtggtggccgtgttccccaagcccctcatcaccaggtttgtgcgcatcaagccagccacctgggagaccggcatctccatgagatttgaggtgtatggctgcaagatcacagactacccctgcagcggcatgctgggcatggtgtctggcctcatcagtgacagccagatcaccagcagcaaccagggcgacaggaactggatgcctgagaacatccggctggtgaccagccgcagcggctgggccctgcccccagccccccacagctacatcaatgagtggctgcagattgacctgggggaggagaagatcgtgcggggcatcatcatccagggcggcaagcaccgggagaacaaggtgttcatgaggaagttcaagattggctacagcaacaacggcagtgactggaagatgatcatggatgacagcaagaggaaggccaagagctttgagggcaacaacaactatgacaccccagagctgcggaccttccctgccctgagcacccgcttcatccgcatctacccagagcgggccacccatggaggcctgggcctgaggatggagctgctgggctgtgaggtggagggcaccatcaacacagaccaggagtgcccctgtgcccgggccctggccaaggatgccaagaagaagaagcgctgggccgacagcacccactgccgctgtgtgcgcagcatccacggggagatgtggagcagcggcaagggcgtgtgcagcctggatgccaacctgtag

SEQ ID NO: 20794 - DNA, 567 bp, Artificial Sequence
  Description of Artificial Sequence: Synthetic coding sequence
atgtctgagatcatcctggagtttgagagctttgacctggagccagacagcaaccccccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagacagcgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaggacagctaccgggagtggatccaggatgccaagtaccgcctgcgggtgtctgtggtgcgcagcaagagcagcagcagcagcaccagcctggagccccggcccctgagcagcctgaagctgtccttcttctcctacaagatcaagatcacctag

SEQ ID NO: 20795 - DNA, 1830 bp, Artificial Sequence
  Description of Artificial Sequence: Synthetic coding sequence
atggagcggggcctgcccctgctgtgtgctgtgctggccctggtgctggccccagctggggccttcagaaatgacaagtgtggggacaccatcaagattgagagccctggctacctgaccagccctggctacccccacagctaccaccccagcgagaagtgtgagtggctgatccaggccccagacccctaccagaggatcatgatcaacttcaacccccactttgacctggaggaccgggactgcaagtatgactatgtggaggtgtttgatggagaaaatgaaaatggccacttccggggcaagttctgtgggaagatcgcccctcctcctgtggtgagcagcggccccttcctgttcatcaagtttgtgtctgactatgagacccacggggccggcttcagcatccgctatgagatcttcaagaggggccctgagtgcagccagaactacaccaccccatctggagtcatcaagagccctggcttccctgagaagtaccccaacagcctggagtgcacctacatcgtgtttgtgcccaagatgtctgagatcatcctggagtttgagagctttgacctggagccagacagcaaccccccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagattctgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaagattcctaccgggagtggatccaggtggacctgggcctgctgcgctttgtgacagctgtgggcacccagggcgccatcagcaaggagaccaagaagaagtactacgtgaagacctacaagattgatgtgagcagcaatggagaggactggatcaccatcaaggagggcaacaagcctgtgctcttccagggcaacaccaaccccacagatgtggtggtggccgtgttccccaagcccctcatcaccaggtttgtgcgcatcaagccagccacctgggagaccggcatctccatgagatttgaggtgtatggctgcaagatcacagactacccctgcagcggcatgctgggcatggtgtctggcctcatcagtgacagccagatcaccagcagcaaccagggcgacaggaactggatgcctgagaacatccggctggtgaccagccgcagcggctgggccctgcccccagccccccacagctacatcaatgagtggctgcagattgacctgggggaggagaagatcgtgcggggcatcatcatccagggcggcaagcaccgggagaacaaggtgttcatgaggaagttcaagattggctacagcaacaacggcagtgactggaagatgatcatggatgacagcaagaggaaggccaagagctttgagggcaacaacaactatgacaccccagagctgcggaccttccctgccctgagcacccgcttcatccgcatctacccagagcgggccacccatggaggcctgggcctgaggatggagctgctgggctgtgaggtggagggcggcaccaccgtgctggccacagagaagcccaccgtcatcgacagcaccatccagagcggcatcaagtag

SEQ ID NO: 20796 - DNA, 1935 bp, Artificial Sequence
  Description of Artificial Sequence: Synthetic coding sequence
atggagcggggcctgcccctgctgtgtgctgtgctggccctggtgctggccccagctggggccttcagaaatgacaagtgtggggacaccatcaagattgagagccctggctacctgaccagccctggctacccccacagctaccaccccagcgagaagtgtgagtggctgatccaggccccagacccctaccagaggatcatgatcaacttcaacccccactttgacctggaggaccgggactgcaagtatgactatgtggaggtgtttgatggagaaaatgaaaatggccacttccggggcaagttctgtgggaagatcgcccctcctcctgtggtgagcagcggccccttcctgttcatcaagtttgtgtctgactatgagacccacggggccggcttcagcatccgctatgagatcttcaagaggggccctgagtgcagccagaactacaccaccccatctggagtcatcaagagccctggcttccctgagaagtaccccaacagcctggagtgcacctacatcgtgtttgtgcccaagatgtctgagatcatcctggagtttgagagctttgacctggagccagacagcaaccccccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagattctgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaagattcctaccgggagtggatccaggtggacctgggcctgctgcgctttgtgacagctgtgggcacccagggcgccatcagcaaggagaccaagaagaagtactacgtgaagacctacaagattgatgtgagcagcaatggagaggactggatcaccatcaaggagggcaacaagcctgtgctcttccagggcaacaccaaccccacagatgtggtggtggccgtgttccccaagcccctcatcaccaggtttgtgcgcatcaagccagccacctgggagaccggcatctccatgagatttgaggtgtatggctgcaagatcacagactacccctgcagcggcatgctgggcatggtgtctggcctcatcagtgacagccagatcaccagcagcaaccagggcgacaggaactggatgcctgagaacatccggctggtgaccagccgcagcggctgggccctgcccccagccccccacagctacatcaatgagtggctgcagattgacctgggggaggagaagatcgtgcggggcatcatcatccagggcggcaagcaccgggagaacaaggtgttcatgaggaagttcaagattggctacagcaacaacggcagtgactggaagatgatcatggatgacagcaagaggaaggccaagagctttgagggcaacaacaactatgacaccccagagctgcggaccttccctgccctgagcacccgcttcatccgcatctacccagagcgggccacccatggaggcctgggcctgaggatggagctgctgggctgtgaggtggaggcccccacagctggccccaccacccccaacggcaacctggtggatgaatgtgatgatgaccaggccaactgccacagcggcactggagatgacttccagctgactggaggcaccaccgtgctggccacagagaagcccaccgtgattgacagcaccatccagagcggcatcaagtag

SEQ ID NO: 20797 - DNA, 2115 bp, Artificial Sequence
  Description of Artificial Sequence: Synthetic coding sequence
atggagcggggcctgcccctgctgtgtgctgtgctggccctggtgctggccccagctggggccttcagaaatgacaagtgtggggacaccatcaagattgagagccctggctacctgaccagccctggctacccccacagctaccaccccagcgagaagtgtgagtggctgatccaggccccagacccctaccagaggatcatgatcaacttcaacccccactttgacctggaggaccgggactgcaagtatgactatgtggaggtgtttgatggagaaaatgaaaatggccacttccggggcaagttctgtgggaagatcgcccctcctcctgtggtgagcagcggccccttcctgttcatcaagtttgtgtctgactatgagacccacggggccggcttcagcatccgctatgagatcttcaagaggggccctgagtgcagccagaactacaccaccccatctggagtcatcaagagccctggcttccctgagaagtaccccaacagcctggagtgcacctacatcgtgtttgtgcccaagatgtctgagatcatcctggagtttgagagctttgacctggagccagacagcaaccccccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagattctgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaagattcctaccgggagtggatccaggtggacctgggcctgctgcgctttgtgacagctgtgggcacccagggcgccatcagcaaggagaccaagaagaagtactacgtgaagacctacaagattgatgtgagcagcaatggagaggactggatcaccatcaaggagggcaacaagcctgtgctcttccagggcaacaccaaccccacagatgtggtggtggccgtgttccccaagcccctcatcaccaggtttgtgcgcatcaagccagccacctgggagaccggcatctccatgagatttgaggtgtatggctgcaagatcacagactacccctgcagcggcatgctgggcatggtgtctggcctcatcagtgacagccagatcaccagcagcaaccagggcgacaggaactggatgcctgagaacatccggctggtgaccagccgcagcggctgggccctgcccccagccccccacagctacatcaatgagtggctgcagattgacctgggggaggagaagatcgtgcggggcatcatcatccagggcggcaagcaccgggagaacaaggtgttcatgaggaagttcaagattggctacagcaacaacggcagtgactggaagatgatcatggatgacagcaagaggaaggccaagagctttgagggcaacaacaactatgacaccccagagctgcggaccttccctgccctgagcacccgcttcatccgcatctacccagagcgggccacccatggaggcctgggcctgaggatggagctgctgggctgtgaggtggaggcccccacagctggccccaccacccccaacggcaacctggtggatgaatgtgatgatgaccaggccaactgccacagcggcactggagatgacttccagctgactggagctgagaccatcttcatccccctgctgtaccacttcagcagctgcctgtcctgggaccagctgacccctgtgtgtgtgctggtgacccctcatggccgggagctgcccaggaacagaagctgcctggcccggacccgggccagcagcttcccccacgtgatctggattgatgagctgttcctgattgccaccaccatctgcaacaacaacctgagccactttgagagccagaggctgggcctgtcctag

SEQ ID NO: 20798 - DNA, 261 bp, Artificial Sequence
  Description of Artificial Sequence: Synthetic coding sequence
atggagctgctgggctgtgaggtggaggcccccacagctggccccaccaccccaaatggaaacctggtggatgaatgtgatgatgaccaggccaactgccacagcggcactggagatgacttccagctgaccggcggcaccaccgtgctggccacagagaagcccaccgtcatcgacagcaccatccagagcgcccggctggaggtgtccaccctgaacctgagcctgcacaaccccccccagcagaaggccctgatctag

SEQ ID NO: 20799 - DNA, 2772 bp, Artificial Sequence; identical to SEQ ID NO: 20791
  Description of Artificial Sequence: Synthetic coding sequence

SEQ ID NO: 20800 - DNA, 2208 bp, Artificial Sequence
  Description of Artificial Sequence: Synthetic coding sequence
atgtctgagatcatcctggagtttgagagctttgacctggagccagacagcaaccccccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagacagcgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaggacagctaccgggagtggatccaggtggacctgggcctgctgcgctttgtgacagctgtgggcacccagggcgccatcagcaaggagaccaagaagaagtactacgtgaagacctacaagattgatgtgagcagcaatggagaggactggatcaccatcaaggagggcaacaagcctgtgctcttccagggcaacaccaaccccacagatgtggtggtggccgtgttccccaagcccctcatcaccaggtttgtgcgcatcaagccagccacctgggagaccggcatctccatgagatttgaggtgtatggctgcaagatcacagactacccctgcagcggcatgctgggcatggtgtctggcctcatcagtgacagccagatcaccagcagcaaccagggcgacaggaactggatgcctgagaacatccggctggtgaccagccgcagcggctgggccctgcccccagccccccacagctacatcaatgagtggctgcagattgacctgggggaggagaagatcgtgcggggcatcatcatccagggcggcaagcaccgggagaacaaggtgttcatgaggaagttcaagattggctacagcaacaatggaagtgactggaagatgatcatggatgacagcaagaggaaggccaagagctttgagggcaacaacaactatgacaccccagagctgcggaccttccctgccctgagcacccgcttcatccgcatctacccagagcgggccacccacggcggcctgggcctgaggatggagctgctgggctgtgaggtggaggcccccacagctggccccaccaccccaaatggaaacctggtggatgaatgtgatgatgaccaggccaactgccacagcggcactggaggcaccaccgtgctggccacagagaagcccaccgtgattgacagcaccatccagagcgagttccccacctacggcttcaactgtgaatttggctggggcagccacaagaccttctgccactgggagcatgacaaccacgtgcagctgaagtggagcgtgctgaccagcaagacaggccccatccaggaccacactggagatggcaacttcatctacagccaggctgatgagaaccagaagggcaaggtggcccggctggtgtcccctgtggtgtacagccagaacagcgcccactgcatgaccttctggtaccacatgagcggcagccacgtgggcaccctgcgggtgaagctgcgctaccagaagccagaggagtatgaccagctggtgtggatggccatcggccaccagggcgaccactggaaggagggccgggtgctgctgcacaagagcctgaagctgtaccaggtgatctttgaaggagaaattggaaaaggaaacctgggcggcattgctgtggatgacatcagcatcaacaaccacatcagccaggaggactgtgccaagccagctgacctggacaagaagaaccctgagatcaagattgatgaaacaggcagcaccccaggctatgaaggagagggggagggggacaagaacatcagcaggaagccaggaaatgtgctgaagaccctggaccccatcctgatcaccatcatcgccatgtctgccctgggcgtgctgctgggcgctgtgtgtggggtggtgctgtactgtgcctgctggcacaacggcatgtctgaaagaaacctgagcgccctggagaactacaactttgagctggtggatggagtgaagctgaagaaggacaagctgaacacccagagcacctacagcgaggcctag

SEQ ID NO: 20801 - DNA, 2721 bp, Artificial Sequence
  Description of Artificial Sequence: Synthetic coding sequence
atggagcggggcctgcccctgctgtgtgctgtgctggccctggtgctggccccagctggggccttcagaaatgacaagtgtggggacaccatcaagattgagagccctggctacctgaccagccctggctacccccacagctaccaccccagcgagaagtgtgagtggctgatccaggccccagacccctaccagaggatcatgatcaacttcaacccccactttgacctggaggaccgggactgcaagtatgactatgtggaggtgtttgatggagaaaatgaaaatggccacttccggggcaagttctgtgggaagatcgcccctcctcctgtggtgagcagcggccccttcctgttcatcaagtttgtgtctgactatgagacccacggggccggcttcagcatccgctatgagatcttcaagaggggccctgagtgcagccagaactacaccaccccatctggagtcatcaagagccctggcttccctgagaagtaccccaacagcctggagtgcacctacatcgtgtttgtgcccaagatgtctgagatcatcctggagtttgagagctttgacctggagccagacagcaaccccccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagattctgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaagattcctaccgggagtggatccaggtggacctgggcctgctgcgctttgtgacagctgtgggcacccagggcgccatcagcaaggagaccaagaagaagtactacgtgaagacctacaagattgatgtgagcagcaatggagaggactggatcaccatcaaggagggcaacaagcctgtgctcttccagggcaacaccaaccccacagatgtggtggtggccgtgttccccaagcccctcatcaccaggtttgtgcgcatcaagccagccacctgggagaccggcatctccatgagatttgaggtgtatggctgcaagatcacagactacccctgcagcggcatgctgggcatggtgtctggcctcatcagtgacagccagatcaccagcagcaaccagggcgacaggaactggatgcctgagaacatccggctggtgaccagccgcagcggctgggccctgcccccagccccccacagctacatcaatgagtggctgcagattgacctgggggaggagaagatcgtgcggggcatcatcatccagggcggcaagcaccgggagaacaaggtgttcatgaggaagttcaagattggctacagcaacaacggcagtgactggaagatgatcatggatgacagcaagaggaaggccaagagctttgagggcaacaacaactatgacaccccagagctgcggaccttccctgccctgagcacccgcttcatccgcatctacccagagcgggccacccatggaggcctgggcctgaggatggagctgctgggctgtgaggtggaggcccccacagctggccccaccacccccaacggcaacctggtggatgaatgtgatgatgaccaggccaactgccacagcggcactggagatgacttccagctgactggaggcaccaccgtgctggccacagagaagcccaccgtgattgacagcaccatccagagcgagttccccacctacggcttcaactgtgaatttggctggggcagccacaagaccttctgccactgggagcatgacaaccacgtgcagctgaagtggagcgtgctgaccagcaagacaggccccatccaggaccacactggagatggcaacttcatctacagccaggctgatgagaaccagaagggcaaggtggcccggctggtgtcccctgtggtgtacagccagaacagcgcccactgcatgaccttctggtaccacatgagcggcagccacgtgggcaccctgcgggtgaagctgcgctaccagaagccagaggagtatgaccagctggtgtggatggccatcggccaccagggcgaccactggaaggagggccgggtgctgctgcacaagagcctgaagctgtaccaggtgatctttgaaggagaaattggaaaaggaaacctgggcggcattgctgtggatgacatcagcatcaacaaccacatcagccaggaggactgtgcccggagcaccccaggctatgaaggagagggggagggggacaagaacatcagcaggaagccaggaaatgtgctgaagaccctggaccccatcctgatcaccatcatcgccatgtctgccctgggcgtgctgctgggcgctgtgtgtggggtggtgctgtactgtgcctgctggcacaacggcatgtctgagaggaacctgagcgccctggagaactacaactttgagctggtggatggagtgaagctgaagaaggacaagctgaacacccagagcacctacagcgaggcctag

SEQ ID NO: 20802 - DNA, 318 bp, Artificial Sequence
  Description of Artificial Sequence: Synthetic coding sequence
aaccacatcagccaggaggactgtgcccggagcaccccaggctatgaaggagagggggagggggacaagaacatcagcaggaagccaggaaatgtgctgaagaccctggaccccatcctgatcaccatcatcgccatgtctgccctgggcgtgctgctgggcgctgtgtgtggggtggtgctgtactgtgcctgctggcacaacggcatgtctgaaagaaacctgagcgccctggagaactacaactttgagctggtggatggagtgaagctgaagaaggacaagctgaacacccagagcacctacagcgaggcctag

SEQ ID NO: 20803 - DNA, 234 bp, Artificial Sequence
  Description of Artificial Sequence: Synthetic coding sequence
tgacccacagctggccccaccacccccaacggcaacctggtggatgaatgtgatgatgaccaggccaactgccacagcggcactggagatgacttccagctgactggaggcaccaccgtgctggccacagagaagcccaccgtgattgacagcaccatccagagcgcccggctggaggtgtccaccctgaacctgagcctgcacaaccccccccagcagaaggccctgatctag

SEQ ID NO: 20804 - DNA, 303 bp, Artificial Sequence
  Description of Artificial Sequence: Synthetic coding sequence
tgaacacatggaggcctgggcctgaggatggagctgctgggctgtgaggtggaggcccccacagctggccccaccacccccaacggcaacctggtggatgaatgtgatgatgaccaggccaactgccacagcggcactggagatgacttccagctgactggaggcaccaccgtgctggccacagagaagcccaccgtgattgacagcaccatccagagcggcagccgcttcttcaagcaccaccacaagcagcagagcatgaggccccagaacctgcaccacaacagcatcctgctgctgtag

SEQ ID NO: 20805 - DNA, 711 bp, Artificial Sequence
  Description of Artificial Sequence: Synthetic coding sequence
gtggacctgggcctgctgcgctttgtgacagctgtgggcacccagggcgccatcagcaaggagaccaagaagaagtactacgtgaagacctacaagattgatgtgagcagcaatggagaggactggatcaccatcaaggagggcaacaagcctgtgctcttccagggcaacaccaaccccacagatgtggtggtggccgtgttccccaagcccctcatcaccaggtttgtgcgcatcaagccagccacctgggagaccggcatctccatgagatttgaggtgtatggctgcaagatcacagactacccctgcagcggcatgctgggcatggtgtctggcctcatcagtgacagccagatcaccagcagcaaccagggcgacaggaactggatgcctgagaacatccggctggtgaccagccgcagcggctgggccctgcccccagccccccacagctacatcaatgagtggctgcagattgacctgggggaggagaagatcgtgcggggcatcatcatccagggcggcaagcaccgggagaacaaggtgttcatgaggaagttcaagattggctacagcaacaatggaagtgactggaagatgatcatggatgacagcaagaggaaggccaaggtgcgggccggggactgggaggaggtgatcccctacgtgctggacttcaaccagggccccctggccttcagcaggtag

SEQ ID NO: 20806 - DNA, 513 bp, Artificial Sequence
  Description of Artificial Sequence: Synthetic coding sequence
tgaccaggcggcatgttctgccgctatgaccggctggagatctgggatggcttcccagatgtgggcccccacatcggccgctactgcggccagaagaccccaggccgcatccgcagcagcagcggcatcctgtccatggtgttctacacagacagcgccatcgccaaggagggcttcagcgccaactacagcgtgctgcagagctctgtgtctgaggacttcaagtgcatggaggccctgggcatggagagcggggagatccacagcgaccagatcacagccagcagccagtacagcaccaactggagcgctgagaggagccggctgaactacccagaaaatggctggaccccaggagaggacagctaccgggagtggatccaggatgccaagtaccgcctgcgggtgtctgtggtgcgcagcaagagcagcagcagcagcaccagcctggagccccggcccctgagcagcctgaagctgtccttcttctcctacaagatcaagatcacctag

SEQ ID NO: 20807 - DNA, 2721 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggcaagcactgcggcaacatcgccccacccaccatcatcagcagcggctccatgctgtacatccgcttcaccagtgactatgcccggcagggcgccggcttcagcctgcgctatgagatcttcaagacaggcagcgaggactgcagcaagaacttcaccagccccaacggcaccatcgagagccctggcttccctgagaagtacccccacaacctggactgcaccttcaccatcctggccaagcccaagatggagatcatcctgcagttcctgatctttgacctggagcatgaccccctgcaggtgggggagggggactgcaagtatgactggctggacatctgggatggcatcccccacgtgggccccctcatcggcaagtactgcggcaccaagacccccagcgagctgcggagcagcacaggcatcctgagcctgaccttccacacagacatggctgtggccaaggatggcttcagcgcccgctactacctggtgcaccaggagcccctggagaacttccagtgcaatgtgcccctgggcatggagagcggccgcatcgccaatgagcagatcagcgccagcagcacctacagtgatggccgctggaccccccagcagagccggctgcatggagatgacaatggctggacccccaacctggacagcaacaaggagtacctgcaggtggacctgcgcttcctgaccatgctgacagccatcgccacccagggcgccatcagccgggagacccagaatggctactacgtgaagagctacaagctggaggtgtccaccaacggggaggactggatggtgtacagacatggcaagaaccacaaggtgttccaggccaacaatgatgccacagaggtggtgctgaacaagctgcacgcccccctgctgaccaggtttgtgcgcatccggccccagacctggcacagcggcatcgccctgcggctggagctgtttggctgccgggtgacagatgccccctgcagcaacatgctgggcatgctgagcggcctgattgctgacagccagatcagcgccagcagcacccaggagtacctgtggagccccagcgctgcccggctggtgagcagccgcagcggctggttcccccgcatcccccaggcccagcctggagaggagtggctgcaggtggacctgggcacccccaagacagtgaagggcgtcatcatccagggcgcccggggcggggacagcatcacagctgtggaggcccgggcctttgtgaggaagttcaaggtgtcctacagcctgaatggcaaggactgggagtacatccaggaccccaggacccagcagcccaagctgtttgagggcaacatgcactatgacaccccagacatcagaagatttgaccccatcccagcccagtatgtgcgggtgtacccagagcgctggagccctgctggcatcggcatgaggctggaggtgctgggctgtgactggacagacagcaagcccaccgtggagaccctgggccccaccgtgaagtctgaggagaccaccaccccctaccccacagaggaggaggccacagaatgtggggagaactgcagctttgaagatgacaaggacctgcagctgcccagcggcttcaactgcaactttgacttcctggaggagccctgtggctggatgtatgaccacgccaagtggctgcggaccacctgggccagcagcagcagccccaatgacaggaccttcccagatgacaggaacttcctgcggctgcagagcgacagccagcgggagggccagtatgcccggctcatcagcccccctgtgcacctgcccaggagccctgtgtgcatggagttccagtaccaggccactggaggccggggcgtggccctgcaggtggtgcgggaggccagccaggagagcaagctgctgtgggtgatccgggaggaccagggcggggagtggaagcacggccgcatcatcctgcccagctatgacatggagtaccagatcgtgtttgagggcgtcatcggcaagggccgctctggagagatcgccattgatgacatccgcatcagcacagatgtgcccctggagaactgcatggagcccatcagcgcctttgctggggagaacttcaagggcggcaccctgctgcctggaacagagcccaccgtggacacagtgcccatgcagcccatcccagcctactggtactacgtgatggctgctggaggagctgtgctggtgctggtgtctgtggccctggccctggtgctgcactaccaccgcttccgctatgctgccaagaagacagaccacagcatcacctacaagaccagccactacaccaacggggcccccctggccgtggagcccaccctgaccatcaagctggagcaggaccggggcagccactgctag

SEQ ID NO: 20808 - DNA, 300 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaacctgctgagcgcctggaagatcagcctgaccagccgcagctttgcctag

SEQ ID NO: 20809 - DNA, 1668 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggcaagcactgcggcaacatcgccccacccaccatcatcagcagcggctccatgctgtacatccgcttcaccagtgactatgcccggcagggcgccggcttcagcctgcgctatgagatcttcaagacaggcagcgaggactgcagcaagaacttcaccagccccaacggcaccatcgagagccctggcttccctgagaagtacccccacaacctggactgcaccttcaccatcctggccaagcccaagatggagatcatcctgcagttcctgatctttgacctggagcatgaccccctgcaggtgggggagggggactgcaagtatgactggctggacatctgggatggcatcccccacgtgggccccctcatcggcaagtactgcggcaccaagacccccagcgagctgcggagcagcacaggcatcctgagcctgaccttccacacagacatggctgtggccaaggatggcttcagcgcccgctactacctggtgcaccaggagcccctggagaacttccagtgcaatgtgcccctgggcatggagagcggccgcatcgccaatgagcagatcagcgccagcagcacctacagtgatggccgctggaccccccagcagagccggctgcatggagatgacaatggctggacccccaacctggacagcaacaaggagtacctgcaggtggacctgcgcttcctgaccatgctgacagccatcgccacccagggcgccatcagccgggagacccagaatggctactacgtgaagagctacaagctggaggtgtccaccaacggggaggactggatggtgtacagacatggcaagaaccacaaggtgttccaggccaacaatgatgccacagaggtggtgctgaacaagctgcacgcccccctgctgaccaggtttgtgcgcatccggccccagacctggcacagcggcatcgccctgcggctggagctgtttggctgccgggtgacagatgccccctgcagcaacatgctgggcatgctgagcggcctgattgctgacagccagatcagcgccagcagcacccaggagtacctgtggagccccagcgctgcccggctggtgagcagccgcagcggctggttcccccgcatcccccaggcccagcctggagaggagtggctgcaggtggacctgggcacccccaagacagtgaagggcgtcatcatccagggcgcccggggcggggacagcatcacagctgtggaggcccgggcctttgtgaggaagttcaaggtgtcctacagcctgaatggcaaggactgggagtacatccaggaccccaggacccagcagcccaaggtgggctgctcctggaggcccctgtag

SEQ ID NO: 20810 - DNA, 2706 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggcaagcactgcggcaacatcgccccacccaccatcatcagcagcggctccatgctgtacatccgcttcaccagtgactatgcccggcagggcgccggcttcagcctgcgctatgagatcttcaagacaggcagcgaggactgcagcaagaacttcaccagccccaacggcaccatcgagagccctggcttccctgagaagtacccccacaacctggactgcaccttcaccatcctggccaagcccaagatggagatcatcctgcagttcctgatctttgacctggagcatgaccccctgcaggtgggggagggggactgcaagtatgactggctggacatctgggatggcatcccccacgtgggccccctcatcggcaagtactgcggcaccaagacccccagcgagctgcggagcagcacaggcatcctgagcctgaccttccacacagacatggctgtggccaaggatggcttcagcgcccgctactacctggtgcaccaggagcccctggagaacttccagtgcaatgtgcccctgggcatggagagcggccgcatcgccaatgagcagatcagcgccagcagcacctacagtgatggccgctggaccccccagcagagccggctgcatggagatgacaatggctggacccccaacctggacagcaacaaggagtacctgcaggtggacctgcgcttcctgaccatgctgacagccatcgccacccagggcgccatcagccgggagacccagaatggctactacgtgaagagctacaagctggaggtgtccaccaacggggaggactggatggtgtacagacatggcaagaaccacaaggtgttccaggccaacaatgatgccacagaggtggtgctgaacaagctgcacgcccccctgctgaccaggtttgtgcgcatccggccccagacctggcacagcggcatcgccctgcggctggagctgtttggctgccgggtgacagatgccccctgcagcaacatgctgggcatgctgagcggcctgattgctgacagccagatcagcgccagcagcacccaggagtacctgtggagccccagcgctgcccggctggtgagcagccgcagcggctggttcccccgcatcccccaggcccagcctggagaggagtggctgcaggtggacctgggcacccccaagacagtgaagggcgtcatcatccagggcgcccggggcggggacagcatcacagctgtggaggcccgggcctttgtgaggaagttcaaggtgtcctacagcctgaatggcaaggactgggagtacatccaggaccccaggacccagcagcccaagctgtttgagggcaacatgcactatgacaccccagacatcagaagatttgaccccatcccagcccagtatgtgcgggtgtacccagagcgctggagccctgctggcatcggcatgaggctggaggtgctgggctgtgactggacagacagcaagcccaccgtggagaccctgggccccaccgtgaagtctgaggagaccaccaccccctaccccacagaggaggaggccacagaatgtggggagaactgcagctttgaagatgacaaggacctgcagctgcccagcggcttcaactgcaactttgacttcctggaggagccctgtggctggatgtatgaccacgccaagtggctgcggaccacctgggccagcagcagcagccccaatgacaggaccttcccagatgacaggaacttcctgcggctgcagagcgacagccagcgggagggccagtatgcccggctcatcagcccccctgtgcacctgcccaggagccctgtgtgcatggagttccagtaccaggccactggaggccggggcgtggccctgcaggtggtgcgggaggccagccaggagagcaagctgctgtgggtgatccgggaggaccagggcggggagtggaagcacggccgcatcatcctgcccagctatgacatggagtaccagatcgtgtttgagggcgtcatcggcaagggccgctctggagagatcgccattgatgacatccgcatcagcacagatgtgcccctggagaactgcatggagcccatcagcgcctttgctgggggcaccctgctgcccggcacagagcccaccgtggacacagtgcccatgcagcccatcccagcctactggtactacgtgatggccgccggcggcgctgtgctggtgctggtgtctgtggccctggccctggtgctgcactaccaccgcttccgctatgctgccaagaagacagaccacagcatcacctacaagaccagccactacaccaatggagcccccctggccgtggagcccaccctgaccatcaagctggagcaggaccggggcagccactgctag

SEQ ID NO: 20811 - DNA, 2781 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggcaagcactgcggcaacatcgccccacccaccatcatcagcagcggctccatgctgtacatccgcttcaccagtgactatgcccggcagggcgccggcttcagcctgcgctatgagatcttcaagacaggcagcgaggactgcagcaagaacttcaccagccccaacggcaccatcgagagccctggcttccctgagaagtacccccacaacctggactgcaccttcaccatcctggccaagcccaagatggagatcatcctgcagttcctgatctttgacctggagcatgaccccctgcaggtgggggagggggactgcaagtatgactggctggacatctgggatggcatcccccacgtgggccccctcatcggcaagtactgcggcaccaagacccccagcgagctgcggagcagcacaggcatcctgagcctgaccttccacacagacatggctgtggccaaggatggcttcagcgcccgctactacctggtgcaccaggagcccctggagaacttccagtgcaatgtgcccctgggcatggagagcggccgcatcgccaatgagcagatcagcgccagcagcacctacagtgatggccgctggaccccccagcagagccggctgcatggagatgacaatggctggacccccaacctggacagcaacaaggagtacctgcaggtggacctgcgcttcctgaccatgctgacagccatcgccacccagggcgccatcagccgggagacccagaatggctactacgtgaagagctacaagctggaggtgtccaccaacggggaggactggatggtgtacagacatggcaagaaccacaaggtgttccaggccaacaatgatgccacagaggtggtgctgaacaagctgcacgcccccctgctgaccaggtttgtgcgcatccggccccagacctggcacagcggcatcgccctgcggctggagctgtttggctgccgggtgacagatgccccctgcagcaacatgctgggcatgctgagcggcctgattgctgacagccagatcagcgccagcagcacccaggagtacctgtggagccccagcgctgcccggctggtgagcagccgcagcggctggttcccccgcatcccccaggcccagcctggagaggagtggctgcaggtggacctgggcacccccaagacagtgaagggcgtcatcatccagggcgcccggggcggggacagcatcacagctgtggaggcccgggcctttgtgaggaagttcaaggtgtcctacagcctgaatggcaaggactgggagtacatccaggaccccaggacccagcagcccaagctgtttgagggcaacatgcactatgacaccccagacatcagaagatttgaccccatcccagcccagtatgtgcgggtgtacccagagcgctggagccctgctggcatcggcatgaggctggaggtgctgggctgtgactggacagacagcaagcccaccgtggagaccctgggccccaccgtgaagtctgaggagaccaccaccccctaccccacagaggaggaggccacagaatgtggggagaactgcagctttgaagatgacaaggacctgcagctgcccagcggcttcaactgcaactttgacttcctggaggagccctgtggctggatgtatgaccacgccaagtggctgcggaccacctgggccagcagcagcagccccaatgacaggaccttcccagatgacaggaacttcctgcggctgcagagcgacagccagcgggagggccagtatgcccggctcatcagcccccctgtgcacctgcccaggagccctgtgtgcatggagttccagtaccaggccactggaggccggggcgtggccctgcaggtggtgcgggaggccagccaggagagcaagctgctgtgggtgatccgggaggaccagggcggggagtggaagcacggccgcatcatcctgcccagctatgacatggagtaccagatcgtgtttgagggcgtcatcggcaagggccgctctggagagatcgccattgatgacatccgcatcagcacagatgtgcccctggagaactgcatggagcccatcagcgcctttgctgtggacatccctgagatccacgagcgggagggctatgaagatgaaattgatgatgaatatgaggtggactggagcaacagcagcagcgccaccagcggcagcggggcccccagcacagacaaggagaagtcctggctgtacaccctggaccccatcctgatcaccatcatcgccatgagcagcctgggcgtgctgctgggcgccacctgtgccggcctgctgctgtactgcacctgcagctacagcggcctgagcagccgcagctgcaccaccctggagaactacaactttgagctgtatgatggcctgaagcacaaggtgaagatgaaccaccagaagtgctgcagcgaggcctag

SEQ ID NO: 20812 - DNA, 2796 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggcaagcactgcggcaacatcgccccacccaccatcatcagcagcggctccatgctgtacatccgcttcaccagtgactatgcccggcagggcgccggcttcagcctgcgctatgagatcttcaagacaggcagcgaggactgcagcaagaacttcaccagccccaacggcaccatcgagagccctggcttccctgagaagtacccccacaacctggactgcaccttcaccatcctggccaagcccaagatggagatcatcctgcagttcctgatctttgacctggagcatgaccccctgcaggtgggggagggggactgcaagtatgactggctggacatctgggatggcatcccccacgtgggccccctcatcggcaagtactgcggcaccaagacccccagcgagctgcggagcagcacaggcatcctgagcctgaccttccacacagacatggctgtggccaaggatggcttcagcgcccgctactacctggtgcaccaggagcccctggagaacttccagtgcaatgtgcccctgggcatggagagcggccgcatcgccaatgagcagatcagcgccagcagcacctacagtgatggccgctggaccccccagcagagccggctgcatggagatgacaatggctggacccccaacctggacagcaacaaggagtacctgcaggtggacctgcgcttcctgaccatgctgacagccatcgccacccagggcgccatcagccgggagacccagaatggctactacgtgaagagctacaagctggaggtgtccaccaacggggaggactggatggtgtacagacatggcaagaaccacaaggtgttccaggccaacaatgatgccacagaggtggtgctgaacaagctgcacgcccccctgctgaccaggtttgtgcgcatccggccccagacctggcacagcggcatcgccctgcggctggagctgtttggctgccgggtgacagatgccccctgcagcaacatgctgggcatgctgagcggcctgattgctgacagccagatcagcgccagcagcacccaggagtacctgtggagccccagcgctgcccggctggtgagcagccgcagcggctggttcccccgcatcccccaggcccagcctggagaggagtggctgcaggtggacctgggcacccccaagacagtgaagggcgtcatcatccagggcgcccggggcggggacagcatcacagctgtggaggcccgggcctttgtgaggaagttcaaggtgtcctacagcctgaatggcaaggactgggagtacatccaggaccccaggacccagcagcccaagctgtttgagggcaacatgcactatgacaccccagacatcagaagatttgaccccatcccagcccagtatgtgcgggtgtacccagagcgctggagccctgctggcatcggcatgaggctggaggtgctgggctgtgactggacagacagcaagcccaccgtggagaccctgggccccaccgtgaagtctgaggagaccaccaccccctaccccacagaggaggaggccacagaatgtggggagaactgcagctttgaagatgacaaggacctgcagctgcccagcggcttcaactgcaactttgacttcctggaggagccctgtggctggatgtatgaccacgccaagtggctgcggaccacctgggccagcagcagcagccccaatgacaggaccttcccagatgacaggaacttcctgcggctgcagagcgacagccagcgggagggccagtatgcccggctcatcagcccccctgtgcacctgcccaggagccctgtgtgcatggagttccagtaccaggccactggaggccggggcgtggccctgcaggtggtgcgggaggccagccaggagagcaagctgctgtgggtgatccgggaggaccagggcggggagtggaagcacggccgcatcatcctgcccagctatgacatggagtaccagatcgtgtttgagggcgtcatcggcaagggccgctctggagagatcgccattgatgacatccgcatcagcacagatgtgcccctggagaactgcatggagcccatcagcgcctttgctggggagaacttcaaggtggacatccctgagatccacgagcgggagggctatgaagatgaaattgatgatgaatatgaggtggactggagcaacagcagcagcgccaccagcggcagcggggcccccagcacagacaaggagaagtcctggctgtacaccctggaccccatcctgatcaccatcatcgccatgagcagcctgggcgtgctgctgggcgccacctgtgccggcctgctgctgtactgcacctgcagctacagcggcctgagcagccgcagctgcaccaccctggagaactacaactttgagctgtatgatggcctgaagcacaaggtgaagatgaaccaccagaagtgctgcagcgaggcctag

SEQ ID NO: 20813 - DNA, 2730 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggcaagcactgcggcaacatcgccccacccaccatcatcagcagcggctccatgctgtacatccgcttcaccagtgactatgcccggcagggcgccggcttcagcctgcgctatgagatcttcaagacaggcagcgaggactgcagcaagaacttcaccagccccaacggcaccatcgagagccctggcttccctgagaagtacccccacaacctggactgcaccttcaccatcctggccaagcccaagatggagatcatcctgcagttcctgatctttgacctggagcatgaccccctgcaggtgggggagggggactgcaagtatgactggctggacatctgggatggcatcccccacgtgggccccctcatcggcaagtactgcggcaccaagacccccagcgagctgcggagcagcacaggcatcctgagcctgaccttccacacagacatggctgtggccaaggatggcttcagcgcccgctactacctggtgcaccaggagcccctggagaacttccagtgcaatgtgcccctgggcatggagagcggccgcatcgccaatgagcagatcagcgccagcagcacctacagtgatggccgctggaccccccagcagagccggctgcatggagatgacaatggctggacccccaacctggacagcaacaaggagtacctgcaggtggacctgcgcttcctgaccatgctgacagccatcgccacccagggcgccatcagccgggagacccagaatggctactacgtgaagagctacaagctggaggtgtccaccaacggggaggactggatggtgtacagacatggcaagaaccacaaggtgttccaggccaacaatgatgccacagaggtggtgctgaacaagctgcacgcccccctgctgaccaggtttgtgcgcatccggccccagacctggcacagcggcatcgccctgcggctggagctgtttggctgccgggtgacagatgccccctgcagcaacatgctgggcatgctgagcggcctgattgctgacagccagatcagcgccagcagcacccaggagtacctgtggagccccagcgctgcccggctggtgagcagccgcagcggctggttcccccgcatcccccaggcccagcctggagaggagtggctgcaggtggacctgggcacccccaagacagtgaagggcgtcatcatccagggcgcccggggcggggacagcatcacagctgtggaggcccgggcctttgtgaggaagttcaaggtgtcctacagcctgaatggcaaggactgggagtacatccaggaccccaggacccagcagcccaagctgtttgagggcaacatgcactatgacaccccagacatcagaagatttgaccccatcccagcccagtatgtgcgggtgtacccagagcgctggagccctgctggcatcggcatgaggctggaggtgctgggctgtgactggacagacagcaagcccaccgtggagaccctgggccccaccgtgaagtctgaggagaccaccaccccctaccccacagaggaggaggccacagaatgtggggagaactgcagctttgaagatgacaaggacctgcagctgcccagcggcttcaactgcaactttgacttcctggaggagccctgtggctggatgtatgaccacgccaagtggctgcggaccacctgggccagcagcagcagccccaatgacaggaccttcccagatgacaggaacttcctgcggctgcagagcgacagccagcgggagggccagtatgcccggctcatcagcccccctgtgcacctgcccaggagccctgtgtgcatggagttccagtaccaggccactggaggccggggcgtggccctgcaggtggtgcgggaggccagccaggagagcaagctgctgtgggtgatccgggaggaccagggcggggagtggaagcacggccgcatcatcctgcccagctatgacatggagtaccagatcgtgtttgagggcgtcatcggcaagggccgctctggagagatcgccattgatgacatccgcatcagcacagatgtgcccctggagaactgcatggagcccatcagcgcctttgctgatgaatatgaggtggactggagcaacagcagcagcgccaccagcggcagcggggcccccagcacagacaaggagaagtcctggctgtacaccctggaccccatcctgatcaccatcatcgccatgagcagcctgggcgtgctgctgggcgccacctgtgccggcctgctgctgtactgcacctgcagctacagcggcctgagcagccgcagctgcaccaccctggagaactacaactttgagctgtatgatggcctgaagcacaaggtgaagatgaaccaccagaagtgctgcagcgaggcctag

SEQ ID NO: 20814 - DNA, 1668 bp, Artificial Sequence; identical to SEQ ID NO: 20809
  Description of Artificial Sequence: Synthetic coding sequence

SEQ ID NO: 20815 - DNA, 309 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggctag

SEQ ID NO: 20816 - DNA, 2781 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggcaagcactgcggcaacatcgccccacccaccatcatcagcagcggctccatgctgtacatccgcttcaccagtgactatgcccggcagggcgccggcttcagcctgcgctatgagatcttcaagacaggcagcgaggactgcagcaagaacttcaccagccccaacggcaccatcgagagccctggcttccctgagaagtacccccacaacctggactgcaccttcaccatcctggccaagcccaagatggagatcatcctgcagttcctgatctttgacctggagcatgaccccctgcaggtgggggagggggactgcaagtatgactggctggacatctgggatggcatcccccacgtgggccccctcatcggcaagtactgcggcaccaagacccccagcgagctgcggagcagcacaggcatcctgagcctgaccttccacacagacatggctgtggccaaggatggcttcagcgcccgctactacctggtgcaccaggagcccctggagaacttccagtgcaatgtgcccctgggcatggagagcggccgcatcgccaatgagcagatcagcgccagcagcacctacagtgatggccgctggaccccccagcagagccggctgcatggagatgacaatggctggacccccaacctggacagcaacaaggagtacctgcaggtggacctgcgcttcctgaccatgctgacagccatcgccacccagggcgccatcagccgggagacccagaatggctactacgtgaagagctacaagctggaggtgtccaccaacggggaggactggatggtgtacagacatggcaagaaccacaaggtgttccaggccaacaatgatgccacagaggtggtgctgaacaagctgcacgcccccctgctgaccaggtttgtgcgcatccggccccagacctggcacagcggcatcgccctgcggctggagctgtttggctgccgggtgacagatgccccctgcagcaacatgctgggcatgctgagcggcctgattgctgacagccagatcagcgccagcagcacccaggagtacctgtggagccccagcgctgcccggctggtgagcagccgcagcggctggttcccccgcatcccccaggcccagcctggagaggagtggctgcaggtggacctgggcacccccaagacagtgaagggcgtcatcatccagggcgcccggggcggggacagcatcacagctgtggaggcccgggcctttgtgaggaagttcaaggtgtcctacagcctgaatggcaaggactgggagtacatccaggaccccaggacccagcagcccaagctgtttgagggcaacatgcactatgacaccccagacatcagaagatttgaccccatcccagcccagtatgtgcgggtgtacccagagcgctggagccctgctggcatcggcatgaggctggaggtgctgggctgtgactggacagacagcaagcccaccgtggagaccctgggccccaccgtgaagtctgaggagaccaccaccccctaccccacagaggaggaggccacagaatgtggggagaactgcagctttgaagatgacaaggacctgcagctgcccagcggcttcaactgcaactttgacttcctggaggagccctgtggctggatgtatgaccacgccaagtggctgcggaccacctgggccagcagcagcagccccaatgacaggaccttcccagatgacaggaacttcctgcggctgcagagcgacagccagcgggagggccagtatgcccggctcatcagcccccctgtgcacctgcccaggagccctgtgtgcatggagttccagtaccaggccactggaggccggggcgtggccctgcaggtggtgcgggaggccagccaggagagcaagctgctgtgggtgatccgggaggaccagggcggggagtggaagcacggccgcatcatcctgcccagctatgacatggagtaccagatcgtgtttgagggcgtcatcggcaagggccgctctggagagatcgccattgatgacatccgcatcagcacagatgtgcccctggagaactgcatggccaccgtgtctgccagcatcgtggacatccctgagatccacgagcgggagggctatgaagatgaaattgatgatgaatatgaggtggactggagcaacagcagcagcgccaccagcggcagcggggcccccagcacagacaaggagaagtcctggctgtacaccctggaccccatcctgatcaccatcatcgccatgagcagcctgggcgtgctgctgggcgccacctgtgccggcctgctgctgtactgcacctgcagctacagcggcctgagcagccgcagctgcaccaccctggagaactacaactttgagctgtatgatggcctgaagcacaaggtgaagatgaaccaccagaagtgctgcagcgaggcctag

SEQ ID NO: 20817 - DNA, 2730 bp, Artificial Sequence
  Description of Artificial Sequence: Synthetic coding sequence
atggacatgttccccctgacctgggtgttcctggccctgtacttcagccgccaccaggtgcggggccagcctgaccccccctgtggcggccgcctgaacagcaaggatgctggctacatcaccagccctggctacccccaggactaccccagccaccagaactgtgagtggatcgtgtatgcccctgagcccaaccagaagatcgtgctgaacttcaacccccactttgaaattgagaagcatgactgcaagtatgacttcatcgagatcagagatggagacagcgagagcgctgacctgctgggcaagcactgcggcaacatcgccccacccaccatcatcagcagcggctccatgctgtacatccgcttcaccagtgactatgcccggcagggcgccggcttcagcctgcgctatgagatcttcaagacaggcagcgaggactgcagcaagaacttcaccagccccaacggcaccatcgagagccctggcttccctgagaagtacccccacaacctggactgcaccttcaccatcctggccaagcccaagatggagatcatcctgcagttcctgatctttgacctggagcatgaccccctgcaggtgggggagggggactgcaagtatgactggctggacatctgggatggcatcccccacgtgggccccctcatcggcaagtactgcggcaccaagacccccagcgagctgcggagcagcacaggcatcctgagcctgaccttccacacagacatggctgtggccaaggatggcttcagcgcccgctactacctggtgcaccaggagcccctggagaacttccagtgcaatgtgcccctgggcatggagagcggccgcatcgccaatgagcagatcagcgccagcagcacctacagtgatggccgctggaccccccagcagagccggctgcatggagatgacaatggctggacccccaacctggacagcaacaaggagtacctgcaggtggacctgcgcttcctgaccatgctgacagccatcgccacccagggcgccatcagccgggagacccagaatggctactacgtgaagagctacaagctggaggtgtccaccaacggggaggactggatggtgtacagacatggcaagaaccacaaggtgttccaggccaacaatgatgccacagaggtggtgctgaacaagctgcacgcccccctgctgaccaggtttgtgcgcatccggccccagacctggcacagcggcatcgccctgcggctggagctgtttggctgccgggtgacagatgccccctgcagcaacatgctgggcatgctgagcggcctgattgctgacagccagatcagcgccagcagcacccaggagtacctgtggagccccagcgctgcccggctggtgagcagccgcagcggctggttcccccgcatcccccaggcccagcctggagaggagtggctgcaggtggacctgggcacccccaagacagtgaagggcgtcatcatccagggcgcccggggcggggacagcatcacagctgtggaggcccgggcctttgtgaggaagttcaaggtgtcctacagcctgaatggcaaggactgggagtacatccaggaccccaggacccagcagcccaagctgtttgagggcaacatgcactatgacaccccagacatcagaagatttgaccccatcccagcccagtatgtgcgggtgtacccagagcgctggagccctgctggcatcggcatgaggctggaggtgctgggctgtgactggacagacagcaagcccaccgtggagaccctgggccccaccgtgaagtctgaggagaccaccaccccctaccccacagaggaggaggccacagaatgtggggagaactgcagctttgaagatgacaaggacctgcagctgcccagcggcttcaactgcaactttgacttcctggaggagccctgtggctggatgtatgaccacgccaagtggctgcggaccacctgggccagcagcagcagccccaatgacaggaccttcccagatgacaggaacttcctgcggctgcagagcgacagccagcgggagggccagtatgcccggctcatcagcccccctgtgcacctgcccaggagccctgtgtgcatggagttccagtaccaggccactggaggccggggcgtggccctgcaggtggtgcgggaggccagccaggagagcaagctgctgtgggtgatccgggaggaccagggcggggagtggaagcacggccgcatcatcctgcccagctatgacatggagtaccagatcgtgtttgagggcgtcatcggcaagggccgctctggagagatcgccattgatgacatccgcatcagcacagatgtgcccctggagaactgcatgggccccaaggcctgcatcgcagatgaatatgaggtggactggagcaacagcagcagcgccaccagcggcagcggggcccccagcacagacaaggagaagtcctggctgtacaccctggaccccatcctgatcaccatcatcgccatgagcagcctgggcgtgctgctgggcgccacctgtgccggcctgctgctgtactgcacctgcagctacagcggcctgagcagccgcagctgcaccaccctggagaactacaactttgagctgtatgatggcctgaagcacaaggtgaagatgaaccaccagaagtgctgcagcgaggcctag

SEQ ID NO: 20818 - DNA, 462 bp, Artificial Sequence
  Description of Artificial Sequence: Synthetic coding sequence
atgaccaagatcaaggctgaccctgatggccctgaggcccaggccgaggcctgcagcggggagaggacctaccaggagctgctggtgaaccagaaccccatcgcccagcccctggccagccggcggctgaccaggaagctgtacaagtgcatcaagaaggctgtgaagcagaagcagatcagaagaggagtgaaggaggtgcagaagtttgtgaacaagggggagaagggcatcatggtgctggccggggacaccctgcccatcgaggtgtactgccacctgcctgtgatgtgtgaagatagaaacctgccctacgtgtacatccccagcaagacagacctgggcgctgctgctggcagcaagaggcccacctgtgtgatcatggtgaagccccatgaggagtaccaggaggcctatgatgaatgtctggaggaggtgcagagcctgcccctgcccctgtag

SEQ ID NO: 20819 - DNA, 273 bp, Artificial Sequence
  Description of Artificial Sequence: Synthetic coding sequence
atgaccaagatcaaggctgaccctgatggccctgaggcccaggccgaggcctgcagcggggagaggacctaccaggagctgctggtgaaccagaaccccatcgcccagcccctggccagccggcggctgaccaggaagctgtacaagtgcatcaagaaggctgtgaagcagaagcagatcagaagaggagtgaaggaggtgcagaagtttgtgaacaagggggagaagggcacctgggtgcagccccaggcccccagcgcccctcctgtgtag

SEQ ID NO: 20820 - DNA, 2265 bp, Artificial Sequence
  Description of Artificial Sequence: Synthetic coding sequence
atgtggaagctgctgcctgctgctggccctgctggaggagagccctaccgcctgctgactggagtggagtatgtggtgggcaggaagaactgtgccatcctgattgaaaatgaccagagcatcagcagaaatcatgctgtgctgacagccaacttctctgtgaccaacctgagccagacagatgagatccctgtgctgaccctgaaggacaacagcaaatatggcacctttgtgaatgaggagaagatgcagaatggcttcagcaggaccctgaagtctggagatggcatcacctttggagtgtttggcagcaagttccgcatcgagtatgagcccctggtggcctgcagcagctgcctggatgtgtctgggaagacagccctgaaccaggccatcctgcagctgggcggcttcaccgtgaacaactggacagaggagtgcacccacctggtgatggtgtctgtgaaggtgaccatcaagaccatctgtgccctgatctgtggccggcccatcgtgaagccagagtacttcacagagttcctgaaggctgtggagagcaagaagcagcccccccagatcgagagcttctacccacccctggatgagcccagcatcggcagcaagaatgtggacctgagcggccggcaggagaggaagcagatcttcaagggcaagaccttcatcttcctgaatgccaagcagcacaagaagctgagcagcgctgtggtgtttggaggaggagaggcccggctcatcacagaagaaaatgaggaggagcacaacttcttcctggcccctggcacctgtgtggtggacaccggcatcaccaacagccagaccctcatcccagactgccagaagaagtggatccagagcatcatggacatgctgcagaggcagggcctgcggcccatccctgaggccgagatcggcctggccgtcatcttcatgaccaccaagaactactgtgacccccagggccaccccagcacaggcctgaagaccaccaccccaggccccagcctgagccagggcgtgtctgtggatgagaagctgatgcccagcgcccctgtgaacaccaccacctacgtggccgacacagaaagtgagcaggccgacacctgggacctgtctgagcggcccaaggagatcaaggtgtccaagatggagcagaagttcaggatgctgagccaggatgcccccaccgtgaaggagagctgcaagaccagcagcaacaacaacagcatggtgagcaacaccctggccaagatgaggatccccaactaccagctgagccccaccaagctgcccagcatcaacaagagcaaggaccgggccagccagcagcagcagaccaacagcatccggaactacttccagcccagcaccaagaagcgggagagagatgaggagaaccaggagatgagcagctgcaagagcgccagaattgagaccagctgcagcctgctggagcagacccagcctgccacccccagcctgtggaagaacaaggagcagcacctgtctgaaaatgaacctgtggacaccaacagcgacaacaacctcttcacagacacagacctgaagagcatcgtgaagaacagcgccagcaagagccatgctgctgagaagctgcggagcaacaagaagcgggagatggatgatgtggccattgaagatgaggtgctggagcagctgttcaaggacaccaagccagagctggagattgatgtgaaggtgcagaagcaggaggaggatgtgaatgtgaggaagaggcccaggatggacatcgagaccaatgacaccttcagtgatgaagctgtgcctgagagcagcaagatcagccaggagaatgagatcggcaagaagcgggagctgaaggaggacagcctgtggagcgccaaggagatcagcaacaatgacaagctgcaggatgattctgagatgctgcccaagaagctgctgctgacagagttccgcagcctggtgatcaagaacagcaccagcaggaaccccagcggcatcaatgatgattatggccagctgaagaacttcaagaagttcaagaaggtgacctacccaggggccggcaagctgccccacatcattggaggcagtgacctgattgcccaccacgccaggaagaacacagagctggaggagtggctgcggcaggagatggaggtgcagaaccagcacgccaaggaggagagcctggctgatgacctcttccgctacaacccctacctgaagagaagaagatag

SEQ ID NO: 20821 - DNA, 1437 bp, Artificial Sequence
  Description of Artificial Sequence: Synthetic coding sequence
atgtggaagctgctgcctgctgctggccctgctggaggagagccctaccgcctgctgactggagtggagtatgtggtgggcaggaagaactgtgccatcctgattgaaaatgaccagagcatcagcagaaatcatgctgtgctgacagccaacttctctgtgaccaacctgagccagacagatgagatccctgtgctgaccctgaaggacaacagcaaatatggcacctttgtgaatgaggagaagatgcagaatggcttcagcaggaccctgaagtctggagatggcatcacctttggagtgtttggcagcaagttccgcatcgagtatgagcccctggtggcctgcagcagctgcctggatgtgtctgggaagacagccctgaaccaggccatcctgcagctgggcggcttcaccgtgaacaactggacagaggagtgcacccacctggtgatggtgtctgtgaaggtgaccatcaagaccatctgtgccctgatctgtggccggcccatcgtgaagccagagtacttcacagagttcctgaaggctgtggagagcaagaagcagcccccccagatcgagagcttctacccacccctggatgagcccagcatcggcagcaagaatgtggacctgagcggccggcaggagaggaagcagatcttcaagggcaagaccttcatcttcctgaatgccaagcagcacaagaagctgagcagcgctgtggtgtttggaggaggagaggcccggctcatcacagaagaaaatgaggaggagcacaacttcttcctggcccctggcacctgtgtggtggacaccggcatcaccaacagccagaccctcatcccagactgccagaagaagtggatccagagcatcatggacatgctgcagaggcagggcctgcggcccatccctgaggccgagatcggcctggccgtcatcttcatgaccaccaagaactactgtgacccccagggccaccccagcacaggcctgaagaccaccaccccaggccccagcctgagccagggcgtgtctgtggatgagaagctgatgcccagcgcccctgtgaacaccaccacctacgtggccgacacagaaagtgagcaggccgacacctgggacctgtctgagcggcccaaggagatcaaggtgtccaagatggagcagaagttcaggatgctgagccaggatgcccccaccgtgaaggagagctgcaagaccagcagcaacaacaacagcatggtgagcaacaccctggccaagatgaggatccccaactaccagctgagccccaccaagctgcccagcatcaacaagagcaaggaccgggccagccagcagcagcagaccaacagcatccggaactacttccagcccagcaccaagaagcgggagcggctgcacctgaagaagaagaagaagaagaagtag

SEQ ID NO: 20822 - DNA, 333 bp, Artificial Sequence
  Description of Artificial Sequence: Synthetic coding sequence
atgggcgccagcggcagcaaggcccggggcctgtggccctttgccagcgctgctgggggcggcggcagcgaggccgccggggctgagcaggccctggtgcggccccggggccgggctgtgcccccatttgtgttcacccggcggggctccatgttttatgatgaagatggagacctggcccacgagttctatgaggagaccatcgtgaccaagaatggccagaagagggccaagctgcggcgggtgcacaagaacctgatcccccagggcatcgtgaagctggaccacccccgcatccacgtggacttccctgtgatcctgtatgaggtgtag

SEQ ID NO: 20823 - DNA, 1206 bp, Artificial Sequence
  Description of Artificial Sequence: Synthetic coding sequence
atgtggagcggcggcagcggcaaggcccggggctgggaggccgccgccggcggccgcagcagccctggccgcctgagcagaagacgcatcatgtccatgagccccaagcacaccacccccttctctgtgtctgacatcctgagccccctggaggagagctacaagaaggtgggcatggagggcggcggcctgggcgcccccctggccgcctaccggcagggccaggccgccccacccacagctgccatgcagcagcacgctgtgggccaccacggggctgtgacagctgcctaccacatgacagctgctggggtgccccagctgagccacagcgctgtgggcggctactgcaatggaaacctgggcaacatgtctgagctgcccccctaccaggacaccatgagaaattctgccagcggccctggctggtacggggccaacccagacccccgcttccctgccatcagccgcttcatgggccctgccagcggcatgaacatgagcggcatgggcggcctgggcagcctgggagatgtgtccaagaacatggcccccctgcccagcgcccccaggaggaagagaagagtgctcttcagccaggcccaggtgtatgagctggagcggcgcttcaagcagcagaagtacctgagcgcccctgagcgggagcacctggcctccatgatccacctgacccccacccaggtgaagatctggttccagaaccaccgctacaagatgaagaggcaggccaaggacaaggccgcccagcagcagctgcagcaggacagcggcggcggcggcggcggcggcggcaccggctgcccccagcagcagcaggcccagcagcagagcccccggcgggtggccgtgcctgtgctggtgaaggatggcaagccctgccaggccggggccccagcccctggagctgccagcctgcagggccacgcccagcagcaggcccagcaccaggcccaggccgcccaggccgctgctgctgccatctctgtgggcagcggcggggccggcctgggcgcccaccctggccaccagcccggcagcgctggccagagcccagacctggcccaccacgccgccagccctgctgccctgcagggccaggtgagcagcctgagccacctgaacagcagcggcagtgactatggcaccatgagctgcagcaccctgctgtatggccgcacctggtag

SEQ ID NO: 20824 - DNA, 1116 bp, Artificial Sequence
  Description of Artificial Sequence: Synthetic coding sequence
atgtccatgagccccaagcacaccacccccttctctgtgtctgacatcctgagccccctggaggagagctacaagaaggtgggcatggagggcggcggcctgggcgcccccctggccgcctaccggcagggccaggccgccccacccacagctgccatgcagcagcacgctgtgggccaccacggggctgtgacagctgcctaccacatgacagctgctggggtgccccagctgagccacagcgctgtgggcggctactgcaatggaaacctgggcaacatgtctgagctgcccccctaccaggacaccatgagaaattctgccagcggccctggctggtacggggccaacccagacccccgcttccctgccatcagccgcttcatgggccctgccagcggcatgaacatgagcggcatgggcggcctgggcagcctgggagatgtgtccaagaacatggcccccctgcccagcgcccccaggaggaagagaagagtgctcttcagccaggcccaggtgtatgagctggagcggcgcttcaagcagcagaagtacctgagcgcccctgagcgggagcacctggcctccatgatccacctgacccccacccaggtgaagatctggttccagaaccaccgctacaagatgaagaggcaggccaaggacaaggccgcccagcagcagctgcagcaggacagcggcggcggcggcggcggcggcggcaccggctgcccccagcagcagcaggcccagcagcagagcccccggcgggtggccgtgcctgtgctggtgaaggatggcaagccctgccaggccggggccccagcccctggagctgccagcctgcagggccacgcccagcagcaggcccagcaccaggcccaggccgcccaggccgctgctgctgccatctctgtgggcagcggcggggccggcctgggcgcccaccctggccaccagcccggcagcgctggccagagcccagacctggcccaccacgccgccagccctgctgccctgcagggccaggtgagcagcctgagccacctgaacagcagcggcagtgactatggcaccatgagctgcagcaccctgctgtatggccgcacctggtag

SEQ ID NO: 20825 - DNA, 1116 bp, Artificial Sequence; identical to SEQ ID NO: 20824
  Description of Artificial Sequence: Synthetic coding sequence

SEQ ID NO: 20826 - DNA, 1116 bp, Artificial Sequence; identical to SEQ ID NO: 20824
  Description of Artificial Sequence: Synthetic coding sequence

SEQ ID NO: 20827 - DNA, 105 bp, Artificial Sequence
  Description of Artificial Sequence: Synthetic coding sequence
atgtggagcggcggcagcggcaaggcccggggctgggaggccgccgccggcggccgcagcagccctggccgcctgagcgcctatgccccacccctggtggcctag

SEQ ID NO: 20828 - DNA, 573 bp, Artificial Sequence
  Description of Artificial Sequence: Synthetic coding sequence
atgctgcgggtgcctgagcccaggcctggagaggccaaggccgagggcgccgccccacccacccccagcaagcccctgaccagcttcctgatccaggacatcctgagagatggagcccctgaggaggccgagaccctggccgagacagagcctgagcggcacctgggcagctacctgctggacagcgagaacaccagcggggccctgccccggctgccccagacccccaagcagccccagaagaggagcagagctgccttcagccacacccaggtgattgagctggagaggaagttcagccaccagaagtacctgagcgcccctgagcgggcccacctggccaagaacctgaagctgacagagacccaggtgaagatctggttccagaacagacgctacaagaccaagaggaagcagctgagcagcgagctgggggacctggagaagcacagcagcctgcctgccctgaaggaggaggccttcagccgggccagcctggtgtctgtgtacaacagctacccctactacccctacctgtactgtgtgggctcctggagccctgccttctggtag

SEQ ID NO: 20829 - DNA, 705 bp, Artificial Sequence
  Description of Artificial Sequence: Synthetic coding sequence
atgctgcgggtgcctgagcccaggcctggagaggccaaggccgagggcgccgccccacccacccccagcaagcccctgaccagcttcctgatccaggacatcctgagagatggagcccagaggcagggcggccgcaccagcagccagaggcagagggaccctgagcctgagcctgagcctgagcctgagggcggccgcagcagagctggggcccagaatgaccagctgagcacaggcccccgggccgcccctgaggaggccgagaccctggccgagacagagcctgagcggcacctgggcagctacctgctggacagcgagaacaccagcggggccctgccccggctgccccagacccccaagcagccccagaagaggagcagagctgccttcagccacacccaggtgattgagctggagaggaagttcagccaccagaagtacctgagcgcccctgagcgggcccacctggccaagaacctgaagctgacagagacccaggtgaagatctggttccagaacagacgctacaagaccaagaggaagcagctgagcagcgagctgggggacctggagaagcacagcagcctgcctgccctgaaggaggaggccttcagccgggccagcctggtgtctgtgtacaacagctacccctactacccctacctgtactgtgtgggctcctggagccctgccttctggtag

SEQ ID NO: 20830 - DNA, 480 bp, Artificial Sequence
  Description of Artificial Sequence: Synthetic coding sequence
atgctgcgggtgcctgagcccaggcctggagaggccgagaccctggccgagacagagcctgagcggcacctgggcagctacctgctggacagcgagaacaccagcggggccctgccccggctgccccagacccccaagcagccccagaagaggagccgggccgccttcagccacacccaggtgattgagctggagaggaagttcagccaccagaagtacctgagcgcccctgagcgggcccacctggccaagaacctgaagctgacagagacccaggtgaagatctggttccagaacagacgctacaagaccaagaggaagcagctgagcagcgagctgggggacctggagaagcacagcagcctgcctgccctgaaggaggaggccttcagccgggccagcctggtgtctgtgtacaacagctacccctactacccctacctgtactgtgtgggctcctggagccctgccttctggtag

SEQ ID NO: 20831 - DNA, 4212 bp, Artificial Sequence
  Description of Artificial Sequence: Synthetic coding sequence
atggccacccagcagaaggccagtgatgagcgcatcagccagtttgaccacaacctgctgcctgagctgagcgccctgctgggcctggatgctgtgcagctggccaaggagctggaggaggaggagcagaaggagcgggccaagatgcagaagggctacaacagccagatgaggtctgaggccaagaggctgaagacctttgtgacctatgagccctacagctcctggatcccccaggagatggctgctgctggcttctacttcaccggggtgaagagcggcatccagtgcttctgctgcagcctcatcctgtttggagctggcctgacccggctgcccatcgaggaccacaagcgcttccacccagactgtggcttcctgctgaacaaggatgtgggcaacatcgccaagtatgacatccgggtgaagaacctgaagagccggctgcggggcggcaagatgagataccaggaggaggaggcccggctggccagcttcaggaactggcccttctacgtgcagggcatcagcccctgtgtgctgtctgaggccggctttgtgttcaccgggaagcaggacacagtgcagtgcttcagctgtggcggctgcctgggcaactgggaggagggagatgacccctggaaggagcacgccaagtggttccccaagtgtgagttcctgcggagcaagaagagcagcgaggagatcacccagtacatccagagctacaagggctttgtggacatcaccggggagcactttgtgaacagctgggtgcagcgggagctgcccatggccagcgcctactgcaatgacagcatctttgcctatgaggagctgcggctggacagcttcaaggactggccccgggagagcgctgtgggcgtggccgccctggccaaggccggcctcttctacacaggcatcaaggacatcgtgcagtgcttcagctgtggcggctgcctggagaagtggcaggagggagatgaccccctggatgaccacacccgctgcttccccaactgccccttcctgcagaacatgaagagcagcgctgaggtgaccccagacctgcagagcagaggagagctgtgtgagctgctggagaccaccagcgagagcaacctggaggacagcattgctgtgggccccatcgtgcctgagatggcccagggcgaggcccagtggttccaggaggccaagaacctgaatgagcagctgcgggccgcctacaccagcgccagcttccgccacatgagcctgctggacatcagcagtgacctggccacagaccacctgctgggctgtgacctgagcatcgccagcaagcacatcagcaagcctgtgcaggagcccctggtgctgcctgaggtgtttggaaacctgaacagcgtgatgtgtgtggagggggaggccggcagcggcaagacagtgctgctgaagaagatcgccttcctgtgggccagcggctgctgccccctgctgaaccgcttccagctggtgttctacctgagcctgagcagcaccaggccagatgagggcctggccagcatcatctgtgaccagctgctggagaaggagggctctgtgacagagatgtgtgtgaggaacatcatccagcagctgaagaaccaggtgctcttcctgctggatgactacaaggagatctgcagcatcccccaggtgattggcaagctgatccagaagaaccacctgagcaggacctgcctgctgattgctgtgaggaccaacagagcccgggacatccgccgctacctggagaccatcctggagatcaaggccttccccttctacaacacagtgtgcatcctgaggaagctgttcagccacaacatgacccggctgaggaagttcatggtgtactttgggaagaaccagagcctgcagaagatccagaagacccccctgtttgtggccgccatctgtgcccactggttccagtacccctttgaccccagctttgatgatgtggccgtgttcaagagctacatggagcggctgagcctgaggaacaaggccacagctgagatcctgaaggccaccgtgagcagctgtggggagctggccctgaagggcttcttcagctgctgctttgagttcaatgatgatgacctggccgaggccggcgtggatgaagatgaggacctgaccatgtgcctgatgagcaagttcaccgcccagaggctgcggcccttctaccgcttcctgagccctgccttccaggagttcctggccggcatgaggctgattgagctgctggacagcgaccggcaggagcaccaggacctgggcctgtaccacctgaagcagatcaacagccccatgatgacagtgtctgcctacaacaacttcctgaactacgtgagcagcctgcccagcaccaaggccggccccaagatcgtgagccacctgctgcacctggtggacaacaaggagagcctggagaacatcagtgaaaatgatgactacctgaagcaccagcctgagatcagcctgcagatgcagctgctgcggggcctgtggcagatctgcccccaggcctacttctccatggtgtctgagcacctgctggtgctggccctgaagacagcctaccagagcaacacagtggccgcctgcagcccctttgtgctgcagttcctgcagggccgcaccctgaccctgggcgccctgaacctgcagtacttctttgaccaccctgagagcctgagcctgctgcggagcatccacttccccatccggggcaacaagaccagcccccgggcccacttctctgtgctggagacctgctttgacaagagccaggtgcccaccatcgaccaggactatgccagcgcctttgagcccatgaatgagtgggagaggaacctggccgagaaggaggacaacgtgaagagctacatggacatgcagaggcgggccagcccagacctgagcacaggctactggaagctgagccccaagcagtacaagatcccctgcctggaggtggatgtgaatgacattgatgtggtgggccaggacatgctggagatcctgatgaccgtcttcagcgccagccagagaattgagctgcacctgaaccacagccggggcttcatcgagagcatccggcctgccctggagctgagcaaggcctctgtgaccaagtgcagcatcagcaagctggagctgtctgctgctgagcaggagctgctgctgaccctgcccagcctggagagcctggaggtgtctggcaccatccagagccaggaccagatcttccccaacctggacaagttcctgtgcctgaaggagctgtctgtggacctggagggcaacatcaacgtgttttctgtcatccctgaggagttccccaacttccaccacatggagaagctgctgatccagatctctgcagaatatgaccccagcaagctggtgaagctgatccagaacagccccaacctgcacgtgttccacctgaagtgcaacttcttcagtgactttggcagcctgatgaccatgctggtgtcctgcaagaagctgacagagatcaagttcagtgacagcttcttccaggccgtgccctttgtggccagcctgcccaacttcatcagcctgaagatcctgaacctggagggccagcagttcccagatgaggagaccagcgagaagtttgcctacatcctgggcagcctgagcaacctggaggagctgatcctgcccactggagatggcatctacagagtggccaagctgatcatccagcagtgccagcagctgcactgcctgcgggtgctgtccttcttcaagaccctgaatgatgacagcgtggtggagatcgccaaggtggccatcagcggcggcttccagaagctggagaacctgaagctgagcatcaaccacaagatcacagaggagggctacagaaacttcttccaggccctggacaacatgcccaacctgcaggagctggacatcagccgccacttcacagagtgcatcaaggcccaggccaccaccgtgaagagcctgagccagtgtgtgctgcggctgcccaggctcatccggctgaacatgctgtcctggctgctggatgctgatgacatcgccctgctgaatgtgatgaaggagcggcacccccagagcaagtacctgaccatcctgcagaagtggatcctgcccttcagccccatcatccagaagtag

SEQ ID NO: 20832 - DNA, 3726 bp, Artificial Sequence
  Description of Artificial Sequence: Synthetic coding sequence
atgcccctgcacatcggggactttgtgtgggacagcaaggtgcacagcctgcagagcagcctgaacatcttcagcctgctgcccaccaagggccgcacagagcacctgttcttcagccacatcctgtccttccactggccagccttcagcagcatccggctggagctgtggatcaacctgcgctgtgagttcctgcggagcaagaagagcagcgaggagatcacccagtacatccagagctacaagggctttgtggacatcaccggggagcactttgtgaacagctgggtgcagcgggagctgcccatggccagcgcctactgcaatgacagcatctttgcctatgaggagctgcggctggacagcttcaaggactggccccgggagagcgctgtgggcgtggccgccctggccaaggccggcctcttctacacaggcatcaaggacatcgtgcagtgcttcagctgtggcggctgcctggagaagtggcaggagggagatgaccccctggatgaccacacccgctgcttccccaactgccccttcctgcagaacatgaagagcagcgctgaggtgaccccagacctgcagagcagaggagagctgtgtgagctgctggagaccaccagcgagagcaacctggaggacagcattgctgtgggccccatcgtgcctgagatggcccagggcgaggcccagtggttccaggaggccaagaacctgaatgagcagctgcgggccgcctacaccagcgccagcttccgccacatgagcctgctggacatcagcagtgacctggccacagaccacctgctgggctgtgacctgagcatcgccagcaagcacatcagcaagcctgtgcaggagcccctggtgctgcctgaggtgtttggaaacctgaacagcgtgatgtgtgtggagggggaggccggcagcggcaagacagtgctgctgaagaagatcgccttcctgtgggccagcggctgctgccccctgctgaaccgcttccagctggtgttctacctgagcctgagcagcaccaggccagatgagggcctggccagcatcatctgtgaccagctgctggagaaggagggctctgtgacagagatgtgtgtgaggaacatcatccagcagctgaagaaccaggtgctcttcctgctggatgactacaaggagatctgcagcatcccccaggtgattggcaagctgatccagaagaaccacctgagcaggacctgcctgctgattgctgtgaggaccaacagagcccgggacatccgccgctacctggagaccatcctggagatcaaggccttccccttctacaacacagtgtgcatcctgaggaagctgttcagccacaacatgacccggctgaggaagttcatggtgtactttgggaagaaccagagcctgcagaagatccagaagacccccctgtttgtggccgccatctgtgcccactggttccagtacccctttgaccccagctttgatgatgtggccgtgttcaagagctacatggagcggctgagcctgaggaacaaggccacagctgagatcctgaaggccaccgtgagcagctgtggggagctggccctgaagggcttcttcagctgctgctttgagttcaatgatgatgacctggccgaggccggcgtggatgaagatgaggacctgaccatgtgcctgatgagcaagttcaccgcccagaggctgcggcccttctaccgcttcctgagccctgccttccaggagttcctggccggcatgaggctgattgagctgctggacagcgaccggcaggagcaccaggacctgggcctgtaccacctgaagcagatcaacagccccatgatgacagtgtctgcctacaacaacttcctgaactacgtgagcagcctgcccagcaccaaggccggccccaagatcgtgagccacctgctgcacctggtggacaacaaggagagcctggagaacatcagtgaaaatgatgactacctgaagcaccagcctgagatcagcctgcagatgcagctgctgcggggcctgtggcagatctgcccccaggcctacttctccatggtgtctgagcacctgctggtgctggccctgaagacagcctaccagagcaacacagtggccgcctgcagcccctttgtgctgcagttcctgcagggccgcaccctgaccctgggcgccctgaacctgcagtacttctttgaccaccctgagagcctgagcctgctgcggagcatccacttccccatccggggcaacaagaccagcccccgggcccacttctctgtgctggagacctgctttgacaagagccaggtgcccaccatcgaccaggactatgccagcgcctttgagcccatgaatgagtgggagaggaacctggccgagaaggaggacaacgtgaagagctacatggacatgcagaggcgggccagcccagacctgagcacaggctactggaagctgagccccaagcagtacaagatcccctgcctggaggtggatgtgaatgacattgatgtggtgggccaggacatgctggagatcctgatgaccgtcttcagcgccagccagagaattgagctgcacctgaaccacagccggggcttcatcgagagcatccggcctgccctggagctgagcaaggcctctgtgaccaagtgcagcatcagcaagctggagctgtctgctgctgagcaggagctgctgctgaccctgcccagcctggagagcctggaggtgtctggcaccatccagagccaggaccagatcttccccaacctggacaagttcctgtgcctgaaggagctgtctgtggacctggagggcaacatcaacgtgttttctgtcatccctgaggagttccccaacttccaccacatggagaagctgctgatccagatctctgcagaatatgaccccagcaagctggtgaagctgatccagaacagccccaacctgcacgtgttccacctgaagtgcaacttcttcagtgactttggcagcctgatgaccatgctggtgtcctgcaagaagctgacagagatcaagttcagtgacagcttcttccaggccgtgccctttgtggccagcctgcccaacttcatcagcctgaagatcctgaacctggagggccagcagttcccagatgaggagaccagcgagaagtttgcctacatcctgggcagcctgagcaacctggaggagctgatcctgcccactggagatggcatctacagagtggccaagctgatcatccagcagtgccagcagctgcactgcctgcgggtgctgtccttcttcaagaccctgaatgatgacagcgtggtggagatcgccaaggtggccatcagcggcggcttccagaagctggagaacctgaagctgagcatcaaccacaagatcacagaggagggctacagaaacttcttccaggccctggacaacatgcccaacctgcaggagctggacatcagccgccacttcacagagtgcatcaaggcccaggccaccaccgtgaagagcctgagccagtgtgtgctgcggctgcccaggctcatccggctgaacatgctgtcctggctgctggatgctgatgacatcgccctgctgaatgtgatgaaggagcggcacccccagagcaagtacctgaccatcctgcagaagtggatcctgcccttcagccccatcatccagaagtag

SEQ ID NO: 20833 - DNA, 4212 bp, Artificial Sequence; identical to SEQ ID NO: 20831
  Description of Artificial Sequence: Synthetic coding sequence

SEQ ID NO: 20834 - DNA, 3726 bp, Artificial Sequence; identical to SEQ ID NO: 20832
  Description of Artificial Sequence: Synthetic coding sequence

SEQ ID NO: 20835 - DNA, 678 bp, Artificial Sequence
  Description of Artificial Sequence: Synthetic coding sequence
atgctgggcctggatgcctgtgagctgggcgcccagctgctggagctgctgcggctggccctgtgtgcccgggtgctgctggccgacaaggagggcggccccccagctgtggatgaggtgctggatgaggccgtgcctgagtaccgggcccctggcaggaagagcctgctggagatccggcagctggaccctgatgacaggagcctggccaagtacaagagggtgctgctgggccccctgcccccagctgtggaccccagcctgcccaacgtgcaggtgacccggctgaccctgctgtctgagcaggcccctggccctgtggtgatggacctgaccggggacctggccgtgctgaaggaccaggtgtttgtgctgaaggagggcgtggactacagagtgaagatctccttcaaggtgcaccgggagatcgtgtctggcctgaagtgcctgcaccacacctacagaagaggcctgcgggtggacaagacagtgtacatggtgggcagctatggccccagcgcccaggagtatgaatttgtgacccctgtggaggaggcccccaggggggccctggtgcggggcccctacctggtggtgtccctcttcacagatgatgacaggacccaccacctgtcctgggagtggggcctgtgcatctgccaggactggaaggactag

SEQ ID NO: 20836 - DNA, 882 bp, Artificial Sequence
  Description of Artificial Sequence: Synthetic coding sequence
atgcctgcccggagcggggcccagttctgcaggaggatgggccagaagaagcagaggcctgcccgggccggccagccccacagcagcagtgatgctgcccaggccccagctgagcagccccacagcagcagtgatgctgcccaggccccctgcccccgggagcgctgcctgggcccccccaccaccccaggcccctaccgcagcatctacttcagcagccccaagggccacctgacccggctgggcctggagttctttgaccagcctgctgtgcccctggcccgggccttcctgggccaggtgctggtgcggcggctgcccaacggcacagagctgcggggccgcatcgtggagacagaggcctacctgggcccagaagatgaagctgcccacagccggggcggccggcagacccccaggaacagaggcatgttcatgaagccaggcaccctgtatgtgtacatcatctacggcatgtacttctgcatgaacatcagcagccagggagatggagcctgtgtgctgctgcgggccctggagcccctggagggcctggagaccatgaggcagctgcggagcaccctgaggaaaggaacagccagccgggtgctgaaggaccgggagctgtgcagcggccccagcaagctgtgccaggccctggccatcaacaagagctttgaccagagggacctggcccaggatgaggccgtgtggctggagcggggccccctggagcccagcgagcctgctgtggtggccgccgcccgggtgggcgtgggccacgccggggagtgggccaggaagcccctgcgcttctacgtgcggggcagcccctgggtgtctgtggtggacagagtggccgagcaggacacccaggcctag

SEQ ID NO: 20837 - DNA, 846 bp, Artificial Sequence
  Description of Artificial Sequence: Synthetic coding sequence
atgggccagaagaagcagaggcctgcccgggccggccagccccacagcagcagtgatgctgcccaggccccagctgagcagccccacagcagcagtgatgctgcccaggccccctgcccccgggagcgctgcctgggcccccccaccaccccaggcccctaccgcagcatctacttcagcagccccaagggccacctgacccggctgggcctggagttctttgaccagcctgctgtgcccctggcccgggccttcctgggccaggtgctggtgcggcggctgcccaacggcacagagctgcggggccgcatcgtggagacagaggcctacctgggcccagaagatgaagctgcccacagccggggcggccggcagacccccaggaacagaggcatgttcatgaagccaggcaccctgtatgtgtacatcatctacggcatgtacttctgcatgaacatcagcagccagggagatggagcctgtgtgctgctgcgggccctggagcccctggagggcctggagaccatgaggcagctgcggagcaccctgaggaaaggaacagccagccgggtgctgaaggaccgggagctgtgcagcggccccagcaagctgtgccaggccctggccatcaacaagagctttgaccagagggacctggcccaggatgaggccgtgtggctggagcggggccccctggagcccagcgagcctgctgtggtggccgccgcccgggtgggcgtgggccacgccggggagtgggccaggaagcccctgcgcttctacgtgcggggcagcccctgggtgtctgtggtggacagagtggccgagcaggacacccaggcctag

SEQ ID NO: 20838 - DNA, 756 bp, Artificial Sequence
  Description of Artificial Sequence: Synthetic coding sequence
atgggccagaagaagcagaggcctgcccgggccggccagccccacagcagcagtgatgctgcccaggccccagctgagcagccccacagcagcagtgatgctgcccaggccccctgcccccgggagcgctgcctgggcccccccaccaccccaggcccctaccgcagcatctacttcagcagccccaagggccacctgacccggctgggcctggagttctttgaccagcctgctgtgcccctggcccgggccttcctgggccaggtgctggtgcggcggctgcccaacggcacagagctgcggggccgcatcgtggagacagaggcctacctgggcccagaagatgaagctgcccacagccggggcggccggcagacccccaggaacagaggcatgttcatgaagccaggcaccctgtatgtgtacatcatctacggcatgtacttctgcatgaacatcagcagccagggagatggagcctgtgtgctgctgcgggccctggagcccctggagggcctggagaccatgaggcagctgcggagcaccctgaggaaaggaacagccagccgggtgctgaaggaccgggagctgtgcagcggccccagcaagctgtgccaggccctggccatcaacaagagctttgaccagagggacctggcccaggatgaggccgtgtggctggagcggggccccctggagcccagcgagcctgctgtggtggccgccgcccgggtgggcgtgggccacgccggctag

SEQ ID NO: 20839 - DNA, 1044 bp, Artificial Sequence
  Description of Artificial Sequence: Synthetic coding sequence
atgcacgcccactgcctgcccttcctgctgcacgcctggtgggccctgctgcaggccggggccgccaccgtggccacagccctgctgcggacccggggccagcccagcagccccagccccctggcctacatgctgagcctgtacagagaccccctgcccagggctgacatcatccgcagcctgcaggccgaggatgtggccgtggatggccagaactggacctttgcctttgacttctccttcctgagccagcaggaggacctggcctgggccgagctgcggctgcagctgagcagccctgtggacctgcccacagagggcagcctggccatcgagatcttccaccagcccaagccagacacagagcaggccagtgacagctgcctggagcgcttccagatggacctcttcaccgtgaccctgagccaggtgaccttcagcctgggctccatggtgctggaggtgacccggcccctgagcaagtggctgaagcaccctggggccctggagaagcagatgagccgggtggccggggagtgctggccccggccccccaccccaccagccaccaacgtgctgctgatgctgtacagcaacctgagccaggagcagaggcagctgggcggcagcaccctgctgtgggaggccgagagctcctggagggcccaggagggccagctgtcctgggagtggggcaagaggcaccggcggcaccacctgcctgacaggagccagctgtgcaggaaggtgaagttccaggtggacttcaacctgattggctggggctcctggatcatctaccccaagcagtacaatgcctaccgctgtgaaggagaatgtcccaaccctgtgggggaggagttccaccccaccaaccacgcctacatccagagcctgctgaagcgctaccagccccaccgggtgcccagcacctgctgtgcccctgtgaagaccaagcccctgtccatgctgtatgtggacaatggccgggtgctgctggaccaccacaaggacatgattgtggaggagtgtggctgcctgtag

SEQ ID NO: 20840 - DNA, 879 bp, Artificial Sequence
  Description of Artificial Sequence: Synthetic coding sequence
gaccagcagctgggcatccagaccaaggatgtggccgtggatggccagaactggacctttgcctttgacttctccttcctgagccagcaggaggacctggcctgggccgagctgcggctgcagctgagcagccctgtggacctgcccacagagggcagcctggccatcgagatcttccaccagcccaagccagacacagagcaggccagtgacagctgcctggagcgcttccagatggacctcttcaccgtgaccctgagccaggtgaccttcagcctgggctccatggtgctggaggtgacccggcccctgagcaagtggctgaagcaccctggggccctggagaagcagatgagccgggtggccggggagtgctggcccaggcctcccaccccaccagccaccaacgtgctgctgatgctgtacagcaacctgagccaggagcagaggcagctgggcggcagcaccctgctgtgggaggccgagagctcctggagggcccaggagggccagctgtcctgggagtggggcaagaggcacagaagacaccacctgcctgacaggagccagctgtgcaggaaggtgaagttccaggtggacttcaacctgattggctggggctcctggatcatctaccccaagcagtacaatgcctaccgctgtgagggggagtgccccaaccctgtgggggaggagttccaccccaccaaccacgcctacatccagagcctgctgaagcgctaccagccccaccgggtgcccagcacctgctgtgcccctgtgaagaccaagcccctgtccatgctgtatgtggacaatggccgggtgctgctggaccaccacaaggacatgattgtggaggagtgtggctgcctgtag

SEQ ID NO: 20841 - DNA, 534 bp, Artificial Sequence
  Description of Artificial Sequence: Synthetic coding sequence
atggtgctgctgagcaccctgggcatcgtgttccagggcgagggcccccccatcagcagctgtgacaccggcaccatggccaactgtgagaggaccttcatcgccatcaagccagatggagtgcagaggggcctggtgggggagatcatcaagagatttgagcagaagggcttccggctggtgggcctgaagttcatgcaggccagcgaggacctgctgaaggagcactacgtggacctgaaggaccggcccttctttgctggcctggtgaagtacatgcacagcggccctgtggtggccatggtgtgggagggcctgaatgtggtgaagacaggccgggtgatgctgggggagaccaacccagctgacagcaagccaggcaccatccggggggacttctgcatccaggtgggcaggaacatcatccacggcagtgacagcgtggagagcgctgagaaggagatcggcctgtggttccaccctgaggagctggtggactacaccagctgtgcccagaactggatctatgaatag

SEQ ID NO: 20842 - DNA, 534 bp, Artificial Sequence; identical to SEQ ID NO: 20841
  Description of Artificial Sequence: Synthetic coding sequence

SEQ ID NO: 20843 - DNA, 459 bp, Artificial Sequence
  Description of Artificial Sequence: Synthetic coding sequence
atggccaactgtgagaggaccttcatcgccatcaagccagatggagtgcagaggggcctggtgggggagatcatcaagagatttgagcagaagggcttccggctggtgggcctgaagttcatgcaggccagcgaggacctgctgaaggagcactacgtggacctgaaggaccggcccttctttgctggcctggtgaagtacatgcacagcggccctgtggtggccatggtgtgggagggcctgaatgtggtgaagacaggccgggtgatgctgggggagaccaacccagctgacagcaagccaggcaccatccggggggacttctgcatccaggtgggcaggaacatcatccacggcagtgacagcgtggagagcgctgagaaggagatcggcctgtggttccaccctgaggagctggtggactacaccagctgtgcccagaactggatctatgaatag

SEQ ID NO: 20844 - DNA, 183 bp, Artificial Sequence
  Description of Artificial Sequence: Synthetic coding sequence
atggtgctgctgagcaccctgggcatcgtgttccagggcgagggcccccccatcagcagctgtgacaccggcaccatggccaactgtgagaggaccttcatcgccatcaagccagatggagtgcagaggggcctggtgggggagatcatcaagagatttgagcagaagggcttccggctgtag

SEQ ID NO: 20845 - DNA, 1443 bp, Artificial Sequence
  Description of Artificial Sequence: Synthetic coding sequence
atggccaccgtgcccggcctgcagcccctgcccaccctggagcaggacctggagcaggaggagatcctgattgtgaaggtggaggaggacttctgcctggaggaggagcccagcgtggagacagaggaccccagccctgagaccttccggcagctgttccgcctcttctgctaccaggaggtggccggcccccgggaggccctgagccggctgtgggagctgtgctgccgctggctgcggcctgagctgcggaccaaggagcagatcctggagctgctggtgctggagcagttcctgactgtgctgcctggagagatccaggcccgggtgcgggagcagcagcctgagagcggggaggaggccgtggtgctggtggagggcctgcagaggaagcccaggaagcaccggcagaggggcagcgagctgctgagtgatgatgaggtgcccctgggcatcggcggccagttcctgaagcaccaggccgaggcccagcctgaggacctgagcctggaggaggaggcccgcttcagcagccagcagcccccagcccagctgagccaccggccccagaggggccccctgctgtggccagagcggggccccccagcccccaggcaccaggagatggccagcgccagccccttcctgagcgcctggagccaggtgcctgtgaacctggaggatgtggccgtgtacctgagcggggaggagccccgctgcatggaccctgcccagagagatgcccccctggagaatgaaggacctggcatccagctggaggatggaggagatggaagagaagatgcccccctgaggatggagtggtacagagtgctgagcgcccgctgccagggccctggccaccccctgcccggccagaggcctgcccctgtgcggggcctggtgcggccagaccagccccggggcggccccccacctggaagaagagccagccatggagctgacaagccctacacctgcccagaatgtgggaagggcttcagcaagaccagccacctgaccaagcaccagaggacccacactggagagcggccctacaagtgcctggtgtgtgggaagggcttcagtgacaggagcaacttcagcacccaccagagggtgcacactggagagaagccctacccctgcccagaatgtgggaagcgcttcagccagagcagcagcctggtgatccacaggaggacccacagcggggagcggccctatgcctgcacccagtgtgggaagcgcttcaacaacagcagccacttcagcgcccacaggaggacccacactggagagaagccctacacctgcccagcctgtggccggggcttcagaagaggaacagacctgcacaagcaccagaggacccacatgggcgccggcagcctgcccaccctgcagcctgtggcccctgggggccctggggccaaggcctag

SEQ ID NO: 20846 - DNA, 588 bp, Artificial Sequence
  Description of Artificial Sequence: Synthetic coding sequence
atgggcggcctcttctggaggtctgccctgcggggcctgcgctgtggcccccgggcccctggccccagcctgctggtgcgccacggcagcggcctgcccccatctgccctgaagaggggccccagctggacccgggagaggaccctggtggccgtgaagccagatggagtgcagaggcggctggtgggagatgtgatccagagatttgaaagaagaggcttcaccctggtgggcatgaagatgctgcaggcccctgagagcgtgctggccgagcactaccaggacctgcggaggaagcccttctacccagccctgatccgctacatgagcagcggccctgtggtggccatggtgtgggagggctacaacgtggtgcgggccagccgggccatgattggccacacagattctgctgaggccgcccctggcaccatccggggggacttctctgtgcacatcagcagaaatgtcatccacgccagtgacagcgtggagggcgcccagcgggagatccagctgtggttccagagcagcgagctggtgtcctgggcagatggcggccagcacagcagcatccacccagcctag

SEQ ID NO: 20847 - DNA, 354 bp, Artificial Sequence
  Description of Artificial Sequence: Synthetic coding sequence
atgaagatgctgcaggcccctgagagcgtgctggccgagcactaccaggacctgcggaggaagcccttctacccagccctgatccgctacatgagcagcggccctgtggtggccatggtgtgggagggctacaacgtggtgcgggccagccgggccatgattggccacacagattctgctgaggccgcccctggcaccatccggggggacttctctgtgcacatcagcagaaatgtcatccacgccagtgacagcgtggagggcgcccagcgggagatccagctgtggttccagagcagcgagctggtgtcctgggcagatggcggccagcacagcagcatccacccagcctag

SEQ ID NO: 20848 - DNA, 510 bp, Artificial Sequence
  Description of Artificial Sequence: Synthetic coding sequence
tgatggaggtctgccctgcggggcctgcgctgtggcccccgggcccctggccccagcctgctggtgcgccacggcagcggcggccccagctggacccgggagaggaccctggtggccgtgaagccagatggagtgcagaggcggctggtgggagatgtgatccagagatttgaaagaagaggcttcaccctggtgggcatgaagatgctgcaggcccctgagagcgtgctggccgagcactaccaggacctgcggaggaagcccttctacccagccctgatccgctacatgagcagcggccctgtggtggccatggtgtgggagggctacaacgtggtgcgggccagccgggccatgattggccacacagattctgctgaggccgcccctggcaccatccggggggacttctctgtgcacatcagcagccaccggctggcccccctggaccggggccagcgggagcagcagatggtgcccggcatcccccagggcgcccacgaggcctag

SEQ ID NO: 20849 - DNA, 702 bp, Artificial Sequence
  Description of Artificial Sequence: Synthetic coding sequence
atgggcggcctcttctggaggtctgccctgcggggcctgcgctgtggcccccgggcccctggccccagcctgctggtgcgccacggcagcggcggccccagctggacccgggagaggaccctggtggccgtgaagccagatggagtgcagaggcggctggtgggagatgtgatccagagatttgaaagaagaggcttcaccctggtgggcatgaagatgctgcaggcccctgagagcgtgctggccgagcactaccaggacctgcggaggaagcccttctacccagccctgatccgctacatgagcagcggccctgtggtggccatggtgtgggagggctacaacgtggtgcgggccagccgggccatgattggccacacagattctgctgaggccgcccctggcaccatccggggggacttctctgtgcacatcagcagaaatgtcatccacgccagtgacagcgtggagggcgcccagcgggagatccagctgtggttccagagcagcgagctgagccccactggagccccctggcccagccggcggcccacctggaggggcaccaccgtgagccccaggacagccaccagcagcgcccggacctgctgcggcaccaagtggcccagcagccaggaggccgccctgggcctgggcagcggcctgctgcgcttcagctgtggcacagctgccatcagatag

SEQ ID NO: 20850 - DNA, 354 bp, Artificial Sequence; identical to SEQ ID NO: 20847
  Description of Artificial Sequence: Synthetic coding sequence

SEQ ID NO: 20851 - DNA, 114 bp, Artificial Sequence
  Description of Artificial Sequence: Synthetic coding sequence
atgaagatgctgcaggcccctgagagcgtgctggccgagcactaccaggacctgcggaggaagcccttctacccagccctgatccgctacatgagcagcggccctgtggtgtag

SEQ ID NO: 20852 - DNA, 195 bp, Artificial Sequence
  Description of Artificial Sequence: Synthetic coding sequence
atgttcctgcagtactacctgaatgagcagggcgacagagtgtacaccctgaagaagtttgaccccatgggccagcagacctgcagcgcccacccagcccgcttctccccagatgacaagtacagccgccaccgcatcaccatcaagaagcgcttcaaggtgctgatgacccagcagcccaggcctgtgctgtag

SEQ ID NO: 20853 - DNA, 7668 bp, Artificial Sequence
  Description of Artificial Sequence: Synthetic coding sequence
atgccacccctgctggcccccctgctgtgcctggccctgctgcctgccctggccgcccggggcccccgctgcagccagcctggagagacctgcctgaatggaggaaaatgtgaggccgccaatggaacagaggcctgtgtgtgtggcggggcctttgtgggcccccgctgccaggaccccaacccctgcctgagcaccccctgcaagaatgccggcacctgccacgtggtggacagaagaggagtggccgactatgcctgcagctgtgccctgggcttcagcggccccctgtgcctgacccccctggacaatgcctgcctgaccaacccctgcagaaatggaggcacctgtgacctgctgaccctgacagagtacaagtgccgctgccccccaggctggagcggcaagagctgccagcaggccgacccctgtgccagcaacccctgtgccaatggaggccagtgcctgccctttgaggccagctacatctgccactgccccccatccttccacggccccacctgccggcaggatgtgaatgaatgtggccagaagccaggcctgtgcagacatggaggcacctgccacaatgaggtgggcagctaccgctgtgtgtgccgggccacccacacaggccccaactgtgagcggccctacgtgccctgcagccccagcccctgccagaatggaggcacctgccggcccactggagatgtgacccatgaatgtgcctgcctgcccggcttcaccggccagaactgtgaggagaacattgatgactgccccggcaacaactgcaagaatggaggagcctgtgtggatggagtgaacacctacaactgccgctgccccccagagtggacaggccagtactgcacagaagatgtggatgagtgccagctgatgcccaatgcctgccagaatggaggcacctgccacaacacccacggcggctacaactgtgtgtgtgtgaatggctggacaggagaggactgcagcgagaacattgatgactgtgccagcgctgcctgcttccacggggccacctgccacgacagagtggccagcttctactgtgagtgcccccacggccgcacaggcctgctgtgccacctgaatgatgcctgcatcagcaacccctgcaatgaaggcagcaactgtgacaccaaccctgtgaatggcaaggccatctgcacctgccccagcggctacacaggccctgcctgcagccaggatgtggatgaatgttccctgggcgccaacccctgtgaacatgctgggaagtgcatcaacaccctgggcagctttgagtgccagtgcctgcagggctacacaggcccccgctgtgaaattgatgtgaatgaatgtgtgagcaacccctgccagaatgatgccacctgcctggaccagattggagagttccagtgcatctgcatgcctggctatgagggcgtgcactgtgaggtgaacacagatgaatgtgccagcagcccctgcctgcacaacggccgctgcctggacaagatcaatgagttccagtgtgaatgtcccaccggcttcaccggccacctgtgccagtatgatgtggatgaatgtgccagcaccccctgcaagaatggagccaagtgcctggatggccccaacacctacacctgtgtgtgcacagagggctacacaggcacccactgtgaggtggacattgatgaatgtgaccctgacccctgccactacggcagctgcaaggatggagtggccaccttcacctgcctgtgcaggcctggctacacaggccaccactgtgagaccaacatcaatgaatgtagcagccagccctgccgccacggcggcacctgccaggaccgggacaatgcctacctgtgcttctgcctgaagggcaccaccggccccaactgtgagatcaacctggatgactgtgccagcagcccctgtgacagcggcacctgcctggacaagattgatggctatgaatgtgcctgtgagcccggctacacaggctccatgtgcaacatcaacattgatgaatgtgccggcaacccctgccacaatggaggcacctgtgaagatggcatcaatggcttcacctgccgctgcccagagggctaccatgaccccacctgcctgtctgaggtgaatgaatgcaacagcaacccctgtgtgcatggagcctgccgggacagcctgaatggctacaagtgtgactgtgaccccggctggagcggcaccaactgtgacatcaacaacaatgaatgtgagagcaacccctgtgtgaatggaggcacctgcaaggacatgaccagcggctacgtgtgcacctgccgggagggcttcagcggccccaactgccagaccaacatcaatgaatgtgccagcaacccctgcctgaaccagggcacctgcattgatgatgtggccggctacaagtgcaactgcctgctgccctacaccggggccacctgtgaggtggtgctggccccctgtgcccccagcccctgcagaaatggaggagaatgtcggcagagcgaggactatgagagcttcagctgtgtgtgccccaccggctggcagggccagacctgtgaggtggacatcaatgaatgtgtgctgagcccctgccgccacggggccagctgccagaacacccacggcggctaccgctgccactgccaggccggctacagcggcaggaactgtgaaacagacattgatgactgccggcccaacccctgccacaacggcggcagctgcacagatggcatcaacacagccttctgtgactgcctgcccggcttccggggcaccttctgtgaggaggacatcaatgaatgtgccagtgacccctgcagaaatggagccaactgcacagactgtgtggacagctacacctgcacctgcccagctggcttcagcggcatccactgtgagaacaacaccccagactgcacagagagcagctgcttcaacggcggcacctgtgtggatggcatcaacagcttcacctgcctgtgccccccaggcttcaccggcagctactgccagcatgatgtgaatgaatgtgacagccagccctgcctgcacggcggcacctgccaggacggctgcggcagctaccgctgcacctgcccccagggctacacaggccccaactgccagaacctggtgcactggtgtgacagcagcccctgcaagaatggaggcaagtgctggcagacccacacccagtaccgctgtgagtgccccagcggctggacaggcctgtactgtgatgtgcccagcgtgtcctgtgaggtggccgcccagaggcagggcgtggatgtggcccggctgtgccagcacggcggcctgtgtgtggatgctggcaacacccaccactgccgctgccaggccggctacacaggcagctactgtgaggacctggtggatgagtgcagccccagcccctgccagaatggagccacctgcacagactacctgggcggctacagctgcaagtgtgtggccggctaccacggcgtgaactgcagcgaggagattgatgagtgcctgagccacccctgccagaatggaggcacctgcctggacctgcccaacacctacaagtgcagctgcccccggggcacccagggcgtgcactgtgagatcaacgtggatgactgcaacccccctgtggaccctgtgagccgcagccccaagtgcttcaacaacggcacctgtgtggaccaggtgggcggctacagctgcacctgccccccaggctttgtgggggagcgctgtgaaggagatgtgaatgaatgtctgagcaacccctgtgatgcccggggcacccagaactgtgtgcagagggtgaatgacttccactgtgagtgcagagctggccacacaggccgccgctgtgagagcgtcatcaatggctgcaagggcaagccctgcaagaatggaggcacctgtgctgtggccagcaacacagcccggggcttcatctgcaagtgcccagctggctttgagggcgccacctgtgaaaatgatgcccggacctgtggcagcctgcgctgcctgaatggaggcacctgcatcagcggccccaggagccccacctgcctgtgcctgggccccttcaccggccctgagtgccagtttcctgccagcagcccctgcctgggcggcaacccctgctacaaccagggcacctgtgagcccaccagcgagagccccttctaccgctgcctgtgcccagccaagttcaacggcctgctgtgccacatcctggactacagctttggaggaggagctggccgggacatccccccacccctgattgaggaggcctgtgagctgcctgagtgccaggaggatgctggcaacaaggtgtgcagcctgcagtgcaacaaccacgcctgtggctgggatggaggagactgcagcctgaacttcaatgacccctggaagaactgcacccagagcctgcagtgctggaagtacttcagtgatggccactgtgacagccagtgcaacagcgctggctgcctgtttgatggctttgactgccagagagctgagggccagtgcaaccccctgtatgaccagtactgcaaggaccacttcagtgatggccactgtgaccagggctgcaacagcgcagaatgtgagtgggatggcctggactgtgccgagcacgtgcctgagcggctggccgccggcaccctggtggtggtggtgctgatgcctcctgagcagctgaggaacagcagcttccacttcctgcgggagctgagccgggtgctgcacaccaacgtggtgttcaagagagatgcccacggccagcagatgatcttcccctactacggccgggaggaggagctgaggaagcaccccatcaagagagctgctgagggctgggccgccccagatgccctgctgggccaggtgaaggccagcctgctgcccggcggcagcgagggcggcagaagaagaagagagctggaccccatggatgtgcggggcagcatcgtgtacctggagattgacaaccggcagtgtgtgcaggccagcagccagtgcttccagagcgccacagatgtggccgccttcctgggcgccctggccagcctgggcagcctgaacatcccctacaagattgaggccgtgcagagcgagaccgtggagcccccacctccagcccagctgcacttcatgtatgtggccgccgccgcctttgtgctgctcttctttgtgggctgcggcgtgctgctgagcaggaagagaagacggcagcacggccagctgtggttccctgagggcttcaaggtgtctgaggccagcaagaagaagagaagagagcccctgggagaagattctgtgggcctgaagcccctgaagaatgccagtgatggagccctgatggatgacaaccagaatgagtggggagatgaggacctggagaccaagaagttccgctttgaggagcctgtggtgctgcctgacctggatgaccagacagaccaccggcagtggacccagcagcacctggatgctgctgacctgaggatgtctgccatggcccccaccccaccccagggcgaggtggatgctgactgcatggatgtgaatgtgcggggcccagatggcttcacccccctgatgattgccagctgcagcggcggcggcctggagactggaaacagcgaggaggaggaggatgccccagctgtgatcagtgacttcatctaccagggcgccagcctgcacaaccagacagacagaactggagaaacagccctgcacctggccgcccgctacagcagaagtgatgctgccaagaggctgctggaggccagcgcagatgccaacatccaggacaacatgggccgcacccccctgcatgctgctgtgtctgcagatgcccagggcgtcttccagatcctgatccggaacagagccacagacctggatgccaggatgcatgatggcaccacccccctcatcctggccgcccggctggccgtggagggcatgctggaggacctgatcaacagccatgctgatgtgaatgctgtggatgacctgggcaagagcgccctgcactgggccgctgctgtgaacaacgtggatgctgctgtggtgctgctgaagaatggagccaacaaggacatgcagaacaaccgggaggagacccccctcttcctggccgcccgggagggcagctatgaaacagccaaggtgctgctggaccactttgccaacagagacatcacagaccacatggaccggctgccccgggacatcgcccaggagaggatgcaccacgacatcgtgcggctgctggatgagtacaacctggtgcgcagcccccagctgcatggagcccccctgggcggcacccccaccctgagcccccccctgtgcagccccaacggctacctgggcagcctgaagccaggagtgcagggcaagaaggtgaggaagcccagcagcaagggcctggcctgtggcagcaaggaggccaaggacctgaaggcccggaggaagaagagccaggacggcaagggctgcctgctggacagcagcggcatgctgagccctgtggacagcctggagagcccccacggctacctgagtgatgtggccagcccccccctgctgcccagccccttccagcagagccccagcgtgcccctgaaccacctgcccggcatgccagacacccacctgggcatcggccacctgaatgtggccgccaagccagagatggccgccctgggcggcggcggccgcctggcctttgagaccggccccccccggctgagccacctgcctgtggccagcggcaccagcacagtgctgggcagcagcagcggcggggccctgaacttcaccgtgggcggcagcaccagcctgaatggccagtgtgagtggctgagccggctgcagagcggcatggtgcccaaccagtacaaccccctgcggggctctgtggcccctggccccctgagcacccaggcccccagcctgcagcacggcatggtgggccccctgcacagcagcctggccgccagcgccctgagccagatgatgagctaccagggcctgcccagcacccggctggccacccagccccacctggtgcagacccagcaggtgcagccccagaacctgcagatgcagcagcagaacctgcagcctgccaacatccagcagcagcagagcctgcagcccccacctcctccaccccagccccacctgggcgtgtcctctgctgccagcggccacctgggccgctccttcctgtctggagagcccagccaggctgatgtgcagcccctgggccccagcagcctggccgtgcacaccatcctgccccaggagagccctgccctgcccaccagcctgcccagcagcctggtgccccctgtgacagctgcccagttcctgaccccacccagccagcacagctacagcagccctgtggacaacacccccagccaccagctgcaggtgcctgagcaccccttcctgacccccagccctgagagcccagaccagtggagcagcagcagcccccacagcaatgtgtctgactggagcgagggcgtgagcagcccccccacctccatgcagagccagatcgcccgcatccctgaggccttcaagtag

SEQ ID NO: 20854 - DNA, 6012 bp, Artificial Sequence
  Description of Artificial Sequence: Synthetic coding sequence
atgcagccccccagcctgctgctgctgctgctgctgctgctgctgctgtgtgtgtctgtggtgcggccccggggcctgctgtgtggcagcttccctgagccctgtgccaatggaggcacctgcctgagcctgagcctgggccagggcacctgccagtgtgcccctggcttcctgggggagacctgccagttcccagacccctgccagaatgcccagctgtgccagaatggaggcagctgccaggccctgctgcctgcccccctgggcctgcccagcagccccagccccctgacccccagcttcctgtgcacctgcctgcccggcttcaccggggagcgctgccaggccaagctggaggacccctgccccccatccttctgcagcaagaggggccgctgccacatccaggccagcggccggccccagtgcagctgcatgcctggctggacaggagagcagtgccagctgcgggacttctgcagcgccaacccctgtgtgaatggaggagtgtgcctggccacctacccccagatccagtgccactgccccccaggctttgagggccacgcctgtgaaagagatgtgaatgaatgcttccaggaccccggcccctgccccaagggcaccagctgccacaacaccctgggcagcttccagtgcctgtgccctgtgggccaggagggcccccgctgtgagctgcgggccggcccctgccccccccggggctgcagcaatggaggcacctgccagctgatgcctgagaaggacagcaccttccacctgtgcctgtgccccccaggcttcatcggccctgactgtgaggtgaacccagacaactgtgtgagccaccagtgccagaatggaggcacctgccaggacggcctggacacctacacctgcctgtgcccagagacctggacaggctgggactgcagtgaagatgtggatgaatgtgagacccagggccccccccactgcagaaatggaggcacctgccagaacagcgctggcagcttccactgtgtgtgtgtgtctggctggggcggcaccagctgtgaggagaacctggatgactgcatcgccgccacctgtgcccctggcagcacctgcatcgacagagtgggcagcttcagctgcctgtgccccccaggccgcacaggcctgctgtgccacctggaggacatgtgcctgagccagccctgccacggagatgcccagtgcagcaccaaccccctgaccggcagcaccctgtgcctgtgccagcccggctacagcggccccacctgccaccaggacctggatgaatgtctgatggcccagcagggccccagcccctgtgagcacggcggcagctgcctgaacaccccaggcagcttcaactgcctgtgccccccaggctacacaggcagccgctgtgaggccgaccacaatgaatgtctgagccagccctgccaccctggcagcacctgcctggacctgctggccaccttccactgcctgtgccccccaggcctggagggccagctgtgtgaggtggagaccaatgaatgtgccagcgccccctgcctgaaccacgccgactgccacgacctgctgaatggcttccagtgcatctgcctgcccggcttcagcggcacccgctgtgaggaggacattgatgagtgccgcagcagcccctgtgccaacggcggccagtgccaggaccagcccggggccttccactgcaagtgcctgcccggctttgagggcccccgctgccagacagaggtggatgagtgcctgagtgacccctgccctgtgggcgccagctgcctggacctgcccggggccttcttctgcctgtgccccagcggcttcaccggccagctgtgtgaggtgcccctgtgtgcccccaacctgtgccagcccaagcagatctgcaaggaccagaaggacaaggccaactgcctgtgcccagatggcagccctggctgtgcccctcctgaggacaactgcacctgccaccacggccactgccagaggagcagctgtgtgtgtgatgtgggctggacaggcccagaatgtgaggccgagctgggcggctgcatcagcgccccctgtgcccacggcggcacctgctacccccagcccagcggctacaactgcacctgccccaccggctacacaggccccacctgcagcgaggagatgacagcctgccacagcggcccctgcctgaatggaggcagctgcaaccccagccctgggggctactactgcacctgcccccccagccacacaggcccccagtgccagaccagcacagactactgtgtgtctgccccctgcttcaacggcggcacctgtgtgaaccggcccggcaccttcagctgcctgtgtgccatgggcttccagggcccccgctgtgagggcaagctgcggcccagctgtgccgacagcccctgcaggaacagagccacctgccaggacagcccccagggcccccgctgcctgtgccccaccgtgtacacaggaggcagctgccagaccctgatggacctgtgtgcccagaagccctgccccaggaacagccactgcctgcagacaggccccagcttccactgcctgtgcctgcagggctggacaggccccctgtgcaacctgcccctgagcagctgccagaaggccgccctgagccagggcattgatgtgagcagcctgtgccacaatggaggcctgtgtgtggacagcggccccagctacttctgccactgccccccaggcttccagggcagcctgtgccaggaccacgtgaacccctgtgagagccggccctgccagaatggagccacctgcatggcccagcccagcggctacctgtgccagtgtgcccctggctatgatggccagaactgcagcaaggagctggatgcctgccagagccagccctgccacaaccacggcacctgcacccccaagccaggcggcttccactgtgcctgccccccaggctttgtgggcctgcgctgtgaaggagatgtggatgaatgtctggaccagccctgccaccccaccggcacagctgcctgccacagcctggccaatgccttctactgccagtgcctgcccggccacacaggccagtggtgtgaggtggagattgacccctgccacagccagccctgcttccatggaggcacctgtgaggccacagctggcagccccctgggcttcatctgccactgccccaagggctttgagggccccacctgcagccaccgggcccccagctgtggcttccaccactgccaccacggcggcctgtgcctgcccagccccaagccaggcttccccccaagatgtgcctgcctgagcggctacggcggccctgactgcctgaccccaccagcccccaagggctgcggcccccccagcccctgcctgtacaacggcagctgcagcgagaccaccggcctgggcggccctggcttccgctgcagctgcccccacagcagccctggcccccgctgccagaagccaggggccaagggctgtgagggccgctctggagatggagcctgtgatgctggctgcagcggccctgggggcaactgggatggaggagactgcagcctgggcgtgcctgacccctggaagggctgccccagccacagccgctgctggctgctcttcagagatggccagtgccacccccagtgtgacagtgaagaatgtctgtttgatggctatgactgtgagaccccaccagcctgcaccccagcctatgaccagtactgccacgaccacttccacaacggccactgtgagaagggctgcaacacagcagaatgtggctgggatggaggagactgcaggccagaagatggagaccctgagtggggccccagcctggccctgctggtggtgctgagccccccagccctggaccagcagctgtttgccctggcccgggtgctgagcctgaccctgcgggtgggcctgtgggtgaggaaggacagagatggccgggacatggtgtacccctacccaggggcccgggcagaggagaagctgggcggcacccgggaccccacctaccaggagagagctgccccccagacccagcccctgggcaaggagacagacagcctgtctgctggctttgtggtggtgatgggcgtggacctgagccgctgtggccctgaccacccagccagccgctgcccctgggaccccggcctgctgctgcgcttcctggccgccatggctgctgtgggcgccctggagcccctgctgcccggccccctgctggccgtgcacccccacgccggcacagcccccccagccaaccagctgccctggcctgtgctgtgcagccctgtggccggggtcatcctgctggccctgggcgccctgctggtgctgcagctgatcagaagaagaagaagagagcacggggccctgtggctgcccccaggcttcacccggcggcccaggacccagagcgccccccacagaagaagaccacccctgggggaggacagcatcggcctgaaggccctgaagcccaaggccgaggtggatgaagatggagtggtgatgtgcagcggccctgaggagggggaggaggtgggccaggccgaggagactggaccacccagcacctgccagctgtggagcctgagcggcggctgtggggccctgccccaggccgccatgctgaccccaccccaggagagcgagatggaggccccagacctggacacccggggcccagatggagtgacccccctgatgtctgctgtgtgctgcggggaggtgcagagcggcaccttccagggcgcctggctgggctgcccagagccctgggagcccctgctggatggaggagcctgcccccaggcccacacagtgggcactggagagacccccctgcacctggccgcccgcttcagccggcccacagctgcccggcggctgctggaggccggggccaaccccaaccagcctgaccgggccggccgcacccccctgcatgctgctgtggccgcagatgcccgggaggtgtgccagctgctgctgcggagccggcagacagctgtggatgccaggacagaagatggcaccacccccctgatgctggccgcccggctggccgtggaggacctggtggaggagctgattgctgcccaggctgatgtgggcgcccgggacaagtggggcaagacagccctgcactgggccgctgctgtgaacaatgcccgggccgcccggagcctgctgcaggccggggctgacaaggatgcccaggacaaccgggagcagacccccctcttcctggccgcccgggagggcgctgtggaggtggcccagctgctgctgggcctgggcgccgcccgggagctgcgggaccaggccggcctggccccagcagatgtggcccaccagaggaaccactgggacctgctgaccctgctggagggcgccggccccccagaggcccggcacaaggccaccccaggccgggaggccggccccttcccccgggccaggacagtgtctgtgtctgtgccccctcatggaggaggagccctgccccgctgcaggaccctgtctgctggggccggcccccggggcggcggggcctgcctgcaggcccggacctggagcgtggacctggccgcccggggcggcggggcctacagccactgccgcagcctgtctggagtgggcgccggcggcggccccaccccccggggccgccgcttctctgctggcatgaggggcccccggcccaacccagccatcatgaggggccgctatggagtggccgccggccggggcggccgggtgtccacagatgactggccctgtgactgggtggccctgggcgcctgtggcagcgccagcaacatccccatccccccaccctgcctgacccccagccctgagcggggcagcccccagctggactgtggccccccagccctgcaggagatgcccatcaaccagggcggggagggcaagaagtag

SEQ ID NO: 20855 - DNA, 561 bp, Artificial Sequence
  Description of Artificial Sequence: Synthetic coding sequence
atgtctgctgtgtgctgcggggaggtgcagagcggcaccttccagggcgcctggctgggctgcccagagccctgggagcccctgctggatggaggagcctgcccccaggcccacacagtgggcaccggggagacccccctgcacctggccgcccgcttcagccggcccacagctgcccggcggctgctggaggccggggccaaccccaaccagcctgacagagctggccgcacccccctgcacgccgctgtggccgcagatgcccgggaggtgtgccagctgctgctgcggagccggcagacagctgtggatgccaggacagaagatggcaccacccccctgatgctggccgcccggctggccgtggaggacctggtggaggagctgattgctgcccaggctgatgtgggcgcccgggacaagtggggcgcagatgctgccatccctggaggagctggccgcagcggcggcagcagccctgccacagctggagctgggggcagccccagggctgctggccctggctgggccagcgctgggggccgccgcagccccacctag

SEQ ID NO: 20856 - DNA, 1734 bp, Artificial Sequence
  Description of Artificial Sequence: Synthetic coding sequence
atgcactggctgaggaaggtgcagggcctgtgcaccctgtggggcacccagatgagcagcaggaccctgtacatcaacagccggcagctggtgtccctgcagtggggccaccaggaggtgcctgccaagttcaactttgccagtgatgtgctggaccactgggccgacatggagaaggccggcaagaggctgcccagccctgccctgtggtgggtgaatggcaagggcaaggagctgatgtggaacttccgggagctgtctgagaacagccagcaggccgccaacgtgctgagcggggcctgtggcctgcagagaggagacagagtggccgtggtgctgccccgggtgcctgagtggtggctggtgatcctgggctgcatccgggccggcctcatcttcatgcctggcaccatccagatgaagagcacagacatcctgtaccgcctgcagatgagcaaggccaaggccatcgtggccggagatgaagtcatccaggaggtggacacagtggcctctgaatgtcccagcctgcgcatcaagctgctggtgtctgagaagagctgtgatggctggctgaacttcaagaagctgctgaatgaggccagcaccacccaccactgtgtggagaccggcagccaggaggccagcgccatctacttcaccagcggcaccagcggcctgcccaagatggccgagcacagctacagcagcctgggcctgaaggccaagatggatgctggctggacaggcctgcaggccagtgacatcatgtggaccatcagtgacaccggctggatcctgaacatcctgtgcagcctgatggagccctgggccctgggcgcctgcacctttgtgcacctgctgcccaagtttgaccccctggtgatcctgaagaccctgagcagctaccccatcaagtccatgatgggcgcccccatcgtgtacaggatgctgctgcagcaggacctgagcagctacaagttcccccacctgcagaactgtgtgacagtgggggagagcctgctgcctgagaccctggagaactggagggcccagacaggcctggacatccgggagagctatggccagacagagaccggcctgacctgcatggtgtccaagaccatgaagatcaagccaggctacatgggcacagctgccagctgctatgatgtgcagatcattgatgacaagggaaatgtgctgcccccaggcacagaaggagacatcggcatccgggtgaagcccatccggcccatcggcatcttcagcggctacgtggacaacccagacaagacagctgccaacatccggggggacttctggctgctgggggaccggggcatcaaggatgaagatggctacttccagttcatgggccgggccaatgacatcatcaacagcagcggctacagaattggccccagcgaggtggagaatgccctgatggagcaccctgctgtggtggagacagctgtgatcagcagcccagaccctgtgcggggggaggtggtgaaggcctttgtggtgctggccagccagttcctgagccatgaccctgagcagctgaccaaggagctgcagcagcacgtgaagtctgtgacagccccctacaagtaccccaggaagattgaatttgtgctgaacctgcccaagacagtgacaggcaagatccagagggccaagctgcgggacaaggagtggaagatgtctgggaaggcccgggcccagtag

SEQ ID NO: 20857 - DNA, 4368 bp, Artificial Sequence
  Description of Artificial Sequence: Synthetic coding sequence
atgggcggggcctgcagcagcttcaccaccagcagcagccccaccatctacagcacctctgtgacagacagcaaggccatgcaggtggagagctgcagcagcgctgtgggcgtgagcaacagaggagtgtctgagaagcagctgaccagcaacacagtgcagcagcaccccagcacccccaagaggcacacagtgctgtacatcagccccccacctgaggacctgctggacaacagcaggatgagctgccaggatgagggctgcggcctggagagcgagcagagctgcagcatgtggatggaggacagccccagcaacttcagcaacatgagcaccagcagctacaatgacaacacagaggtgcccaggaagagcaggaagaggaaccccaagcagaggcctggggtgaagaggcgggactgtgaggagagcaacatggacatctttgatgctgacagcgccaaggccccccactacgtgctgagccagctgaccacagacaacaagggcaacagcaaggctggaaatggcaccctggagaaccagaagggcactggagtgaagaagagccccatgctgtgtggccagtaccctgtgaagtctgagggcaaggagctgaagatcgtggtgcagcctgagacccagcaccgggcccgctacctgacagagggcagccggggctctgtgaaggacaggacccagcagggcttccccaccgtgaagctggagggccacaatgaacctgtggtgctgcaggtgtttgtgggcaatgattctggccgggtgaagccccacggcttctaccaggcctgccgggtgacaggcaggaacaccaccccctgcaaggaggtggacatcgagggcaccaccgtcatcgaggtgggcctggaccccagcaacaacatgaccctggccgtggactgtgtgggcatcctgaagctgagaaatgctgatgtggaggccagaattggaattgctggcagcaagaagaagagcacccgggcccggctggtgttccgggtgaacatcatgaggaaggatggcagcaccctgaccctgcagacccccagcagccccatcctgtgcacccagcctgctggggtgcctgagatcctgaagaagagcctgcacagctgcagcgtgaagggggaggaggaggtgttcctgattggcaagaacttcctgaagggcaccaaggtgatcttccaggagaatgtgtctgatgaaaattcctggaagtctgaggccgagattgacatggagctgttccaccagaaccacctgattgtgaaggtgcccccctaccatgaccagcacatcaccctgcctgtgtctgtgggcatctacgtggtgaccaatgccggccgcagccatgatgtgcagcccttcacctacaccccagaccctgctgctgctggggccctgaatgtgaatgtgaagaaggagatcagcagccctgcccggccctgcagctttgaggaggccatgaaggccatgaagaccaccggctgcaacctggacaaggtgaacatcatccccaatgccctgatgacccccctcatccccagctccatgatcaagtcagaagatgtgacccccatggaggtgacagctgagaagaggagcagcaccatcttcaagaccaccaagtctgtgggcagcacccagcagaccctggagaacatcagcaacattgctggaaatggcagcttcagcagccccagcagcagccacctgcccagtgaaaatgagaagcagcagcagatccagcccaaggcctacaaccctgagaccctgaccaccatccagacccaggacatcagccagcccggcaccttccctgctgtgtctgccagcagccagctgcccaacagtgatgccctgctgcagcaggccacccagttccagacccgggagacccagagccgggagatcctgcagagtgatggcaccgtggtgaacctgagccagctgacagaggccagccagcagcagcagcagagccccctgcaggagcaggcccagaccctgcagcagcagatcagcagcaacatcttccccagccccaacagcgtgtcccagctgcagaacaccatccagcagctgcaggccggcagcttcaccggcagcacagccagcggcagcagcggctctgtggacctggtgcagcaggtgctggaggcccagcagcagctgagctctgtgctcttcagcgccccagatggaaatgaaaatgtgcaggagcagctgtctgctgacatcttccagcaggtgtcccagatccagagcggcgtgtccccaggcatgttcagcagcacagagcccaccgtgcacaccaggccagacaacctgctgcccggccgggcagagagcgtgcacccccagagcgagaacaccctgagcaaccagcagcagcagcagcagcagcagcagcaggtgatggagagcagcgctgccatggtgatggagatgcagcagagcatctgccaggccgccgcccagatccagagcgagctgttccccagcacagccagcgccaatggaaacctgcagcagagccctgtgtaccagcagaccagccacatgatgtctgccctgagcaccaatgaagacatgcagatgcagtgtgagctgttcagcagccccccagctgtgtctggaaatgagaccagcaccaccaccacccagcaggtggccaccccaggcaccaccatgttccagaccagcagcagtggagatggagaggagaccggcacccaggccaagcagatccagaacagcgtcttccagaccatggtgcagatgcagcacagcggggacaaccagccccaggtgaacctcttcagcagcaccaagtccatgatgtctgtgcagaacagcggcacccagcagcagggcaatggcctcttccagcagggcaatgagatgatgagcctgcagagcggcaacttcctgcagcagagcagccacagccaggcccagctgttccacccccagaaccccatcgcagatgcccagaacctgagccaggagacccagggcagcctcttccacagccccaaccccatcgtgcacagccagaccagcaccaccagcagcgagcagatgcagccccccatgttccacagccagagcaccatcgctgtgctgcagggcagctctgtgccccaggaccagcagagcaccaacatcttcctgagccagagccccatgaacaacctgcagaccaacacagtggcccaggaggccttctttgctgcccccaacagcatcagccccctgcagagcaccagcaacagcgagcagcaggccgccttccagcagcaggcccccatcagccacatccagacccccatgctgagccaggagcaggcccagcccccccagcagggcctcttccagccccaggtggccctgggcagcctgccccccaaccccatgccccagagccagcagggcaccatgttccagagccagcacagcatcgtggccatgcagagcaacagccccagccaggagcagcagcagcagcagcagcagcagcagcagcagcagcagcagcagcagcagagcatcctcttcagcaaccagaacaccatggccaccatggccagccccaagcagcccccacccaacatgatcttcaaccccaaccagaaccccatggccaaccaggagcagcagaaccagagcatcttccaccagcagagcaacatggcccccatgaaccaggagcagcagcccatgcagttccagagccagagcacagtgagcagcctgcagaaccctggccccacccagagcgagagcagccagacccccctcttccacagcagcccccagatccagctggtgcagggcagccccagcagccaggagcagcaggtgaccctcttcctgagccctgcctccatgtctgccctgcagaccagcatcaaccagcaggacatgcagcagagccccctgtacagcccccagaacaacatgcctggcatccagggcgccaccagcagcccccagccccaggccaccctcttccacaacacagctgggggcaccatgaaccagctgcagaacagccctggcagcagccagcagaccagcggcatgttcctgtttggcatccagaacaactgcagccagctgctgaccagcggccctgccaccctgcctgaccagctgatggccatcagccagcccggccagccccagaatgaaggccagccccctgtgaccaccctgctgagccagcagatgcctgagaacagccccctggccagcagcatcaacaccaaccagaacatcgagaagattgacctgctggtgtccctgcagaaccagggcaacaacctgaccggcagcttctag

SEQ ID NO: 20858 - DNA, 4647 bp, Artificial Sequence
  Description of Artificial Sequence: Synthetic coding sequence
atgcccagcgacttcatcagcctgctgtctgctgacctggacctggagagccccaagagcctgtacagccgggacagcctgaagctgcaccccagccagaacttccaccgggccggcctgctggaggagagcgtgtatgacctgctgcccaaggagctgcagctgccccccagccgggagacctctgtggcctccatgagccagaccagcggcggggaggccggcagccccccacctgctgtggtggccgcagatgccagcagcgcccccagcagcagctccatgggcggggcctgcagcagcttcaccaccagcagcagccccaccatctacagcacctctgtgacagacagcaaggccatgcaggtggagagctgcagcagcgctgtgggcgtgagcaacagaggagtgtctgagaagcagctgaccagcaacacagtgcagcagcaccccagcacccccaagaggcacacagtgctgtacatcagccccccacctgaggacctgctggacaacagcaggatgagctgccaggatgagggctgcggcctggagagcgagcagagctgcagcatgtggatggaggacagccccagcaacttcagcaacatgagcaccagcagctacaatgacaacacagaggtgcccaggaagagcaggaagaggaaccccaagcagaggcctggggtgaagaggcgggactgtgaggagagcaacatggacatctttgatgctgacagcgccaaggccccccactacgtgctgagccagctgaccacagacaacaagggcaacagcaaggctggaaatggcaccctggagaaccagaagggcactggagtgaagaagagccccatgctgtgtggccagtaccctgtgaagtctgagggcaaggagctgaagatcgtggtgcagcctgagacccagcaccgggcccgctacctgacagagggcagccggggctctgtgaaggacaggacccagcagggcttccccaccgtgaagctggagggccacaatgaacctgtggtgctgcaggtgtttgtgggcaatgattctggccgggtgaagccccacggcttctaccaggcctgccgggtgacaggcaggaacaccaccccctgcaaggaggtggacatcgagggcaccaccgtcatcgaggtgggcctggaccccagcaacaacatgaccctggccgtggactgtgtgggcatcctgaagctgagaaatgctgatgtggaggccagaattggaattgctggcagcaagaagaagagcacccgggcccggctggtgttccgggtgaacatcatgaggaaggatggcagcaccctgaccctgcagacccccagcagccccatcctgtgcacccagcctgctggggtgcctgagatcctgaagaagagcctgcacagctgcagcgtgaagggggaggaggaggtgttcctgattggcaagaacttcctgaagggcaccaaggtgatcttccaggagaatgtgtctgatgaaaattcctggaagtctgaggccgagattgacatggagctgttccaccagaaccacctgattgtgaaggtgcccccctaccatgaccagcacatcaccctgcctgtgtctgtgggcatctacgtggtgaccaatgccggccgcagccatgatgtgcagcccttcacctacaccccagaccctgctgctggggccctgaatgtgaatgtgaagaaggagatcagcagccctgcccggccctgcagctttgaggaggccatgaaggccatgaagaccaccggctgcaacctggacaaggtgaacatcatccccaatgccctgatgacccccctcatccccagctccatgatcaagtcagaagatgtgacccccatggaggtgacagctgagaagaggagcagcaccatcttcaagaccaccaagtctgtgggcagcacccagcagaccctggagaacatcagcaacattgctggaaatggcagcttcagcagccccagcagcagccacctgcccagtgaaaatgagaagcagcagcagatccagcccaaggcctacaaccctgagaccctgaccaccatccagacccaggacatcagccagcccggcaccttccctgctgtgtctgccagcagccagctgcccaacagtgatgccctgctgcagcaggccacccagttccagacccgggagacccagagccgggagatcctgcagagtgatggcaccgtggtgaacctgagccagctgacagaggccagccagcagcagcagcagagccccctgcaggagcaggcccagaccctgcagcagcagatcagcagcaacatcttccccagccccaacagcgtgtcccagctgcagaacaccatccagcagctgcaggccggcagcttcaccggcagcacagccagcggcagcagcggctctgtggacctggtgcagcaggtgctggaggcccagcagcagctgagctctgtgctcttcagcgccccagatggaaatgaaaatgtgcaggagcagctgtctgctgacatcttccagcaggtgtcccagatccagagcggcgtgtccccaggcatgttcagcagcacagagcccaccgtgcacaccaggccagacaacctgctgcccggccgggcagagagcgtgcacccccagagcgagaacaccctgagcaaccagcagcagcagcagcagcagcagcagcaggtgatggagagcagcgctgccatggtgatggagatgcagcagagcatctgccaggccgccgcccagatccagagcgagctgttccccagcacagccagcgccaacggcaacctgcagcagagccctgtgtaccagcagaccagccacatgatgtctgccctgagcaccaatgaagacatgcagatgcagtgtgagctgttcagcagccccccagctgtgtctggaaatgagaccagcaccaccaccacccagcaggtggccaccccaggcaccaccatgttccagaccagcagcagtggagatggagaggagaccggcacccaggccaagcagatccagaacagcgtcttccagaccatggtgcagatgcagcacagcggggacaaccagccccaggtgaacctcttcagcagcaccaagtccatgatgtctgtgcagaacagcggcacccagcagcagggcaatggcctcttccagcagggcaatgagatgatgagcctgcagagcggcaacttcctgcagcagagcagccacagccaggcccagctgttccacccccagaaccccatcgcagatgcccagaacctgagccaggagacccagggcagcctcttccacagccccaaccccatcgtgcacagccagaccagcaccaccagcagcgagcagatgcagccccccatgttccacagccagagcaccatcgctgtgctgcagggcagctctgtgccccaggaccagcagagcaccaacatcttcctgagccagagccccatgaacaacctgcagaccaacacagtggcccaggaggccttctttgctgcccccaacagcatcagccccctgcagagcaccagcaacagcgagcagcaggccgccttccagcagcaggcccccatcagccacatccagacccccatgctgagccaggagcaggcccagcccccccagcagggcctcttccagccccaggtggccctgggcagcctgccccccaaccccatgccccagagccagcagggcaccatgttccagagccagcacagcatcgtggccatgcagagcaacagccccagccaggagcagcagcagcagcagcagcagcagcagcagcagcagcagcagcagcagcagagcatcctcttcagcaaccagaacaccatggccaccatggccagccccaagcagcccccacccaacatgatcttcaaccccaaccagaaccccatggccaaccaggagcagcagaaccagagcatcttccaccagcagagcaacatggcccccatgaaccaggagcagcagcccatgcagttccagagccagagcacagtgagcagcctgcagaaccctggccccacccagagcgagagcagccagacccccctcttccacagcagcccccagatccagctggtgcagggcagccccagcagccaggagcagcaggtgaccctcttcctgagccctgcctccatgtctgccctgcagaccagcatcaaccagcaggacatgcagcagagccccctgtacagcccccagaacaacatgcctggcatccagggcgccaccagcagcccccagccccaggccaccctcttccacaacacagctgggggcaccatgaaccagctgcagaacagccctggcagcagccagcagaccagcggcatgttcctgtttggcatccagaacaactgcagccagctgctgaccagcggccctgccaccctgcctgaccagctgatggccatcagccagcccggccagccccagaatgaaggccagccccctgtgaccaccctgctgagccagcagatgcctgagaacagccccctggccagcagcatcaacaccaaccagaacatcgagaagattgacctgctggtgtccctgcagaaccagggcaacaacctgaccggcagcttctag

SEQ ID NO: 20859 - DNA, 4368 bp, Artificial Sequence; identical to SEQ ID NO: 20857
  Description of Artificial Sequence: Synthetic coding sequence

SEQ ID NO: 20860 - DNA, 4596 bp, Artificial Sequence
  Description of Artificial Sequence: Synthetic coding sequence
atgcccagcgacttcatcagcctgctgtctgctgacctggacctggagagccccaagagcctgtacagccgggagagcgtgtatgacctgctgcccaaggagctgcagctgccccccagccgggagacctctgtggcctccatgagccagaccagcggcggggaggccggcagccccccacctgctgtggtggccgcagatgccagcagcgcccccagcagcagctccatgggcggggcctgcagcagcttcaccaccagcagcagccccaccatctacagcacctctgtgacagacagcaaggccatgcaggtggagagctgcagcagcgctgtgggcgtgagcaacagaggagtgtctgagaagcagctgaccagcaacacagtgcagcagcaccccagcacccccaagaggcacacagtgctgtacatcagccccccacctgaggacctgctggacaacagcaggatgagctgccaggatgagggctgcggcctggagagcgagcagagctgcagcatgtggatggaggacagccccagcaacttcagcaacatgagcaccagcagctacaatgacaacacagaggtgcccaggaagagcaggaagaggaaccccaagcagaggcctggggtgaagaggcgggactgtgaggagagcaacatggacatctttgatgctgacagcgccaaggccccccactacgtgctgagccagctgaccacagacaacaagggcaacagcaaggctggaaatggcaccctggagaaccagaagggcactggagtgaagaagagccccatgctgtgtggccagtaccctgtgaagtctgagggcaaggagctgaagatcgtggtgcagcctgagacccagcaccgggcccgctacctgacagagggcagccggggctctgtgaaggacaggacccagcagggcttccccaccgtgaagctggagggccacaatgaacctgtggtgctgcaggtgtttgtgggcaatgattctggccgggtgaagccccacggcttctaccaggcctgccgggtgacaggcaggaacaccaccccctgcaaggaggtggacatcgagggcaccaccgtcatcgaggtgggcctggaccccagcaacaacatgaccctggccgtggactgtgtgggcatcctgaagctgagaaatgctgatgtggaggccagaattggaattgctggcagcaagaagaagagcacccgggcccggctggtgttccgggtgaacatcatgaggaaggatggcagcaccctgaccctgcagacccccagcagccccatcctgtgcacccagcctgctggggtgcctgagatcctgaagaagagcctgcacagctgcagcgtgaagggggaggaggaggtgttcctgattggcaagaacttcctgaagggcaccaaggtgatcttccaggagaatgtgtctgatgaaaattcctggaagtctgaggccgagattgacatggagctgttccaccagaaccacctgattgtgaaggtgcccccctaccatgaccagcacatcaccctgcctgtgtctgtgggcatctacgtggtgaccaatgccggccgcagccatgatgtgcagcccttcacctacaccccagaccctgctgctgctggggccctgaatgtgaatgtgaagaaggagatcagcagccctgcccggccctgcagctttgaggaggccatgaaggccatgaagaccaccggctgcaacctggacaaggtgaacatcatccccaatgccctgatgacccccctcatccccagctccatgatcaagtcagaagatgtgacccccatggaggtgacagctgagaagaggagcagcaccatcttcaagaccaccaagtctgtgggcagcacccagcagaccctggagaacatcagcaacattgctggaaatggcagcttcagcagccccagcagcagccacctgcccagtgaaaatgagaagcagcagcagatccagcccaaggcctacaaccctgagaccctgaccaccatccagacccaggacatcagccagcccggcaccttccctgctgtgtctgccagcagccagctgcccaacagtgatgccctgctgcagcaggccacccagttccagacccgggagacccagagccgggagatcctgcagagtgatggcaccgtggtgaacctgagccagctgacagaggccagccagcagcagcagcagagccccctgcaggagcaggcccagaccctgcagcagcagatcagcagcaacatcttccccagccccaacagcgtgtcccagctgcagaacaccatccagcagctgcaggccggcagcttcaccggcagcacagccagcggcagcagcggctctgtggacctggtgcagcaggtgctggaggcccagcagcagctgagctctgtgctcttcagcgccccagatggaaatgaaaatgtgcaggagcagctgtctgctgacatcttccagcaggtgtcccagatccagagcggcgtgtccccaggcatgttcagcagcacagagcccaccgtgcacaccaggccagacaacctgctgcccggccgggcagagagcgtgcacccccagagcgagaacaccctgagcaaccagcagcagcagcagcagcagcagcagcaggtgatggagagcagcgctgccatggtgatggagatgcagcagagcatctgccaggccgccgcccagatccagagcgagctgttccccagcacagccagcgccaatggaaacctgcagcagagccctgtgtaccagcagaccagccacatgatgtctgccctgagcaccaatgaagacatgcagatgcagtgtgagctgttcagcagccccccagctgtgtctggaaatgagaccagcaccaccaccacccagcaggtggccaccccaggcaccaccatgttccagaccagcagcagtggagatggagaggagaccggcacccaggccaagcagatccagaacagcgtcttccagaccatggtgcagatgcagcacagcggggacaaccagccccaggtgaacctcttcagcagcaccaagtccatgatgtctgtgcagaacagcggcacccagcagcagggcaatggcctcttccagcagggcaatgagatgatgagcctgcagagcggcaacttcctgcagcagagcagccacagccaggcccagctgttccacccccagaaccccatcgcagatgcccagaacctgagccaggagacccagggcagcctcttccacagccccaaccccatcgtgcacagccagaccagcaccaccagcagcgagcagatgcagccccccatgttccacagccagagcaccatcgctgtgctgcagggcagctctgtgccccaggaccagcagagcaccaacatcttcctgagccagagccccatgaacaacctgcagaccaacacagtggcccaggaggccttctttgctgcccccaacagcatcagccccctgcagagcaccagcaacagcgagcagcaggccgccttccagcagcaggcccccatcagccacatccagacccccatgctgagccaggagcaggcccagcccccccagcagggcctcttccagccccaggtggccctgggcagcctgccccccaaccccatgccccagagccagcagggcaccatgttccagagccagcacagcatcgtggccatgcagagcaacagccccagccaggagcagcagcagcagcagcagcagcagcagcagcagcagcagcagcagcagcagagcatcctcttcagcaaccagaacaccatggccaccatggccagccccaagcagcccccacccaacatgatcttcaaccccaaccagaaccccatggccaaccaggagcagcagaaccagagcatcttccaccagcagagcaacatggcccccatgaaccaggagcagcagcccatgcagttccagagccagagcacagtgagcagcctgcagaaccctggccccacccagagcgagagcagccagacccccctcttccacagcagcccccagatccagctggtgcagggcagccccagcagccaggagcagcaggtgaccctcttcctgagccctgcctccatgtctgccctgcagaccagcatcaaccagcaggacatgcagcagagccccctgtacagcccccagaacaacatgcctggcatccagggcgccaccagcagcccccagccccaggccaccctcttccacaacacagctgggggcaccatgaaccagctgcagaacagccctggcagcagccagcagaccagcggcatgttcctgtttggcatccagaacaactgcagccagctgctgaccagcggccctgccaccctgcctgaccagctgatggccatcagccagcccggccagccccagaatgaaggccagccccctgtgaccaccctgctgagccagcagatgcctgagaacagccccctggccagcagcatcaacaccaaccagaacatcgagaagattgacctgctggtgtccctgcagaaccagggcaacaacctgaccggcagcttctag

SEQ ID NO: 20861 - DNA, 4368 bp, Artificial Sequence; identical to SEQ ID NO: 20857
  Description of Artificial Sequence: Synthetic coding sequence

SEQ ID NO: 20862 - DNA, 4647 bp, Artificial Sequence; identical to SEQ ID NO: 20858
  Description of Artificial Sequence: Synthetic coding sequence

SEQ ID NO: 20863 - DNA, 4650 bp, Artificial Sequence
  Description of Artificial Sequence: Synthetic coding sequence
atgcccagcgacttcatcagcctgctgtctgctgacctggacctggagagccccaagagcctgtacagccgggacagcctgaagctgcaccccagccagaacttccaccgggccggcctgctggaggagagcgtgtatgacctgctgcccaaggagctgcagctgccccccagccgggagacctctgtggcctccatgagccagaccagcggcggggaggccggcagccccccacctgctgtggtggccgcagatgccagcagcgcccccagcagcagctccatgggcggggcctgcagcagcttcaccaccagcagcagccccaccatctacagcacctctgtgacagacagcaaggccatgcaggtggagagctgcagcagcgctgtgggcgtgagcaacagaggagtgtctgagaagcagctgaccagcaacacagtgcagcagcaccccagcacccccaagaggcacacagtgctgtacatcagccccccacctgaggacctgctggacaacagcaggatgagctgccaggatgagggctgcggcctggagagcgagcagagctgcagcatgtggatggaggacagccccagcaacttcagcaacatgagcaccagcagctacaatgacaacacagaggtgcccaggaagagcaggaagaggaaccccaagcagaggcctggggtgaagaggcgggactgtgaggagagcaacatggacatctttgatgctgacagcgccaaggccccccactacgtgctgagccagctgaccacagacaacaagggcaacagcaaggctggaaatggcaccctggagaaccagaagggcactggagtgaagaagagccccatgctgtgtggccagtaccctgtgaagtctgagggcaaggagctgaagatcgtggtgcagcctgagacccagcaccgggcccgctacctgacagagggcagccggggctctgtgaaggacaggacccagcagggcttccccaccgtgaagctggagggccacaatgaacctgtggtgctgcaggtgtttgtgggcaatgattctggccgggtgaagccccacggcttctaccaggcctgccgggtgacaggcaggaacaccaccccctgcaaggaggtggacatcgagggcaccaccgtcatcgaggtgggcctggaccccagcaacaacatgaccctggccgtggactgtgtgggcatcctgaagctgagaaatgctgatgtggaggccagaattggaattgctggcagcaagaagaagagcacccgggcccggctggtgttccgggtgaacatcatgaggaaggatggcagcaccctgaccctgcagacccccagcagccccatcctgtgcacccagcctgctggggtgcctgagatcctgaagaagagcctgcacagctgcagcgtgaagggggaggaggaggtgttcctgattggcaagaacttcctgaagggcaccaaggtgatcttccaggagaatgtgtctgatgaaaattcctggaagtctgaggccgagattgacatggagctgttccaccagaaccacctgattgtgaaggtgcccccctaccatgaccagcacatcaccctgcctgtgtctgtgggcatctacgtggtgaccaatgccggccgcagccatgatgtgcagcccttcacctacaccccagaccctgctgctgctggggccctgaatgtgaatgtgaagaaggagatcagcagccctgcccggccctgcagctttgaggaggccatgaaggccatgaagaccaccggctgcaacctggacaaggtgaacatcatccccaatgccctgatgacccccctcatccccagctccatgatcaagtcagaagatgtgacccccatggaggtgacagctgagaagaggagcagcaccatcttcaagaccaccaagtctgtgggcagcacccagcagaccctggagaacatcagcaacattgctggaaatggcagcttcagcagccccagcagcagccacctgcccagtgaaaatgagaagcagcagcagatccagcccaaggcctacaaccctgagaccctgaccaccatccagacccaggacatcagccagcccggcaccttccctgctgtgtctgccagcagccagctgcccaacagtgatgccctgctgcagcaggccacccagttccagacccgggagacccagagccgggagatcctgcagagtgatggcaccgtggtgaacctgagccagctgacagaggccagccagcagcagcagcagagccccctgcaggagcaggcccagaccctgcagcagcagatcagcagcaacatcttccccagccccaacagcgtgtcccagctgcagaacaccatccagcagctgcaggccggcagcttcaccggcagcacagccagcggcagcagcggctctgtggacctggtgcagcaggtgctggaggcccagcagcagctgagctctgtgctcttcagcgccccagatggaaatgaaaatgtgcaggagcagctgtctgctgacatcttccagcaggtgtcccagatccagagcggcgtgtccccaggcatgttcagcagcacagagcccaccgtgcacaccaggccagacaacctgctgcccggccgggcagagagcgtgcacccccagagcgagaacaccctgagcaaccagcagcagcagcagcagcagcagcagcaggtgatggagagcagcgctgccatggtgatggagatgcagcagagcatctgccaggccgccgcccagatccagagcgagctgttccccagcacagccagcgccaatggaaacctgcagcagagccctgtgtaccagcagaccagccacatgatgtctgccctgagcaccaatgaagacatgcagatgcagtgtgagctgttcagcagccccccagctgtgtctggaaatgagaccagcaccaccaccacccagcaggtggccaccccaggcaccaccatgttccagaccagcagcagtggagatggagaggagaccggcacccaggccaagcagatccagaacagcgtcttccagaccatggtgcagatgcagcacagcggggacaaccagccccaggtgaacctcttcagcagcaccaagtccatgatgtctgtgcagaacagcggcacccagcagcagggcaatggcctcttccagcagggcaatgagatgatgagcctgcagagcggcaacttcctgcagcagagcagccacagccaggcccagctgttccacccccagaaccccatcgcagatgcccagaacctgagccaggagacccagggcagcctcttccacagccccaaccccatcgtgcacagccagaccagcaccaccagcagcgagcagatgcagccccccatgttccacagccagagcaccatcgctgtgctgcagggcagctctgtgccccaggaccagcagagcaccaacatcttcctgagccagagccccatgaacaacctgcagaccaacacagtggcccaggaggccttctttgctgcccccaacagcatcagccccctgcagagcaccagcaacagcgagcagcaggccgccttccagcagcaggcccccatcagccacatccagacccccatgctgagccaggagcaggcccagcccccccagcagggcctcttccagccccaggtggccctgggcagcctgccccccaaccccatgccccagagccagcagggcaccatgttccagagccagcacagcatcgtggccatgcagagcaacagccccagccaggagcagcagcagcagcagcagcagcagcagcagcagcagcagcagcagcagcagagcatcctcttcagcaaccagaacaccatggccaccatggccagccccaagcagcccccacccaacatgatcttcaaccccaaccagaaccccatggccaaccaggagcagcagaaccagagcatcttccaccagcagagcaacatggcccccatgaaccaggagcagcagcccatgcagttccagagccagagcacagtgagcagcctgcagaaccctggccccacccagagcgagagcagccagacccccctcttccacagcagcccccagatccagctggtgcagggcagccccagcagccaggagcagcaggtgaccctcttcctgagccctgcctccatgtctgccctgcagaccagcatcaaccagcaggacatgcagcagagccccctgtacagcccccagaacaacatgcctggcatccagggcgccaccagcagcccccagccccaggccaccctcttccacaacacagctgggggcaccatgaaccagctgcagaacagccctggcagcagccagcagaccagcggcatgttcctgtttggcatccagaacaactgcagccagctgctgaccagcggccctgccaccctgcctgaccagctgatggccatcagccagcccggccagccccagaatgaaggccagccccctgtgaccaccctgctgagccagcagatgcctgagaacagccccctggccagcagcatcaacaccaaccagaacatcgagaagattgacctgctggtgtccctgcagaaccagggcaacaacctgaccggcagcttctag

SEQ ID NO: 20864 - DNA, 2151 bp, Artificial Sequence
  Description of Artificial Sequence: Synthetic coding sequence
atgcccagcaccagcttccctgtgcccagcaagttccccctgggccctgctgctgctgtgtttggccgcggggagaccctgggccctgcccccagggctgggggcaccatgaagtctgctgaggaggagcactacggctacgccagcagcaatgtgtccccagccctgcccctgcccacagcccacagcaccctgcctgccccctgccacaacctgcagaccagcaccccaggcatcatccccccagctgaccaccccagcggctatggagctgccctggatggcggccctgctggctacttcctgagcagcggccacaccaggccagatggagccccagccctggagagcccccgcatcgagatcaccagctgcctgggcctgtaccacaacaacaaccagttcttccatgatgtggaggtggaggatgtgctgcccagcagcaagaggagccccagcacagccaccctgagcctgcccagcctggaggcctacagagaccccagctgcctgagccctgccagcagcctgagcagccgcagctgcaacagcgaggccagcagctatgagagcaactacagctacccctatgccagcccccagaccagcccctggcagagcccctgtgtgagccccaagaccacagatcctgaggagggcttcccccggggcctgggcgcctgcaccctgctgggcagccccaggcacagccccagcaccagcccccgggcctctgtgacagaggagagctggctgggcgcccggagcagcaggcctgccagcccctgcaacaagaggaagtacagcctgaatggccggcagcccccctacagcccccaccacagccccacccccagcccccacggcagcccccgggtgtctgtgacagatgacagctggctgggcaacaccacccagtacaccagcagcgccatcgtggccgccatcaatgccctgaccacagacagcagcctggacctgggagatggagtgcctgtgaagagcaggaagaccaccctggagcagcccccatctgtggccctgaaggtggagcctgtgggggaggacctgggcagccccccacctcctgctgactttgcccctgaggactacagcagcttccagcacatcagaaaaggaggcttctgtgaccagtacctggccgtgccccagcacccctaccagtgggccaagcccaagcccctgagccccaccagctacatgagccccaccctgcctgccctggactggcagctgcccagccacagcggcccctatgagctgcgcatcgaggtgcagcccaagagccaccaccgggcccactatgaaacagagggcagcagaggagctgtgaaggccagcgctgggggccaccccatcgtgcagctgcacggctacctggagaatgagcccctgatgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgagaacagcatgagagctgtgattgactgtgccggcatcctgaagctgaggaacagcgacatcgagctgaggaagggggagacagacattggaaggaagaacaccagggtgcggctggtgttccgggtgcacgtgccccagcccagcggccgcaccctgagcctgcaggtggccagcaaccccatcgagtgcagccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaatggaaatgccatcttcctgactgtgtcccgggagcacgagcgggtgggctgcttcttctag

SEQ ID NO: 20865 - DNA, 2478 bp, Artificial Sequence
  Description of Artificial Sequence: Synthetic coding sequence
atgcccagcaccagcttccctgtgcccagcaagttccccctgggccctgctgctgctgtgtttggccgcggggagaccctgggccctgcccccagggctgggggcaccatgaagtctgctgaggaggagcactacggctacgccagcagcaatgtgtccccagccctgcccctgcccacagcccacagcaccctgcctgccccctgccacaacctgcagaccagcaccccaggcatcatccccccagctgaccaccccagcggctatggagctgccctggatggcggccctgctggctacttcctgagcagcggccacaccaggccagatggagccccagccctggagagcccccgcatcgagatcaccagctgcctgggcctgtaccacaacaacaaccagttcttccatgatgtggaggtggaggatgtgctgcccagcagcaagaggagccccagcacagccaccctgagcctgcccagcctggaggcctacagagaccccagctgcctgagccctgccagcagcctgagcagccgcagctgcaacagcgaggccagcagctatgagagcaactacagctacccctatgccagcccccagaccagcccctggcagagcccctgtgtgagccccaagaccacagatcctgaggagggcttcccccggggcctgggcgcctgcaccctgctgggcagccccaggcacagccccagcaccagcccccgggcctctgtgacagaggagagctggctgggcgcccggagcagcaggcctgccagcccctgcaacaagaggaagtacagcctgaatggccggcagcccccctacagcccccaccacagccccacccccagcccccacggcagcccccgggtgtctgtgacagatgacagctggctgggcaacaccacccagtacaccagcagcgccatcgtggccgccatcaatgccctgaccacagacagcagcctggacctgggagatggagtgcctgtgaagagcaggaagaccaccctggagcagcccccatctgtggccctgaaggtggagcctgtgggggaggacctgggcagccccccacctcctgctgactttgcccctgaggactacagcagcttccagcacatcagaaaaggaggcttctgtgaccagtacctggccgtgccccagcacccctaccagtgggccaagcccaagcccctgagccccaccagctacatgagccccaccctgcctgccctggactggcagctgcccagccacagcggcccctatgagctgcgcatcgaggtgcagcccaagagccaccaccgggcccactatgaaacagagggcagcagaggagctgtgaaggccagcgctgggggccaccccatcgtgcagctgcacggctacctggagaatgagcccctgatgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgagaacagcatgagagctgtgattgactgtgccggcatcctgaagctgaggaacagcgacatcgagctgaggaagggggagacagacattggaaggaagaacaccagggtgcggctggtgttccgggtgcacgtgccccagcccagcggccgcaccctgagcctgcaggtggccagcaaccccatcgagtgcagccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaacgtgcccatcatcaagacagagcccacagatgattatgagcccgcccccacctgtggccctgtgtcccagggcctgagccccctgccccggccctactacagccagcagctggccatgcccccagaccccagcagctgcctggtggccggcttccccccctgcccccagaggagcaccctgatgcctgctgcccctggggtgagccccaagctgcatgacctgagccctgctgcctacaccaagggcgtggccagccctggccactgccacctgggcctgccccagcctgctggggaggccccagctgtgcaggatgtgcccaggcctgtggccacccaccctggcagccctggccagcccccaccagccctgctgccccagcagtag

SEQ ID NO: 20866 - DNA, 2832 bp, Artificial Sequence
  Description of Artificial Sequence: Synthetic coding sequence
atgcccagcaccagcttccctgtgcccagcaagttccccctgggccctgctgctgctgtgtttggccgcggggagaccctgggccctgcccccagggctgggggcaccatgaagtctgctgaggaggagcactacggctacgccagcagcaatgtgtccccagccctgcccctgcccacagcccacagcaccctgcctgccccctgccacaacctgcagaccagcaccccaggcatcatccccccagctgaccaccccagcggctatggagctgccctggatggcggccctgctggctacttcctgagcagcggccacaccaggccagatggagccccagccctggagagcccccgcatcgagatcaccagctgcctgggcctgtaccacaacaacaaccagttcttccatgatgtggaggtggaggatgtgctgcccagcagcaagaggagccccagcacagccaccctgagcctgcccagcctggaggcctacagagaccccagctgcctgagccctgccagcagcctgagcagccgcagctgcaacagcgaggccagcagctatgagagcaactacagctacccctatgccagcccccagaccagcccctggcagagcccctgtgtgagccccaagaccacagatcctgaggagggcttcccccggggcctgggcgcctgcaccctgctgggcagccccaggcacagccccagcaccagcccccgggcctctgtgacagaggagagctggctgggcgcccggagcagcaggcctgccagcccctgcaacaagaggaagtacagcctgaatggccggcagcccccctacagcccccaccacagccccacccccagcccccacggcagcccccgggtgtctgtgacagatgacagctggctgggcaacaccacccagtacaccagcagcgccatcgtggccgccatcaatgccctgaccacagacagcagcctggacctgggagatggagtgcctgtgaagagcaggaagaccaccctggagcagcccccatctgtggccctgaaggtggagcctgtgggggaggacctgggcagccccccacctcctgctgactttgcccctgaggactacagcagcttccagcacatcagaaaaggaggcttctgtgaccagtacctggccgtgccccagcacccctaccagtgggccaagcccaagcccctgagccccaccagctacatgagccccaccctgcctgccctggactggcagctgcccagccacagcggcccctatgagctgcgcatcgaggtgcagcccaagagccaccaccgggcccactatgaaacagagggcagcagaggagctgtgaaggccagcgctgggggccaccccatcgtgcagctgcacggctacctggagaatgagcccctgatgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgagaacagcatgagagctgtgattgactgtgccggcatcctgaagctgaggaacagcgacatcgagctgaggaagggggagacagacattggaaggaagaacaccagggtgcggctggtgttccgggtgcacgtgccccagcccagcggccgcaccctgagcctgcaggtggccagcaaccccatcgagtgcagccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaacgtgcccatcatcaagacagagcccacagatgattatgagcccgcccccacctgtggccctgtgtcccagggcctgagccccctgccccggccctactacagccagcagctggccatgcccccagaccccagcagctgcctggtggccggcttccccccctgcccccagaggagcaccctgatgcctgctgcccctggggtgagccccaagctgcatgacctgagccctgctgcctacaccaagggcgtggccagccctggccactgccacctgggcctgccccagcctgctggggaggccccagctgtgcaggatgtgcccaggcctgtggccacccaccctggcagccctggccagcccccaccagccctgctgccccagcaggtgtctgccccacccagcagcagctgccccccaggcctggagcacagcctgtgccccagcagccccagcccccccctgcccccagccacccaggagcccacctgcctgcagccctgcagccctgcctgccccccagccaccggccggccccagcacctgcccagcacagtgagaagagatgagagccccacagctggcccccggctgctgcctgaggtgcatgaagatggcagccccaacctggcccccatccctgtgacagtgaagcgggagcctgaggagctggaccagctgtacctggatgatgtgaatgagatcatcagaaatgacctgagcagcaccagcacccacagctag

SEQ ID NO: 20867 - DNA, 2793 bp, Artificial Sequence
  Description of Artificial Sequence: Synthetic coding sequence
atgacaggcctggaggaccaggagtttgattttgagttcctgtttgagttcaaccagagagatgaaggagctgctgctgctgcccctgagcactacggctacgccagcagcaatgtgtccccagccctgcccctgcccacagcccacagcaccctgcctgccccctgccacaacctgcagaccagcaccccaggcatcatccccccagctgaccaccccagcggctacggggccgccctggatggcggccctgctggctacttcctgagcagcggccacaccaggccagatggagccccagccctggagagccccagaattgagatcaccagctgcctgggcctgtaccacaacaacaaccagttcttccatgatgtggaggtggaggatgtgctgcccagcagcaagaggagccccagcacagccaccctgagcctgcccagcctggaggcctacagagaccccagctgcctgagccctgccagcagcctgagcagccgcagctgcaacagcgaggccagcagctatgagagcaactacagctacccctatgccagcccccagaccagcccctggcagagcccctgtgtgagccccaagaccacagatcctgaggagggcttcccccggggcctgggcgcctgcaccctgctgggcagccccaggcacagccccagcaccagcccccgggcctctgtgacagaggagagctggctgggcgcccggagcagcaggcctgccagcccctgcaacaagaggaagtacagcctgaatggccggcagcccccctacagcccccaccacagccccacccccagcccccacggcagcccccgggtgtctgtgacagatgacagctggctgggcaacaccacccagtacaccagcagcgccatcgtggccgccatcaatgccctgaccacagacagcagcctggacctgggagatggagtgcctgtgaagagcaggaagaccaccctggagcagccccccagcgtggccctgaaggtggagcctgtgggggaggacctgggcagccccccacctcctgctgactttgcccctgaggactacagcagcttccagcacatcaggaagggcggcttctgtgaccagtacctggccgtgccccagcacccctaccagtgggccaagcccaagcccctgagccccaccagctacatgagccccaccctgcctgccctggactggcagctgcccagccacagcggcccctatgagctgagaattgaggtgcagcccaagagccaccaccgggcccactatgaaacagagggcagcagaggagctgtgaaggccagcgctgggggccaccccatcgtgcagctgcacggctacctggagaatgagcccctgatgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgaaaattccatgagagctgtgattgactgtgccggcatcctgaagctgaggaacagcgacatcgagctgaggaaaggagaaacagacatcggcaggaagaacaccagggtgcggctggtgttccgggtgcacgtgccccagcccagcggccgcaccctgagcctgcaggtggccagcaaccccattgaatgttcccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaacgtgcccatcatcaagacagagcccacagatgattatgagcccgcccccacctgtggccctgtgtcccagggcctgagccccctgccccggccctactacagccagcagctggccatgcccccagaccccagcagctgcctggtggccggcttccccccctgcccccagaggagcaccctgatgcctgctgcccctggggtgagccccaagctgcatgacctgagccctgctgcctacaccaagggcgtggccagccctggccactgccacctgggcctgccccagcctgctggggaggccccagctgtgcaggatgtgcccaggcctgtggccacccaccctggcagccctggccagcccccaccagccctgctgccccagcaggtgtctgccccacccagcagcagctgccccccaggcctggagcacagcctgtgccccagcagccccagcccccccctgcccccagccacccaggagcccacctgcctgcagccctgcagccctgcctgccccccagccaccggccggccccagcacctgcccagcacagtgagaagagatgagagccccacagctggcccccggctgctgcctgaggtgcatgaagatggcagccccaacctggcccccatccctgtgacagtgaagcgggagcctgaggagctggaccagctgtacctggatgatgtgaatgagatcatcagaaatgacctgagcagcaccagcacccacagctag

SEQ ID NO: 20868 - DNA, 1062 bp, Artificial Sequence
  Description of Artificial Sequence: Synthetic coding sequence
atgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgagaacagcatgagagctgtgattgactgtgccggcatcctgaagctgaggaacagcgacatcgagctgaggaagggggagacagacattggaaggaagaacaccagggtgcggctggtgttccgggtgcacgtgccccagcccagcggccgcaccctgagcctgcaggtggccagcaaccccatcgagtgcagccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaacgtgcccatcatcaagacagagcccacagatgattatgagcccgcccccacctgtggccctgtgtcccagggcctgagccccctgccccggccctactacagccagcagctggccatgcccccagaccccagcagctgcctggtggccggcttccccccctgcccccagaggagcaccctgatgcctgctgcccctggggtgagccccaagctgcatgacctgagccctgctgcctacaccaagggcgtggccagccctggccactgccacctgggcctgccccagcctgctggggaggccccagctgtgcaggatgtgcccaggcctgtggccacccaccctggcagccctggccagcccccaccagccctgctgccccagcagtag

SEQ ID NO: 20869 - DNA, 2724 bp, Artificial Sequence
  Description of Artificial Sequence: Synthetic coding sequence
atgaagagcggcaccctggagcactacggctacgccagcagcaatgtgtccccagccctgcccctgcccacagcccacagcaccctgcctgccccctgccacaacctgcagaccagcaccccaggcatcatccccccagctgaccaccccagcggctatggagctgccctggatggcggccctgctggctacttcctgagcagcggccacaccaggccagatggagccccagccctggagagcccccgcatcgagatcaccagctgcctgggcctgtaccacaacaacaaccagttcttccatgatgtggaggtggaggatgtgctgcccagcagcaagaggagccccagcacagccaccctgagcctgcccagcctggaggcctacagagaccccagctgcctgagccctgccagcagcctgagcagccgcagctgcaacagcgaggccagcagctatgagagcaactacagctacccctatgccagcccccagaccagcccctggcagagcccctgtgtgagccccaagaccacagatcctgaggagggcttcccccggggcctgggcgcctgcaccctgctgggcagccccaggcacagccccagcaccagcccccgggcctctgtgacagaggagagctggctgggcgcccggagcagcaggcctgccagcccctgcaacaagaggaagtacagcctgaatggccggcagcccccctacagcccccaccacagccccacccccagcccccacggcagcccccgggtgtctgtgacagatgacagctggctgggcaacaccacccagtacaccagcagcgccatcgtggccgccatcaatgccctgaccacagacagcagcctggacctgggagatggagtgcctgtgaagagcaggaagaccaccctggagcagcccccatctgtggccctgaaggtggagcctgtgggggaggacctgggcagccccccacctcctgctgactttgcccctgaggactacagcagcttccagcacatcagaaaaggaggcttctgtgaccagtacctggccgtgccccagcacccctaccagtgggccaagcccaagcccctgagccccaccagctacatgagccccaccctgcctgccctggactggcagctgcccagccacagcggcccctatgagctgcgcatcgaggtgcagcccaagagccaccaccgggcccactatgaaacagagggcagcagaggagctgtgaaggccagcgctgggggccaccccatcgtgcagctgcacggctacctggagaatgagcccctgatgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgagaacagcatgagagctgtgattgactgtgccggcatcctgaagctgaggaacagcgacatcgagctgaggaagggggagacagacattggaaggaagaacaccagggtgcggctggtgttccgggtgcacgtgccccagcccagcggccgcaccctgagcctgcaggtggccagcaaccccatcgagtgcagccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaacgtgcccatcatcaagacagagcccacagatgattatgagcccgcccccacctgtggccctgtgtcccagggcctgagccccctgccccggccctactacagccagcagctggccatgcccccagaccccagcagctgcctggtggccggcttccccccctgcccccagaggagcaccctgatgcctgctgcccctggggtgagccccaagctgcatgacctgagccctgctgcctacaccaagggcgtggccagccctggccactgccacctgggcctgccccagcctgctggggaggccccagctgtgcaggatgtgcccaggcctgtggccacccaccctggcagccctggccagcccccaccagccctgctgccccagcaggtgtctgccccacccagcagcagctgccccccaggcctggagcacagcctgtgccccagcagccccagcccccccctgcccccagccacccaggagcccacctgcctgcagccctgcagccctgcctgccccccagccaccggccggccccagcacctgcccagcacagtgagaagagatgagagccccacagctggcccccggctgctgcctgaggtgcatgaagatggcagccccaacctggcccccatccctgtgacagtgaagcgggagcctgaggagctggaccagctgtacctggatgatgtgaatgagatcatcagaaatgacctgagcagcaccagcacccacagctag

SEQ ID NO: 20870 - DNA, 2745 bp, Artificial Sequence
  Description of Artificial Sequence: Synthetic coding sequence
atgacaggcctggaggaccaggagtttgattttgagttcctgtttgagttcaaccagagagatgaaggagctgctgctgctgcccctgagcactacggctacgccagcagcaatgtgtccccagccctgcccctgcccacagcccacagcaccctgcctgccccctgccacaacctgcagaccagcaccccaggcatcatccccccagctgaccaccccagcggctacggggccgccctggatggcggccctgctggctacttcctgagcagcggccacaccaggccagatggagccccagccctggagagccccagaattgagatcaccagctgcctgggcctgtaccacaacaacaaccagttcttccatgatgtggaggtggaggatgtgctgcccagcagcaagaggagccccagcacagccaccctgagcctgcccagcctggaggcctacagagaccccagctgcctgagccctgccagcagcctgagcagccgcagctgcaacagcgaggccagcagctatgagagcaactacagctacccctatgccagcccccagaccagcccctggcagagcccctgtgtgagccccaagaccacagatcctgaggagggcttcccccggggcctgggcgcctgcaccctgctgggcagccccaggcacagccccagcaccagcccccgggcctctgtgacagaggagagctggctgggcgcccggagcagcaggcctgccagcccctgcaacaagaggaagtacagcctgaatggccggcagcccccctacagcccccaccacagccccacccccagcccccacggcagcccccgggtgtctgtgacagatgacagctggctgggcaacaccacccagtacaccagcagcgccatcgtggccgccatcaatgccctgaccacagacagcagcctggacctgggagatggagtgcctgtgaagagcaggaagaccaccctggagcagccccccagcgtggccctgaaggtggagcctgtgggggaggacctgggcagccccccacctcctgctgactttgcccctgaggactacagcagcttccagcacatcaggaagggcggcttctgtgaccagtacctggccgtgccccagcacccctaccagtgggccaagcccaagcccctgagccccaccagctacatgagccccaccctgcctgccctggactggcagctgcccagccacagcggcccctatgagctgagaattgaggtgcagcccaagagccaccaccgggcccactatgaaacagagggcagcagaggagctgtgaaggccagcgctgggggccaccccatcgtgcagctgcacggctacctggagaatgagcccctgatgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgaaaattccatgagagctgtgattgactgtgccggcatcctgaagctgaggaacagcgacatcgagctgaggaaaggagaaacagacatcggcaggaagaacaccagggtgcggctggtgttccgggtgcacgtgccccagcccagcggccgcaccctgagcctgcaggtggccagcaaccccattgaatgttcccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaacgtgcccatcatcaagacagagcccacagatgattatgagcccgcccccacctgtggccctgtgtcccagggcctgagccccctgccccggccctactacagccagcagctggccatgcccccagaccccagcagctgcctggtggccggcttccccccctgcccccagaggagcaccctgatgcctgctgcccctggggtgagccccaagctgcatgacctgagccctgctgcctacaccaagggcgtggccagccctggccactgccacctgggcctgccccagcctgctggggaggccccagctgtgcaggatgtgcccaggcctgtggccacccaccctggcagccctggccagcccccaccagccctgctgccccagcaggtgtctgccccacccagcagcagctgccccccaggcctggagcacagcctgtgccccagcagccccagcccccccctgcccccagccacccaggagcccacctgcctgcagccctgcagccctgcctgccccccagccaccggccggccccagcacctgcccagcacagtgagaagagatgagagccccacagctggcccccggctgctgcctgaggtgcatgaagatggcagccccaacctggcccccatccctgtgacagtgaagcgggagcctgaggagctggaccagctgtacctggatgactag

SEQ ID NO: 20871 - DNA, 2142 bp, Artificial Sequence
  Description of Artificial Sequence: Synthetic coding sequence
atgcccagcaccagcttccctgtgcccagcaagttccccctgggccctgctgctgctgtgtttggccgcggggagaccctgggccctgcccccagggctgggggcaccatgaagtctgctgaggaggagcactacggctacgccagcagcaatgtgtccccagccctgcccctgcccacagcccacagcaccctgcctgccccctgccacaacctgcagaccagcaccccaggcatcatccccccagctgaccaccccagcggctatggagctgccctggatggcggccctgctggctacttcctgagcagcggccacaccaggccagatggagccccagccctggagagcccccgcatcgagatcaccagctgcctgggcctgtaccacaacaacaaccagttcttccatgatgtggaggtggaggatgtgctgcccagcagcaagaggagccccagcacagccaccctgagcctgcccagcctggaggcctacagagaccccagctgcctgagccctgccagcagcctgagcagccgcagctgcaacagcgaggccagcagctatgagagcaactacagctacccctatgccagcccccagaccagcccctggcagagcccctgtgtgagccccaagaccacagatcctgaggagggcttcccccggggcctgggcgcctgcaccctgctgggcagccccaggcacagccccagcaccagcccccgggcctctgtgacagaggagagctggctgggcgcccggagcagcaggcctgccagcccctgcaacaagaggaagtacagcctgaatggccggcagcccccctacagcccccaccacagccccacccccagcccccacggcagcccccgggtgtctgtgacagatgacagctggctgggcaacaccacccagtacaccagcagcgccatcgtggccgccatcaatgccctgaccacagacagcagcctggacctgggagatggagtgcctgtgaagagcaggaagaccaccctggagcagcccccatctgtggccctgaaggtggagcctgtgggggaggacctgggcagccccccacctcctgctgactttgcccctgaggactacagcagcttccagcacatcagaaaaggaggcttctgtgaccagtacctggccgtgccccagcacccctaccagtgggccaagcccaagcccctgagccccaccagctacatgagccccaccctgcctgccctggactggcagctgcccagccacagcggcccctatgagctgcgcatcgaggtgcagcccaagagccaccaccgggcccactatgaaacagagggcagcagaggagctgtgaaggccagcgctgggggccaccccatcgtgcagctgcacggctacctggagaatgagcccctgatgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgagaacagcatgagagctgtgattgactgtgccggcatcctgaagctgaggaacagcgacatcgagctgaggaagggggagacagacattggaaggaagaacaccagggtgcggctggtgttccgggtgcacgtgccccagcccagcggccgcaccctgagcctgcaggtggccagcaaccccatcgagtgcagccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaacgtgaatgagatcatcagaaatgacctgagcagcaccagcacccacagctag

SEQ ID NO: 20872 - DNA, 1416 bp, Artificial Sequence
  Description of Artificial Sequence: Synthetic coding sequence
atgctgcagctgttcatcggcacagcagatgaccggctgctgcggccccacgccttctaccaggtgcaccgcatcaccgggaagacagtgtccaccaccagccatgaggccatcctgagcaacaccaaggtgctggagatccccctgctgcctgagaacagcatgagagctgtgattgactgtgccggcatcctgaagctgaggaacagcgacatcgagctgaggaagggggagacagacattggaaggaagaacaccagggtgcggctggtgttccgggtgcacgtgccccagcccagcggccgcaccctgagcctgcaggtggccagcaaccccatcgagtgcagccagaggtctgcccaggagctgcccctggtggagaagcagagcacagacagctaccctgtggtgggcggcaagaagatggtgctgagcggccacaacttcctgcaggacagcaaggtgatctttgtggagaaggccccagatggccaccacgtgtgggagatggaggccaagacagaccgggacctgtgcaagcccaacagcctggtggtggagatcccccccttcaggaaccagaggatcaccagccctgtgcacgtgtccttctacgtgtgcaatggcaagaggaagaggagccagtaccagcgcttcacctacctgcctgccaacgtgcccatcatcaagacagagcccacagatgattatgagcccgcccccacctgtggccctgtgtcccagggcctgagccccctgccccggccctactacagccagcagctggccatgcccccagaccccagcagctgcctggtggccggcttccccccctgcccccagaggagcaccctgatgcctgctgcccctggggtgagccccaagctgcatgacctgagccctgctgcctacaccaagggcgtggccagccctggccactgccacctgggcctgccccagcctgctggggaggccccagctgtgcaggatgtgcccaggcctgtggccacccaccctggcagccctggccagcccccaccagccctgctgccccagcaggtgtctgccccacccagcagcagctgccccccaggcctggagcacagcctgtgccccagcagccccagcccccccctgcccccagccacccaggagcccacctgcctgcagccctgcagccctgcctgccccccagccaccggccggccccagcacctgcccagcacagtgagaagagatgagagccccacagctggcccccggctgctgcctgaggtgcatgaagatggcagccccaacctggcccccatccctgtgacagtgaagcgggagcctgaggagctggaccagctgtacctggatgatgtgaatgagatcatcagaaatgacctgagcagcaccagcacccacagctag

SEQ ID NO: 20873 - DNA, 2766 bp, Artificial Sequence
  Description of Artificial Sequence: Synthetic coding sequence
atgaatgcccctgagcggcagccccagccagatggaggagatgcccctggccacgagcccggcggcagcccccaggatgagctggacttcagcatcctgtttgattatgagtacctgaaccccaatgaggaggagcccaatgcccacaaggtggccagcccccccagcggccctgcctacccagatgatgtgctggactatggcctgaagccctacagccccctggccagcctgtctggagagcccccaggccgctttggagagccagacagagtgggcccccagaagttcctgtctgctgccaagccagctggggccagcggcctgagccccagaattgagatcacccccagccatgagctgatccaggccgtgggccccctgaggatgagagatgctggcctgctggtggagcagccccccctggccggcgtggccgccagcccccgcttcaccctgcctgtgcccggctttgagggctaccgggagcccctgtgcctgagccctgccagcagcggcagcagcgccagcttcatcagtgacaccttcagcccctacaccagcccctgtgtgagccccaacaatggaggcccagatgacctgtgcccccagttccagaacatcccagcccactacagccccaggaccagccccatcatgagccccaggaccagcctggccgaggacagctgcctgggccgccacagccctgtgcccaggcctgccagccgcagcagcagccctggggccaagaggaggcacagctgtgccgaggccctggtggccctgcccccaggggccagcccccagaggagccgcagccccagcccccagcccagcagccacgtggccccccaggaccacggcagccctgctggctacccacctgtggccggcagcgctgtgatcatggatgccctgaacagcctggccacagacagcccctgtggcatcccccccaagatgtggaagaccagcccagaccccagccctgtgtctgctgcccccagcaaggccggcctgcccaggcacatctacccagctgtggagttcctgggcccctgtgagcagggcgagaggagaaattctgcccctgagagcatcctgctggtgccccccacctggcccaagcccctggtgcctgccatccccatctgcagcatccctgtgacagccagcctgccccccctggagtggcccctgagcagccagagcggcagctatgagctgcgcatcgaggtgcagcccaagccccaccaccgggcccactatgaaacagagggcagcagaggagctgtgaaggcccccactggaggccaccctgtggtgcagctgcacggctacatggagaacaagcccctgggcctgcagatcttcatcggcacagcagatgagcgcatcctgaagccccacgccttctaccaggtgcaccgcatcaccgggaagacagtgaccaccaccagctatgagaagatcgtgggcaacaccaaggtgctggagatccccctggagcccaagaacaacatgagggccaccatcgactgtgccggcatcctgaagctgagaaatgctgacatcgagctgaggaagggggagacagacattggaaggaagaacaccagggtgcggctggtgttccgggtgcacatccctgagagcagcggcagaattgtgtccctgcagacagccagcaaccccatcgagtgcagccagaggtctgcccacgagctgcccatggtggagcggcaggacacagacagctgcctggtgtatggaggccagcagatgatcctgaccggccagaacttcaccagcgagagcaaggtggtgttcacagagaagaccacagatggccagcagatctgggagatggaggccaccgtggacaaggacaagagccagcccaacatgctgtttgtggagatccctgagtacagaaacaagcacatccgcacccctgtgaaggtgaacttctacgtgatcaacgggaagaggaagaggagccagccccagcacttcacctaccaccctgtgcctgccatcaagacagagcccacagatgaatatgaccccaccctcatctgcagccccacccatggaggcctgggcagccagccctactacccccagcaccccatggtggccgagagccccagctgcctggtggccaccatggccccctgccagcagttcagaacaggcctgagcagcccagatgcccgctaccagcagcagaacccagctgctgtgctgtaccagaggagcaagagcctgagccccagcctgctgggctaccagcagcctgccctgatggccgcccccctgagcctggctgatgcccacaggtctgtgctggtgcacgccggcagccagggccagagcagcgccctgctgcaccccagccccaccaaccagcaggccagccctgtgatccactacagccccaccaaccagcagctgcgctgtggcagccaccaggagttccagcacatcatgtactgtgaaaattttgcccctggcaccacccggcccggccccccacctgtgtcccagggccagaggctgagccctggcagctaccccaccgtcatccagcagcagaatgccaccagccagagagctgccaagaatggacctcctgtgtctgaccagaaggaggtgctgcctgctggggtgaccatcaagcaggagcagaacctggaccagacctacctggatgatgagctgattgacacccacctgtcctggatccagaacatcctgtag

SEQ ID NO: 20874 - DNA, 978 bp, Artificial Sequence
  Description of Artificial Sequence: Synthetic coding sequence
atgagccccaggaccagcctggccgaggacagctgcctgggccgccacagccctgtgcccaggcctgccagccgcagcagcagccctggggccaagagaagacacagctgtgccgaggccctggtggccctgcccccaggggccagcccccagaggagccgcagccccagcccccagcccagcagccacgtggccccccaggaccacggcagccctgctggctacccacctgtggccggcagcgctgtgatcatggatgccctgaacagcctggccacagacagcccctgtggcatcccccccaagatgtggaagaccagcccagaccccagccctgtgtctgctgcccccagcaaggccggcctgcccaggcacatctacccagctgtggagttcctgggcccctgtgagcagggcgagaggaggaacagcgcccctgagagcatcctgctggtgccccccacctggcccaagcccctggtgcctgccatccccatctgcagcatccctgtgacagccagcctgccccccctggagtggcccctgagcagccagagcggcagctatgagctgagaattgaggtgcagcccaagccccaccaccgggcccactatgaaacagagggcagcagaggagctgtgaaggcccccaccggcggccaccctgtggtgcagctgcacggctacatggagaacaagcccctgggcctgcagatcttcatcggcacagcagatgagcgcatcctgaagccccacgccttctaccaggtgcaccgcatcaccgggaagacagtgaccaccaccagctatgagaagatcgtgggcaacaccaaggtgctggagatccccctggagcccagcacagccccccacctgctgagccccttcatgttcatcagccagcccggggtgcacacccgcatcaacgtgtgggccctgagcggcctgagcctgaaggagctggccaccagcctgtag

SEQ ID NO: 20875 - DNA, 2778 bp, Artificial Sequence
  Description of Artificial Sequence: Synthetic coding sequence
atgaatgcccctgagcggcagccccagccagatggaggagatgcccctggccacgagcccggcggcagcccccaggatgagctggacttcagcatcctgtttgattatgagtacctgaaccccaatgaggaggagcccaatgcccacaaggtggccagcccccccagcggccctgcctacccagatgatgtgctggactatggcctgaagccctacagccccctggccagcctgtctggagagcccccaggccgctttggagagccagacagagtgggcccccagaagttcctgtctgctgccaagccagctggggccagcggcctgagccccagaattgagatcacccccagccatgagctgatccaggccgtgggccccctgaggatgagagatgctggcctgctggtggagcagccccccctggccggcgtggccgccagcccccgcttcaccctgcctgtgcccggctttgagggctaccgggagcccctgtgcctgagccctgccagcagcggcagcagcgccagcttcatcagtgacaccttcagcccctacaccagcccctgtgtgagccccaacaatggaggcccagatgacctgtgcccccagttccagaacatcccagcccactacagccccaggaccagccccatcatgagccccaggaccagcctggccgaggacagctgcctgggccgccacagccctgtgcccaggcctgccagccgcagcagcagccctggggccaagaggaggcacagctgtgccgaggccctggtggccctgcccccaggggccagcccccagaggagccgcagccccagcccccagcccagcagccacgtggccccccaggaccacggcagccctgctggctacccacctgtggccggcagcgctgtgatcatggatgccctgaacagcctggccacagacagcccctgtggcatcccccccaagatgtggaagaccagcccagaccccagccctgtgtctgctgcccccagcaaggccggcctgcccaggcacatctacccagctgtggagttcctgggcccctgtgagcagggcgagaggagaaattctgcccctgagagcatcctgctggtgccccccacctggcccaagcccctggtgcctgccatccccatctgcagcatccctgtgacagccagcctgccccccctggagtggcccctgagcagccagagcggcagctatgagctgcgcatcgaggtgcagcccaagccccaccaccgggcccactatgaaacagagggcagcagaggagctgtgaaggcccccactggaggccaccctgtggtgcagctgcacggctacatggagaacaagcccctgggcctgcagatcttcatcggcacagcagatgagcgcatcctgaagccccacgccttctaccaggtgcaccgcatcaccgggaagacagtgaccaccaccagctatgagaagatcgtgggcaacaccaaggtgctggagatccccctggagcccaagaacaacatgagggccaccatcgactgtgccggcatcctgaagctgagaaatgctgacatcgagctgaggaagggggagacagacattggaaggaagaacaccagggtgcggctggtgttccgggtgcacatccctgagagcagcggcagaattgtgtccctgcagacagccagcaaccccatcgagtgcagccagaggtctgcccacgagctgcccatggtggagcggcaggacacagacagctgcctggtgtatggaggccagcagatgatcctgaccggccagaacttcaccagcgagagcaaggtggtgttcacagagaagaccacagatggccagcagatctgggagatggaggccaccgtggacaaggacaagagccagcccaacatgctgtttgtggagatccctgagtacagaaacaagcacatccgcacccctgtgaaggtgaacttctacgtgatcaacgggaagaggaagaggagccagccccagcacttcacctaccaccctgtgcctgccatcaagacagagcccacagatgaatatgaccccaccctcatctgcagccccacccatggaggcctgggcagccagccctactacccccagcaccccatggtggccgagagccccagctgcctggtggccaccatggccccctgccagcagttcagaacaggcctgagcagcccagatgcccgctaccagcagcagaacccagctgctgtgctgtaccagaggagcaagagcctgagccccagcctgctgggctaccagcagcctgccctgatggccgcccccctgagcctggctgatgcccacaggtctgtgctggtgcacgccggcagccagggccagagcagcgccctgctgcaccccagccccaccaaccagcaggccagccctgtgatccactacagccccaccaaccagcagctgcgctgtggcagccaccaggagttccagcacatcatgtactgtgaaaattttgcccctggcaccacccggcccggccccccacctgtgtcccagggccagaggctgagccctggcagctaccccaccgtcatccagcagcagaatgccaccagccagagagctgccaagaatggacctcctgtgtctgaccagaaggaggtgctgcctgctggggtgaccatcaagcaggagcagaacctggaccagacctacctggatgatgtgaatgagatcatcaggaaggagttcagcggccccccagccaggaaccagacctag

SEQ ID NO: 20876 - DNA, 2706 bp, Artificial Sequence
  Description of Artificial Sequence: Synthetic coding sequence
atgcagcgggaggccgccttccggctgggccactgccaccccctgcgcatcatgggctctgtggaccaggaggagcccaatgcccacaaggtggccagcccccccagcggccctgcctacccagatgatgtgctggactatggcctgaagccctacagccccctggccagcctgtctggagagcccccaggccgctttggagagccagacagagtgggcccccagaagttcctgtctgctgccaagccagctggggccagcggcctgagccccagaattgagatcacccccagccatgagctgatccaggccgtgggccccctgaggatgagagatgctggcctgctggtggagcagccccccctggccggcgtggccgccagcccccgcttcaccctgcctgtgcccggctttgagggctaccgggagcccctgtgcctgagccctgccagcagcggcagcagcgccagcttcatcagtgacaccttcagcccctacaccagcccctgtgtgagccccaacaatggaggcccagatgacctgtgcccccagttccagaacatcccagcccactacagccccaggaccagccccatcatgagccccaggaccagcctggccgaggacagctgcctgggccgccacagccctgtgcccaggcctgccagccgcagcagcagccctggggccaagaggaggcacagctgtgccgaggccctggtggccctgcccccaggggccagcccccagaggagccgcagccccagcccccagcccagcagccacgtggccccccaggaccacggcagccctgctggctacccacctgtggccggcagcgctgtgatcatggatgccctgaacagcctggccacagacagcccctgtggcatcccccccaagatgtggaagaccagcccagaccccagccctgtgtctgctgcccccagcaaggccggcctgcccaggcacatctacccagctgtggagttcctgggcccctgtgagcagggcgagaggagaaattctgcccctgagagcatcctgctggtgccccccacctggcccaagcccctggtgcctgccatccccatctgcagcatccctgtgacagccagcctgccccccctggagtggcccctgagcagccagagcggcagctatgagctgcgcatcgaggtgcagcccaagccccaccaccgggcccactatgaaacagagggcagcagaggagctgtgaaggcccccactggaggccaccctgtggtgcagctgcacggctacatggagaacaagcccctgggcctgcagatcttcatcggcacagcagatgagcgcatcctgaagccccacgccttctaccaggtgcaccgcatcaccgggaagacagtgaccaccaccagctatgagaagatcgtgggcaacaccaaggtgctggagatccccctggagcccaagaacaacatgagggccaccatcgactgtgccggcatcctgaagctgagaaatgctgacatcgagctgaggaagggggagacagacattggaaggaagaacaccagggtgcggctggtgttccgggtgcacatccctgagagcagcggcagaattgtgtccctgcagacagccagcaaccccatcgagtgcagccagaggtctgcccacgagctgcccatggtggagcggcaggacacagacagctgcctggtgtatggaggccagcagatgatcctgaccggccagaacttcaccagcgagagcaaggtggtgttcacagagaagaccacagatggccagcagatctgggagatggaggccaccgtggacaaggacaagagccagcccaacatgctgtttgtggagatccctgagtacagaaacaagcacatccgcacccctgtgaaggtgaacttctacgtgatcaacgggaagaggaagaggagccagccccagcacttcacctaccaccctgtgcctgccatcaagacagagcccacagatgaatatgaccccaccctcatctgcagccccacccatggaggcctgggcagccagccctactacccccagcaccccatggtggccgagagccccagctgcctggtggccaccatggccccctgccagcagttcagaacaggcctgagcagcccagatgcccgctaccagcagcagaacccagctgctgtgctgtaccagaggagcaagagcctgagccccagcctgctgggctaccagcagcctgccctgatggccgcccccctgagcctggctgatgcccacaggtctgtgctggtgcacgccggcagccagggccagagcagcgccctgctgcaccccagccccaccaaccagcaggccagccctgtgatccactacagccccaccaaccagcagctgcgctgtggcagccaccaggagttccagcacatcatgtactgtgaaaattttgcccctggcaccacccggcccggccccccacctgtgtcccagggccagaggctgagccctggcagctaccccaccgtcatccagcagcagaatgccaccagccagagagctgccaagaatggacctcctgtgtctgaccagaaggaggtgctgcctgctggggtgaccatcaagcaggagcagaacctggaccagacctacctggatgatgagctgattgacacccacctgtcctggatccagaacatcctgtag

SEQ ID NO: 20877 - DNA, 3207 bp, Artificial Sequence
  Description of Artificial Sequence: Synthetic coding sequence
atgaccacagccaactgtggggcccatgatgagctggacttcaagctggtgtttggagaagatggagccccagcccctcctcctcctggcagcaggcctgctgacctggagccagatgactgtgccagcatctacatcttcaacgtggaccccccacccagcaccctgaccacccccctgtgcctgccccaccacggcctgcccagccacagctctgtgctgagccccagcttccagctgcagagccacaagaactatgagggcacctgtgagatccctgagagcaagtacagccccctgggcggccccaagccctttgaatgtcccagcatccagatcaccagcatcagccccaactgccaccaggagctggatgcccatgaagatgacctgcagatcaatgaccctgagcgggagttcctggagcggcccagccgggaccacctgtacctgcccctggagcccagctaccgggagagcagcctgagccccagccctgccagcagcatcagcagccgctcctggttcagtgatgccagcagctgtgagagcctgagccacatctatgatgatgtggacagcgagctgaatgaagctgctgcccgcttcaccctgggcagccccctgaccagccctgggggcagccctgggggctgccctggagaggagacctggcaccagcagtatggcctgggccacagcctgagcccccggcagagcccctgccacagccccaggagctctgtgacagatgagaactggctgagccccaggcctgccagcggccccagcagccggcccaccagcccctgtgggaagaggaggcacagcagcgctgaggtgtgctacgccggcagcctgagcccccaccacagccctgtgcccagccctggccacagcccccggggctctgtgacagaggacacctggctgaatgcctctgtgcacggcggcagcggcctgggccctgctgtgttccccttccagtactgtgtggagacagacatccccctgaagaccaggaagaccagcgaggaccaggccgccatcctgcccgggaagctggagctgtgcagtgatgaccagggcagcctgagccctgcccgggagaccagcattgatgatggcctgggcagccagtaccccctgaagaaggacagctgtggggaccagttcctgtctgtgcccagccccttcacctggagcaagcccaagccaggccacacccccatcttccgcaccagcagcctgccccccctggactggcccctgcctgcccacttcggccagtgtgagctgaagattgaggtgcagcccaagacccaccaccgggcccactatgaaacagagggcagcagaggagctgtgaaggccagcactggaggccaccctgtggtgaagctgctgggctacaatgagaagcccatcaacctgcagatgttcatcggcacagcagatgaccgctacctgcggccccacgccttctaccaggtgcaccgcatcaccgggaagacagtggccacagccagccaggagatcatcatcgccagcaccaaggtgctggagatccccctgctgcctgagaacaacatgtctgccagcattgactgtgccggcatcctgaagctgaggaacagcgacatcgagctgaggaagggggagacagacattggaaggaagaacaccagggtgcggctggtgttccgggtgcacatcccccagcccagcggcaaggtgctgagcctgcagatcgccagcatccctgtggagtgcagccagaggtctgcccaggagctgccccacatcgagaagtacagcatcaacagctgcagcgtgaatggaggccacgagatggtggtgacaggcagcaacttcctgcctgagagcaagatcatcttcctggagaagggccaggacggccggccccagtgggaggtggagggcaagatcatccgggagaagtgccagggcgcccacatcgtgctggaggtgcccccctaccacaacccagctgtgacagctgctgtgcaggtgcacttctacctgtgcaatggcaagaggaagaagagccagagccagcgcttcacctacacccctgtgctgatgaagcaggagcaccgggaggagattgacctgagctctgtgcccagcctgcctgtgccccacccagcccagacccagaggcccagcagtgacagcggctgcagccatgattctgtgctgagcggccagaggagcctcatctgcagcatcccccagacctacgcctccatggtgaccagcagccacctgccccagctgcagtgcagagatgaatctgtgtccaaggagcagcacatgatccccagccccatcgtgcaccagcccttccaggtgacccccaccccacctgtgggcagcagctaccagcccatgcagaccaacgtggtgtacaacggccccacctgcctgcccatcaatgctgccagcagccaggagtttgattctgtgctcttccagcaggatgccaccctgagcggcctggtgaacctgggctgccagcccctgagcagcatccccttccacagcagcaacagcggcagcacaggccacctgctggcccacaccccccacagcgtgcacaccctgccccacctgcagagcatgggctaccactgcagcaacacaggccagaggagcctgagcagccctgtggccgaccagatcaccggccagcccagcagccagctgcagcccatcacctacggccccagccacagcggcagcgccaccacagccagccctgctgccagccaccccctggccagcagccccctgagcggcccccccagcccccagctgcagcccatgccctaccagagccccagcagcggcacagccagcagccccagccctgccaccaggatgcacagcggccagcacagcacccaggcccagagcacaggccagggcggcctgagcgcccccagcagcctcatctgccacagcctgtgtgaccctgccagcttccccccagatggagccaccgtgtccatcaagccagagccagaagatcgggagcccaactttgccaccatcggcctgcaggacatcaccctggatgatgaccagttcatcagtgacctggagcaccagcccagcggcagcgctgagaagtggcccaaccacagcgtgctgagctgcccagcccccttctggaggatctag

SEQ ID NO: 20878 - DNA, 3228 bp, Artificial Sequence
  Description of Artificial Sequence: Synthetic coding sequence
atgaccacagccaactgtggggcccatgatgagctggacttcaagctggtgtttggagaagatggagccccagcccctcctcctcctggcagcaggcctgctgacctggagccagatgactgtgccagcatctacatcttcaacgtggaccccccacccagcaccctgaccacccccctgtgcctgccccaccacggcctgcccagccacagctctgtgctgagccccagcttccagctgcagagccacaagaactatgagggcacctgtgagatccctgagagcaagtacagccccctgggcggccccaagccctttgaatgtcccagcatccagatcaccagcatcagccccaactgccaccaggagctggatgcccatgaagatgacctgcagatcaatgaccctgagcgggagttcctggagcggcccagccgggaccacctgtacctgcccctggagcccagctaccgggagagcagcctgagccccagccctgccagcagcatcagcagccgctcctggttcagtgatgccagcagctgtgagagcctgagccacatctatgatgatgtggacagcgagctgaatgaagctgctgcccgcttcaccctgggcagccccctgaccagccctgggggcagccctgggggctgccctggagaggagacctggcaccagcagtatggcctgggccacagcctgagcccccggcagagcccctgccacagccccaggagctctgtgacagatgagaactggctgagccccaggcctgccagcggccccagcagccggcccaccagcccctgtgggaagaggaggcacagcagcgctgaggtgtgctacgccggcagcctgagcccccaccacagccctgtgcccagccctggccacagcccccggggctctgtgacagaggacacctggctgaatgcctctgtgcacggcggcagcggcctgggccctgctgtgttccccttccagtactgtgtggagacagacatccccctgaagaccaggaagaccagcgaggaccaggccgccatcctgcccgggaagctggagctgtgcagtgatgaccagggcagcctgagccctgcccgggagaccagcattgatgatggcctgggcagccagtaccccctgaagaaggacagctgtggggaccagttcctgtctgtgcccagccccttcacctggagcaagcccaagccaggccacacccccatcttccgcaccagcagcctgccccccctggactggcccctgcctgcccacttcggccagtgtgagctgaagattgaggtgcagcccaagacccaccaccgggcccactatgaaacagagggcagcagaggagctgtgaaggccagcactggaggccaccctgtggtgaagctgctgggctacaatgagaagcccatcaacctgcagatgttcatcggcacagcagatgaccgctacctgcggccccacgccttctaccaggtgcaccgcatcaccgggaagacagtggccacagccagccaggagatcatcatcgccagcaccaaggtgctggagatccccctgctgcctgagaacaacatgtctgccagcattgactgtgccggcatcctgaagctgaggaacagcgacatcgagctgaggaagggggagacagacattggaaggaagaacaccagggtgcggctggtgttccgggtgcacatcccccagcccagcggcaaggtgctgagcctgcagatcgccagcatccctgtggagtgcagccagaggtctgcccaggagctgccccacatcgagaagtacagcatcaacagctgcagcgtgaatggaggccacgagatggtggtgacaggcagcaacttcctgcctgagagcaagatcatcttcctggagaagggccaggacggccggccccagtgggaggtggagggcaagatcatccgggagaagtgccagggcgcccacatcgtgctggaggtgcccccctaccacaacccagctgtgacagctgctgtgcaggtgcacttctacctgtgcaatggcaagaggaagaagagccagagccagcgcttcacctacacccctgtgctgatgaagcaggagcaccgggaggagattgacctgagctctgtgcccagcctgcctgtgccccacccagcccagacccagaggcccagcagtgacagcggctgcagccatgattctgtgctgagcggccagaggagcctcatctgcagcatcccccagacctacgcctccatggtgaccagcagccacctgccccagctgcagtgcagagatgaatctgtgtccaaggagcagcacatgatccccagccccatcgtgcaccagcccttccaggtgacccccaccccacctgtgggcagcagctaccagcccatgcagaccaacgtggtgtacaacggccccacctgcctgcccatcaatgctgccagcagccaggagtttgattctgtgctcttccagcaggatgccaccctgagcggcctggtgaacctgggctgccagcccctgagcagcatccccttccacagcagcaacagcggcagcacaggccacctgctggcccacaccccccacagcgtgcacaccctgccccacctgcagagcatgggctaccactgcagcaacacaggccagaggagcctgagcagccctgtggccgaccagatcaccggccagcccagcagccagctgcagcccatcacctacggccccagccacagcggcagcgccaccacagccagccctgctgccagccaccccctggccagcagccccctgagcggcccccccagcccccagctgcagcccatgccctaccagagccccagcagcggcacagccagcagccccagccctgccaccaggatgcacagcggccagcacagcacccaggcccagagcacaggccagggcggcctgagcgcccccagcagcctcatctgccacagcctgtgtgaccctgccagcttccccccagatggagccaccgtgtccatcaagccagagccagaagatcgggagcccaactttgccaccatcggcctgcaggacatcaccctggatgatgtgaatgagatcatcggccgggacatgagccagatctctgtgtcccagggcgccggcgtgtcccggcaggcccccctgcccagccctgagagcctggacctgggccgcagtgatggcctgtag

SEQ ID NO: 20879 - DNA, 3198 bp, Artificial Sequence
  Description of Artificial Sequence: Synthetic coding sequence
atgaccacagccaactgtggggcccatgatgagctggacttcaagctggtgtttggagaagatggagccccagcccctcctcctcctggcagcaggcctgctgacctggagccagatgactgtgccagcatctacatcttcaacgtggaccccccacccagcaccctgaccacccccctgtgcctgccccaccacggcctgcccagccacagctctgtgctgagccccagcttccagctgcagagccacaagaactatgagggcacctgtgagatccctgagagcaagtacagccccctgggcggccccaagccctttgaatgtcccagcatccagatcaccagcatcagccccaactgccaccaggagctggatgcccatgaagatgacctgcagatcaatgaccctgagcgggagttcctggagcggcccagccgggaccacctgtacctgcccctggagcccagctaccgggagagcagcctgagccccagccctgccagcagcatcagcagccgctcctggttcagtgatgccagcagctgtgagagcctgagccacatctatgatgatgtggacagcgagctgaatgaagctgctgcccgcttcaccctgggcagccccctgaccagccctgggggcagccctgggggctgccctggagaggagacctggcaccagcagtatggcctgggccacagcctgagcccccggcagagcccctgccacagccccaggagctctgtgacagatgagaactggctgagccccaggcctgccagcggccccagcagccggcccaccagcccctgtgggaagaggaggcacagcagcgctgaggtgtgctacgccggcagcctgagcccccaccacagccctgtgcccagccctggccacagcccccggggctctgtgacagaggacacctggctgaatgcctctgtgcacggcggcagcggcctgggccctgctgtgttccccttccagtactgtgtggagacagacatccccctgaagaccaggaagaccagcgaggaccaggccgccatcctgcccgggaagctggagctgtgcagtgatgaccagggcagcctgagccctgcccgggagaccagcattgatgatggcctgggcagccagtaccccctgaagaaggacagctgtggggaccagttcctgtctgtgcccagccccttcacctggagcaagcccaagccaggccacacccccatcttccgcaccagcagcctgccccccctggactggcccctgcctgcccacttcggccagtgtgagctgaagattgaggtgcagcccaagacccaccaccgggcccactatgaaacagagggcagcagaggagctgtgaaggccagcactggaggccaccctgtggtgaagctgctgggctacaatgagaagcccatcaacctgcagatgttcatcggcacagcagatgaccgctacctgcggccccacgccttctaccaggtgcaccgcatcaccgggaagacagtggccacagccagccaggagatcatcatcgccagcaccaaggtgctggagatccccctgctgcctgagaacaacatgtctgccagcattgactgtgccggcatcctgaagctgaggaacagcgacatcgagctgaggaagggggagacagacattggaaggaagaacaccagggtgcggctggtgttccgggtgcacatcccccagcccagcggcaaggtgctgagcctgcagatcgccagcatccctgtggagtgcagccagaggtctgcccaggagctgccccacatcgagaagtacagcatcaacagctgcagcgtgaatggaggccacgagatggtggtgacaggcagcaacttcctgcctgagagcaagatcatcttcctggagaagggccaggacggccggccccagtgggaggtggagggcaagatcatccgggagaagtgccagggcgcccacatcgtgctggaggtgcccccctaccacaacccagctgtgacagctgctgtgcaggtgcacttctacctgtgcaatggcaagaggaagaagagccagagccagcgcttcacctacacccctgtgctgatgaagcaggagcaccgggaggagattgacctgagctctgtgcccagcctgcctgtgccccacccagcccagacccagaggcccagcagtgacagcggctgcagccatgattctgtgctgagcggccagaggagcctcatctgcagcatcccccagacctacgcctccatggtgaccagcagccacctgccccagctgcagtgcagagatgaatctgtgtccaaggagcagcacatgatccccagccccatcgtgcaccagcccttccaggtgacccccaccccacctgtgggcagcagctaccagcccatgcagaccaacgtggtgtacaacggccccacctgcctgcccatcaatgctgccagcagccaggagtttgattctgtgctcttccagcaggatgccaccctgagcggcctggtgaacctgggctgccagcccctgagcagcatccccttccacagcagcaacagcggcagcacaggccacctgctggcccacaccccccacagcgtgcacaccctgccccacctgcagagcatgggctaccactgcagcaacacaggccagaggagcctgagcagccctgtggccgaccagatcaccggccagcccagcagccagctgcagcccatcacctacggccccagccacagcggcagcgccaccacagccagccctgctgccagccaccccctggccagcagccccctgagcggcccccccagcccccagctgcagcccatgccctaccagagccccagcagcggcacagccagcagccccagccctgccaccaggatgcacagcggccagcacagcacccaggcccagagcacaggccagggcggcctgagcgcccccagcagcctcatctgccacagcctgtgtgaccctgccagcttccccccagatggagccaccgtgtccatcaagccagagccagaagatcgggagcccaactttgccaccatcggcctgcaggacatcaccctggatgatgacctcttcaccagcaacaactttgacctgctgcagctgcggcccaccttctggcctgtgcctgctggccgctacctgaggaacctggagtag

SEQ ID NO: 20880 - DNA, 1770 bp, Artificial Sequence
  Description of Artificial Sequence: Synthetic coding sequence
atgtttattggaacagcagatgaccgctacctgcggccccacgccttctaccaggtgcaccgcatcaccgggaagacagtggccacagccagccaggagatcatcatcgccagcaccaaggtgctggagatccccctgctgcctgagaacaacatgtctgccagcattgactgtgccggcatcctgaagctgaggaacagcgacatcgagctgaggaaaggagaaacagacatcggcaggaagaacaccagggtgcggctggtgttccgggtgcacatcccccagcccagcggcaaggtgctgagcctgcagatcgccagcatccctgtggagtgcagccagaggtctgcccaggagctgccccacatcgagaagtacagcatcaacagctgcagcgtgaatggaggccacgagatggtggtgacaggcagcaacttcctgcctgagagcaagatcatcttcctggagaagggccaggacggccggccccagtgggaggtggagggcaagatcatccgggagaagtgccagggcgcccacatcgtgctggaggtgcccccctaccacaacccagctgtgacagctgctgtgcaggtgcacttctacctgtgcaatggcaagaggaagaagagccagagccagcgcttcacctacacccctgtgctgatgaagcaggagcaccgggaggagattgacctgagctctgtgcccagcctgcctgtgccccacccagcccagacccagaggcccagcagtgacagcggctgcagccatgacagcgtgctgagcggccagaggagcctcatctgcagcatcccccagacctacgcctccatggtgaccagcagccacctgccccagctgcagtgcagagatgagagcgtgtccaaggagcagcacatgatccccagccccatcgtgcaccagcccttccaggtgacccccaccccacctgtgggcagcagctaccagcccatgcagaccaacgtggtgtacaacggccccacctgcctgcccatcaatgctgccagcagccaggagtttgacagcgtgctcttccagcaggatgccaccctgagcggcctggtgaacctgggctgccagcccctgagcagcatccccttccacagcagcaacagcggcagcacaggccacctgctggcccacaccccccacagcgtgcacaccctgccccacctgcagagcatgggctaccactgcagcaacacaggccagaggagcctgagcagccctgtggccgaccagatcaccggccagcccagcagccagctgcagcccatcacctacggccccagccacagcggcagcgccaccacagccagccctgctgccagccaccccctggccagcagccccctgagcggcccccccagcccccagctgcagcccatgccctaccagagccccagcagcggcacagccagcagccccagccctgccaccaggatgcacagcggccagcacagcacccaggcccagagcacaggccagggcggcctgagcgcccccagcagcctcatctgccacagcctgtgtgaccctgccagcttccccccagatggagccaccgtgtccatcaagccagagcctgaggaccgggagcccaactttgccaccatcggcctgcaggacatcaccctggatgatgaccagttcatcagtgacctggagcaccagcccagcggcagcgctgagaagtggcccaaccacagcgtgctgagctgcccagcccccttctggaggatctag

SEQ ID NO: 20881 - DNA, 2709 bp, Artificial Sequence
  Description of Artificial Sequence: Synthetic coding sequence
atgggcgccgccagctgtgaagatgaggagctggagttcaagctggtgtttggagaggagaaggaggccccacccctgggcgctgggggcctgggggaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggaggtgtctgagatcatcggccgggacctgagcggcttccctgcccctcctggagaggagcccccagcctag

SEQ ID NO: 20882 - DNA, 2895 bp, Artificial Sequence
  Description of Artificial Sequence: Synthetic coding sequence
atgatcaccaccctgcccagcctgctgcctgccagcctggccagcatcagccaccgggtgaccaacctgcccagcaacagcctgagccacaaccctggcctgagcaagccagacttccctggcaacagcagccctggcctgcccagcagcagcagccctggccgggacctgggcgccccagctggctccatgggcgccgccagctgtgaagatgaggagctggagttcaagctggtgtttggagaggagaaggaggccccacccctgggcgccggcggcctgggggaggagctggacagtgaagatgccccaccctgctgccgcctggccctgggggagcccccaccctatggagctgcccccatcggcatccccaggcctcctccaccccggcccggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaggccgccctgtatgctgcctgtgatgaggtggagagcgagctgaatgaggccgccagccgcttcggcctgggcagccccctgcccagcccccgggccagcccccggccctggaccccagaggacccctggagcctgtatggccccagccctgggggccggggcccagaagattcctggctgctgctgagcgcccctggccccaccccagccagccccaggcctgccagcccctgtgggaagaggcgctacagcagcagcggcacccccagcagcgccagccctgccctgagcagaagaggcagcctgggggaggagggcagcgagcccccacctcctccacccctgcccctggcccgggaccccggcagccctggcccctttgattatgtgggcgcccccccagctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggcccgcatcggcggccacagccccatcttccgcaccagcgccctgccccccctggactggcccctgcccagccagtatgagcagctggagctgcgcatcgaggtgcagccccgggcccaccaccgggcccactatgaaacagagggcagcagaggagctgtgaaggccgcccctgggggccaccctgtggtgaagctgctgggctacagcgagaagcccctgaccctgcagatgtttattggaacagcagatgaaagaaacctgcggccccacgccttctaccaggtgcaccgcatcaccgggaagatggtggccacagccagctatgaggccgtggtgtctggcaccaaggtgctggagatgaccctgctgcctgagaacaacatggccgccaacatcgactgtgccggcatcctgaagctgaggaacagcgacatcgagctgaggaaaggagaaacagacatcggcaggaagaacaccagggtgcggctggtgttccgggtgcacgtgccccagggcggcggcaaggtggtgtctgtgcaggccgcctctgtgcccattgaatgttcccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggaagaaggaagaggagccccacccagagcttccgcttcctgcccgtcatctgcaaggaggagcccctgcctgacagcagcctgcggggcttccccagcgccagcgccacccccttcggcacagacatggacttcagcccccccaggcctccctaccccagctacccccatgaagatcctgcctgtgagaccccctacctgtctgagggcttcggctacggcatgccacccctgtacccccagacaggccccccacccagctacagacctggcctgaggatgtttcctgagacccggggcaccaccggctgtgcccagcccccagctgtgtccttcctgccccggcccttccccagcgacccctatggaggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagccggggcggctacagcagcggcttccgggacagcgtgcccatccagggcatcaccctggaggagggcggctgcggcaccggcggctgtgaatgtgaatgtgtgcaggagatcgccctgcacgtgtgctag

SEQ ID NO: 20883 - DNA, 2670 bp, Artificial Sequence
  Description of Artificial Sequence: Synthetic coding sequence
atgcctgccagcatcagcagcatcttccctggccccaccctgctgctgagctgtggcagcgaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggagggcggctgcggcactggaggctgtgaatgtgaatgtgtgcaggagatcgccctgcacgtgtgctag

SEQ ID NO: 20884 - DNA, 2745 bp, Artificial Sequence
  Description of Artificial Sequence: Synthetic coding sequence
atgctgagcggccgggacctgggcgccccagctggctccatgggcgccgccagctgtgaagatgaggagctggagttcaagctggtgtttggagaggagaaggaggccccacccctgggcgccggcggcctgggggaggagctggacagtgaagatgccccaccctgctgccgcctggccctgggggagcccccaccctatggagctgcccccatcggcatccccaggcctcctccaccccggcccggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaggccgccctgtatgctgcctgtgatgaggtggagagcgagctgaatgaggccgccagccgcttcggcctgggcagccccctgcccagcccccgggccagcccccggccctggaccccagaggacccctggagcctgtatggccccagccctgggggccggggcccagaagattcctggctgctgctgagcgcccctggccccaccccagccagccccaggcctgccagcccctgtgggaagaggcgctacagcagcagcggcacccccagcagcgccagccctgccctgagcagaagaggcagcctgggggaggagggcagcgagcccccacctcctccacccctgcccctggcccgggaccccggcagccctggcccctttgattatgtgggcgcccccccagctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggcccgcatcggcggccacagccccatcttccgcaccagcgccctgccccccctggactggcccctgcccagccagtatgagcagctggagctgcgcatcgaggtgcagccccgggcccaccaccgggcccactatgaaacagagggcagcagaggagctgtgaaggccgcccctgggggccaccctgtggtgaagctgctgggctacagcgagaagcccctgaccctgcagatgtttattggaacagcagatgaaagaaacctgcggccccacgccttctaccaggtgcaccgcatcaccgggaagatggtggccacagccagctatgaggccgtggtgtctggcaccaaggtgctggagatgaccctgctgcctgagaacaacatggccgccaacatcgactgtgccggcatcctgaagctgaggaacagcgacatcgagctgaggaaaggagaaacagacatcggcaggaagaacaccagggtgcggctggtgttccgggtgcacgtgccccagggcggcggcaaggtggtgtctgtgcaggccgcctctgtgcccattgaatgttcccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggaagaaggaagaggagccccacccagagcttccgcttcctgcccgtcatctgcaaggaggagcccctgcctgacagcagcctgcggggcttccccagcgccagcgccacccccttcggcacagacatggacttcagcccccccaggcctccctaccccagctacccccatgaagatcctgcctgtgagaccccctacctgtctgagggcttcggctacggcatgccacccctgtacccccagacaggccccccacccagctacagacctggcctgaggatgtttcctgagacccggggcaccaccggctgtgcccagcccccagctgtgtccttcctgccccggcccttccccagcgacccctatggaggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagccggggcggctacagcagcggcttccgggacagcgtgcccatccagggcatcaccctggaggagggcggctgcggcaccggcggctgtgaatgtgaatgtgtgcaggagatcgccctgcacgtgtgctag

SEQ ID NO: 20885 - DNA, 2802 bp, Artificial Sequence
  Description of Artificial Sequence: Synthetic coding sequence
atggctgatggaggagctgacagcgctgcccagaggctgcctgagggccctggccgggtggcccctggccgggacctgggcgccccagctggctccatgggcgccgccagctgtgaagatgaggagctggagttcaagctggtgtttggagaggagaaggaggccccacccctgggcgctgggggcctgggggaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggagggcggctgcggcactggaggctgtgaatgtgaatgtgtgcaggagatcgccctgcacgtgtgctag

SEQ ID NO: 20886 - DNA, 2481 bp, Artificial Sequence
  Description of Artificial Sequence: Synthetic coding sequence
atggctgatggaggagctgacagcgctgcccagaggctgcctgagggccctggccgggtggcccctggccgggacctgggcgccccagctggctccatgggcgccgccagctgtgaagatgaggagctggagttcaagctggtgtttggagaggagaaggaggccccacccctgggcgctgggggcctgggggaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccgtgtctgagatcatcggccgggacctgagcggcttccctgcccctcctggagaggagcccccagcctag

SEQ ID NO: 20887 - DNA, 2706 bp, Artificial Sequence
  Description of Artificial Sequence: Synthetic coding sequence
atgggcgccgccagctgtgaagatgaggagctggagttcaagctggtgtttggagaggagaaggaggccccacccctgggcgctgggggcctgggggaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggagggcggctgcggcactggaggctgtgaatgtgaatgtgtgcaggagatcgccctgcacgtgtgctag

SEQ ID NO: 20888 - DNA, 2499 bp, Artificial Sequence
  Description of Artificial Sequence: Synthetic coding sequence
atgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggaggtgtctgagatcatcggccgggacctgagcggcttccctgcccctcctggagaggagcccccagcctag

SEQ ID NO: 20889 - DNA, 2385 bp, Artificial Sequence
  Description of Artificial Sequence: Synthetic coding sequence
atgggcgccgccagctgtgaagatgaggagctggagttcaagctggtgtttggagaggagaaggaggccccacccctgggcgctgggggcctgggggaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccgtgtctgagatcatcggccgggacctgagcggcttccctgcccctcctggagaggagcccccagcctag

SEQ ID NO: 20890 - DNA, 2499 bp, Artificial Sequence; identical to SEQ ID NO: 20888
  Description of Artificial Sequence: Synthetic coding sequence

SEQ ID NO: 20891 - DNA, 990 bp, Artificial Sequence
  Description of Artificial Sequence: Synthetic coding sequence
atgtttattggaacagcagatgaaagaaacctgcggccccacgccttctaccaggtgcaccgcatcaccgggaagatggtggccacagccagctatgaggccgtggtgtctggcaccaaggtgctggagatgaccctgctgcctgagaacaacatggccgccaacatcgactgtgccggcatcctgaagctgaggaacagcgacatcgagctgaggaaaggagaaacagacatcggcaggaagaacaccagggtgcggctggtgttccgggtgcacgtgccccagggcggcggcaaggtggtgtctgtgcaggccgcctctgtgcccattgaatgttcccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggaagaaggaagaggagccccacccagagcttccgcttcctgcccgtcatctgcaaggaggagcccctgcctgacagcagcctgcggggcttccccagcgccagcgccacccccttcggcacagacatggacttcagcccccccaggcctccctaccccagctacccccatgaagatcctgcctgtgagaccccctacctgtctgagggcttcggctacggcatgccacccctgtacccccagacaggccccccacccagctacagacctggcctgaggatgtttcctgagacccggggcaccaccgtgtctgagatcatcggccgggacctgagcggcttccctgcccctcctggagaggagcccccagcctag

SEQ ID NO: 20892 - DNA, 2574 bp, Artificial Sequence
  Description of Artificial Sequence: Synthetic coding sequence
atgatcaccaccctgcccagcctgctgcctgccagcctggccagcatcagccaccgggtgaccaacctgcccagcaacagcctgagccacaaccctggcctgagcaagccagacttccctggcaacagcagccctggcctgcccagcagcagcagccctggccgggacctgggcgccccagctggctccatgggcgccgccagctgtgaagatgaggagctggagttcaagctggtgtttggagaggagaaggaggccccacccctgggcgccggcggcctgggggaggagctggacagtgaagatgccccaccctgctgccgcctggccctgggggagcccccaccctatggagctgcccccatcggcatccccaggcctcctccaccccggcccggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaggccgccctgtatgctgcctgtgatgaggtggagagcgagctgaatgaggccgccagccgcttcggcctgggcagccccctgcccagcccccgggccagcccccggccctggaccccagaggacccctggagcctgtatggccccagccctgggggccggggcccagaagattcctggctgctgctgagcgcccctggccccaccccagccagccccaggcctgccagcccctgtgggaagaggcgctacagcagcagcggcacccccagcagcgccagccctgccctgagcagaagaggcagcctgggggaggagggcagcgagcccccacctcctccacccctgcccctggcccgggaccccggcagccctggcccctttgattatgtgggcgcccccccagctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggcccgcatcggcggccacagccccatcttccgcaccagcgccctgccccccctggactggcccctgcccagccagtatgagcagctggagctgcgcatcgaggtgcagccccgggcccaccaccgggcccactatgaaacagagggcagcagaggagctgtgaaggccgcccctgggggccaccctgtggtgaagctgctgggctacagcgagaagcccctgaccctgcagatgtttattggaacagcagatgaaagaaacctgcggccccacgccttctaccaggtgcaccgcatcaccgggaagatggtggccacagccagctatgaggccgtggtgtctggcaccaaggtgctggagatgaccctgctgcctgagaacaacatggccgccaacatcgactgtgccggcatcctgaagctgaggaacagcgacatcgagctgaggaaaggagaaacagacatcggcaggaagaacaccagggtgcggctggtgttccgggtgcacgtgccccagggcggcggcaaggtggtgtctgtgcaggccgcctctgtgcccattgaatgttcccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggaagaaggaagaggagccccacccagagcttccgcttcctgcccgtcatctgcaaggaggagcccctgcctgacagcagcctgcggggcttccccagcgccagcgccacccccttcggcacagacatggacttcagcccccccaggcctccctaccccagctacccccatgaagatcctgcctgtgagaccccctacctgtctgagggcttcggctacggcatgccacccctgtacccccagacaggccccccacccagctacagacctggcctgaggatgtttcctgagacccggggcaccaccgtgtctgagatcatcggccgggacctgagcggcttccctgcccctcctggagaggagcccccagcctag

SEQ ID NO: 20893 - DNA, 2175 bp, Artificial Sequence
  Description of Artificial Sequence: Synthetic coding sequence
atgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccgtgtctgagatcatcggccgggacctgagcggcttccctgcccctcctggagaggagcccccagcctag

SEQ ID NO: 20894 - DNA, 432 bp, Artificial Sequence
  Description of Artificial Sequence: Synthetic coding sequence
atgggcgccgccagctgtgaagatgaggagctggagttcaagctggtgtttggagaggagaaggaggccccacccctgggcgctgggggcctgggggaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccctag

SEQ ID NO: 20895 - DNA, 2424 bp, Artificial Sequence
  Description of Artificial Sequence: Synthetic coding sequence
atgctgagcggccgggacctgggcgccccagctggctccatgggcgccgccagctgtgaagatgaggagctggagttcaagctggtgtttggagaggagaaggaggccccacccctgggcgccggcggcctgggggaggagctggacagtgaagatgccccaccctgctgccgcctggccctgggggagcccccaccctatggagctgcccccatcggcatccccaggcctcctccaccccggcccggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaggccgccctgtatgctgcctgtgatgaggtggagagcgagctgaatgaggccgccagccgcttcggcctgggcagccccctgcccagcccccgggccagcccccggccctggaccccagaggacccctggagcctgtatggccccagccctgggggccggggcccagaagattcctggctgctgctgagcgcccctggccccaccccagccagccccaggcctgccagcccctgtgggaagaggcgctacagcagcagcggcacccccagcagcgccagccctgccctgagcagaagaggcagcctgggggaggagggcagcgagcccccacctcctccacccctgcccctggcccgggaccccggcagccctggcccctttgattatgtgggcgcccccccagctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggcccgcatcggcggccacagccccatcttccgcaccagcgccctgccccccctggactggcccctgcccagccagtatgagcagctggagctgcgcatcgaggtgcagccccgggcccaccaccgggcccactatgaaacagagggcagcagaggagctgtgaaggccgcccctgggggccaccctgtggtgaagctgctgggctacagcgagaagcccctgaccctgcagatgtttattggaacagcagatgaaagaaacctgcggccccacgccttctaccaggtgcaccgcatcaccgggaagatggtggccacagccagctatgaggccgtggtgtctggcaccaaggtgctggagatgaccctgctgcctgagaacaacatggccgccaacatcgactgtgccggcatcctgaagctgaggaacagcgacatcgagctgaggaaaggagaaacagacatcggcaggaagaacaccagggtgcggctggtgttccgggtgcacgtgccccagggcggcggcaaggtggtgtctgtgcaggccgcctctgtgcccattgaatgttcccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggaagaaggaagaggagccccacccagagcttccgcttcctgcccgtcatctgcaaggaggagcccctgcctgacagcagcctgcggggcttccccagcgccagcgccacccccttcggcacagacatggacttcagcccccccaggcctccctaccccagctacccccatgaagatcctgcctgtgagaccccctacctgtctgagggcttcggctacggcatgccacccctgtacccccagacaggccccccacccagctacagacctggcctgaggatgtttcctgagacccggggcaccaccgtgtctgagatcatcggccgggacctgagcggcttccctgcccctcctggagaggagcccccagcctag

SEQ ID NO: 20896 - DNA, 1311 bp, Artificial Sequence
  Description of Artificial Sequence: Synthetic coding sequence
atgtttattggaacagcagatgaaagaaacctgcggccccacgccttctaccaggtgcaccgcatcaccgggaagatggtggccacagccagctatgaggccgtggtgtctggcaccaaggtgctggagatgaccctgctgcctgagaacaacatggccgccaacatcgactgtgccggcatcctgaagctgaggaacagcgacatcgagctgaggaaaggagaaacagacatcggcaggaagaacaccagggtgcggctggtgttccgggtgcacgtgccccagggcggcggcaaggtggtgtctgtgcaggccgcctctgtgcccattgaatgttcccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggaagaaggaagaggagccccacccagagcttccgcttcctgcccgtcatctgcaaggaggagcccctgcctgacagcagcctgcggggcttccccagcgccagcgccacccccttcggcacagacatggacttcagcccccccaggcctccctaccccagctacccccatgaagatcctgcctgtgagaccccctacctgtctgagggcttcggctacggcatgccacccctgtacccccagacaggccccccacccagctacagacctggcctgaggatgtttcctgagacccggggcaccaccggctgtgcccagcccccagctgtgtccttcctgccccggcccttccccagcgacccctatggaggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagccggggcggctacagcagcggcttccgggacagcgtgcccatccagggcatcaccctggaggagggcggctgcggcaccggcggctgtgaatgtgaatgtgtgcaggagatcgccctgcacgtgtgctag

SEQ ID NO: 20897 - DNA, 570 bp, Artificial Sequence
  Description of Artificial Sequence: Synthetic coding sequence
atggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggagggcggctgcggcactggaggctgtgaatgtgaatgtgtgcaggagatcgccctgcacgtgtgctag

SEQ ID NO: 20898 - DNA, 2673 bp, Artificial Sequence
  Description of Artificial Sequence: Synthetic coding sequence
atgcctgccagcatcagcagcatcttccctggccccaccctgctgctgagctgtggcagcgaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggaggtgtctgagatcatcggccgggacctgagcggcttccctgcccctcctggagaggagcccccagcctag

SEQ ID NO: 20899 - DNA, 2748 bp, Artificial Sequence
  Description of Artificial Sequence: Synthetic coding sequence
atgctgagcggccgggacctgggcgccccagctggctccatgggcgccgccagctgtgaagatgaggagctggagttcaagctggtgtttggagaggagaaggaggccccacccctgggcgccggcggcctgggggaggagctggacagtgaagatgccccaccctgctgccgcctggccctgggggagcccccaccctatggagctgcccccatcggcatccccaggcctcctccaccccggcccggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaggccgccctgtatgctgcctgtgatgaggtggagagcgagctgaatgaggccgccagccgcttcggcctgggcagccccctgcccagcccccgggccagcccccggccctggaccccagaggacccctggagcctgtatggccccagccctgggggccggggcccagaagattcctggctgctgctgagcgcccctggccccaccccagccagccccaggcctgccagcccctgtgggaagaggcgctacagcagcagcggcacccccagcagcgccagccctgccctgagcagaagaggcagcctgggggaggagggcagcgagcccccacctcctccacccctgcccctggcccgggaccccggcagccctggcccctttgattatgtgggcgcccccccagctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggcccgcatcggcggccacagccccatcttccgcaccagcgccctgccccccctggactggcccctgcccagccagtatgagcagctggagctgcgcatcgaggtgcagccccgggcccaccaccgggcccactatgaaacagagggcagcagaggagctgtgaaggccgcccctgggggccaccctgtggtgaagctgctgggctacagcgagaagcccctgaccctgcagatgtttattggaacagcagatgaaagaaacctgcggccccacgccttctaccaggtgcaccgcatcaccgggaagatggtggccacagccagctatgaggccgtggtgtctggcaccaaggtgctggagatgaccctgctgcctgagaacaacatggccgccaacatcgactgtgccggcatcctgaagctgaggaacagcgacatcgagctgaggaaaggagaaacagacatcggcaggaagaacaccagggtgcggctggtgttccgggtgcacgtgccccagggcggcggcaaggtggtgtctgtgcaggccgcctctgtgcccattgaatgttcccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggaagaaggaagaggagccccacccagagcttccgcttcctgcccgtcatctgcaaggaggagcccctgcctgacagcagcctgcggggcttccccagcgccagcgccacccccttcggcacagacatggacttcagcccccccaggcctccctaccccagctacccccatgaagatcctgcctgtgagaccccctacctgtctgagggcttcggctacggcatgccacccctgtacccccagacaggccccccacccagctacagacctggcctgaggatgtttcctgagacccggggcaccaccggctgtgcccagcccccagctgtgtccttcctgccccggcccttccccagcgacccctatggaggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagccggggcggctacagcagcggcttccgggacagcgtgcccatccagggcatcaccctggaggaggtgtctgagatcatcggccgggacctgagcggcttccctgcccctcctggagaggagcccccagcctag

SEQ ID NO: 20900 - DNA, 573 bp, Artificial Sequence
  Description of Artificial Sequence: Synthetic coding sequence
atggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggaggtgtctgagatcatcggccgggacctgagcggcttccctgcccctcctggagaggagcccccagcctag

SEQ ID NO: 20901 - DNA, 2349 bp, Artificial Sequence
  Description of Artificial Sequence: Synthetic coding sequence
atgcctgccagcatcagcagcatcttccctggccccaccctgctgctgagctgtggcagcgaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccgtgtctgagatcatcggccgggacctgagcggcttccctgcccctcctggagaggagcccccagcctag

SEQ ID NO: 20902 - DNA, 2805 bp, Artificial Sequence
  Description of Artificial Sequence: Synthetic coding sequence
atggctgatggaggagctgacagcgctgcccagaggctgcctgagggccctggccgggtggcccctggccgggacctgggcgccccagctggctccatgggcgccgccagctgtgaagatgaggagctggagttcaagctggtgtttggagaggagaaggaggccccacccctgggcgctgggggcctgggggaggagctggacagtgaagatgccccaccctgctgccgcctggccctgggggagcccccaccctacggggccgcccccatcggcatcccccggcccccaccacccaggcctggcatgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggaggtgtctgagatcatcggccgggacctgagcggcttccctgcccctcctggagaggagcccccagcctag

SEQ ID NO: 20903 - DNA, 1314 bp, Artificial Sequence
  Description of Artificial Sequence: Synthetic coding sequence
atgtttattggaacagcagatgaaagaaacctgcggccccacgccttctaccaggtgcaccgcatcaccgggaagatggtggccacagccagctatgaggccgtggtgtctggcaccaaggtgctggagatgaccctgctgcctgagaacaacatggccgccaacatcgactgtgccggcatcctgaagctgaggaacagcgacatcgagctgaggaaaggagaaacagacatcggcaggaagaacaccagggtgcggctggtgttccgggtgcacgtgccccagggcggcggcaaggtggtgtctgtgcaggccgcctctgtgcccattgaatgttcccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggaagaaggaagaggagccccacccagagcttccgcttcctgcccgtcatctgcaaggaggagcccctgcctgacagcagcctgcggggcttccccagcgccagcgccacccccttcggcacagacatggacttcagcccccccaggcctccctaccccagctacccccatgaagatcctgcctgtgagaccccctacctgtctgagggcttcggctacggcatgccacccctgtacccccagacaggccccccacccagctacagacctggcctgaggatgtttcctgagacccggggcaccaccggctgtgcccagcccccagctgtgtccttcctgccccggcccttccccagcgacccctatggaggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagccggggcggctacagcagcggcttccgggacagcgtgcccatccagggcatcaccctggaggaggtgtctgagatcatcggccgggacctgagcggcttccctgcccctcctggagaggagcccccagcctag

SEQ ID NO: 20904 - DNA, 2496 bp, Artificial Sequence
  Description of Artificial Sequence: Synthetic coding sequence
atgcacagccccccacccaggcctgcccccagccctggcacctgggagagccagcctgcccggtctgtgcggctgggcggccctgggggcggggccggcggggccggcggcggccgggtgctggagtgccccagcatccgcatcaccagcatcagccccaccccagagcccccagctgccctggaggacaacccagatgcctggggagatggcagcccccgggactacccacctcctgagggctttggaggctaccgggaggccggcggccagggcggcggggccttcttcagccccagccctggcagcagcagcctgagctcctggagcttcttcagtgatgccagtgatgaagctgccctgtatgctgcctgtgatgaggtggagagcgagctgaatgaagctgccagcagatttggcctgggcagccccctgcccagcccccgggccagcccccggccctggaccccagaggacccctggagcctgtatggccccagccctgggggccggggccctgaggacagctggctgctgctgagcgcccctggccccaccccagccagccccaggcctgccagcccctgtgggaagaggcgctacagcagcagcggcacccccagcagcgccagccctgccctgagccggcggggcagcctgggggaggagggcagcgagcccccacctcctccacccctgcccctggcccgggaccccggcagccctggcccctttgattatgtgggcgcccctcctgctgagagcatcccccagaagaccaggaggaccagcagcgagcaggccgtggccctgcccaggtctgaggagcccgccagctgcaatggcaagctgcccctgggcgctgaggagagcgtggcccctcctgggggcagcaggaaggaggtggccggcatggactacctggccgtgcccagccccctggcctggagcaaggccagaattggaggccacagccccatcttccgcaccagcgccctgccccccctggactggcccctgcccagccagtatgagcagctggagctgagaattgaggtgcagccccgggcccaccaccgggcccactatgaaacagagggcagcagaggagctgtgaaggccgcccctgggggccaccctgtggtgaagctgctgggctacagcgagaagcccctgaccctgcagatgttcatcggcacagcagatgagaggaacctgcggccccacgccttctaccaggtgcaccgcatcaccgggaagatggtggccacagccagctatgaagctgtggtgtctggcaccaaggtgctggagatgaccctgctgcctgagaacaacatggccgccaacatcgactgtgccggcatcctgaagctgaggaacagcgacatcgagctgaggaagggggagacagacattggaaggaagaacaccagggtgcggctggtgttccgggtgcacgtgccccagggcggcggcaaggtggtgtctgtgcaggccgcctctgtgcccatcgagtgcagccagaggtctgcccaggagctgccccaggtggaggcctacagccccagcgcctgcagcgtgcggggcggggaggagctggtgctgaccggcagcaacttcctgcctgacagcaaggtggtgttcatcgagcggggcccagatggcaagctgcagtgggaggaggaggccaccgtgaaccggctgcagagcaatgaggtgaccctgaccctgactgtgcctgagtacagcaacaagagggtgtccaggcctgtgcaggtgtacttctacgtgtccaatggccgcaggaagaggagccccacccagagcttccgcttcctgcctgtgatctgcaaggaggagcccctgcctgacagcagcctgcggggcttccccagcgccagcgccaccccatttggaacagacatggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccggctgtgcccagcccccagctgtgtccttcctgccccggcccttccccagcgacccctacggcggccggggcagcagcttcagcctgggcctgcccttcagccccccagcccccttccggcccccacccctgcctgccagcccccccctggagggccccttccccagccagagtgatgtgcaccccctgcctgctgagggctacaacaaggtgggccctggctacggccctggagagggcgcccctgagcaggagaagagcagaggaggctacagcagcggcttccgggacagcgtgcccatccagggcatcaccctggaggagggcggctgcggcactggaggctgtgaatgtgaatgtgtgcaggagatcgccctgcacgtgtgctag

SEQ ID NO: 20905 - DNA, 249 bp, Artificial Sequence
  Description of Artificial Sequence: Synthetic coding sequence
atggacttcagccccccccggcccccctaccccagctacccccatgaggaccctgcctgtgagaccccctacctgtctgagggcttcggctacggcatgccacccctgtacccccagacaggccccccacccagctaccggcccggcctgaggatgtttcctgagacccggggcaccaccgtgtctgagatcatcggccgggacctgagcggcttccctgcccctcctggagaggagcccccagcctag

SEQ ID NO: 20906 - DNA, 315 bp, Artificial Sequence
  Description of Artificial Sequence: Synthetic coding sequence
atgagcagcgctgcccggagccggctgacccgggccacccggcaggagatgctgttcctggccctgctgctgctgcctgtggtggtggcctttgcccgggcagaggccgaggaggatggagacctgcagtgcctgtgtgtgaagaccaccagccaggtgcggcccaggcacatcaccagcctggaggtgatcaaggccggcccccactgccccacagcccagctgattgccaccctgaagaatggaaggaagatctgcctggacctgcaggccctgctgtacaagaagatcatcaaggagcacctggagagctag

SEQ ID NO: 20907 - DNA, 2907 bp, Artificial Sequence
  Description of Artificial Sequence: Synthetic coding sequence
atggctgaagatgacccctacctgggccggcctgagcagatgttccacctggaccccagcctgacccacaccatcttcaaccctgaggtgttccagccccagatggccctgcccacagatggcccctacctgcagatcctggagcagcccaagcagaggggcttccgcttccgctacgtgtgtgagggccccagccacggcggcctgcccggggccagcagcgagaagaacaagaagagctacccccaggtgaagatctgcaactacgtgggccctgccaaggtgattgtgcagctggtgaccaacgggaagaacatccacctgcacgcccacagcctggtgggcaagcactgtgaagatggcatctgcaccgtgacagctggccccaaggacatggtggtgggctttgccaacctgggcatcctgcacgtgaccaagaagaaggtgtttgagaccctggaggccaggatgacagaggcctgcatccggggctacaaccctggcctgctggtgcacccagacctggcctacctgcaggccgagggcggcggggaccggcagctgggggaccgggagaaggagctgatccggcaggccgccctgcagcagaccaaggagatggacctgtctgtggtgcggctgatgttcaccgccttcctgcctgacagcacaggcagcttcacccggcggctggagcctgtggtgtctgatgccatctatgacagcaaggccccaaatgccagcaacctgaagatcgtgaggatggacagaacagctggctgtgtgactggaggagaggagatctacctgctgtgtgacaaggtgcagaaggatgacatccagatccgcttctatgaggaggaggagaatggaggagtgtgggagggctttggagacttcagccccacagatgtgcaccggcagtttgccatcgtgttcaagacccccaagtacaaggacatcaacatcaccaagccagcctctgtgtttgtgcagctgcggaggaagagtgacctggagaccagcgagcccaagcccttcctgtactacccagagatcaaggacaaggaggaggtgcagaggaagaggcagaagctgatgcccaacttcagtgacagctttggaggcggcagcggggccggggccggcggcggcggcatgtttggcagcggcggcggcggcggcggcaccggcagcacaggccctggctacagcttcccccactacggcttccccacctacggcggcatcaccttccaccctggcaccaccaagagcaatgccggcatgaagcacggcaccatggacacagagagcaagaaggaccctgagggctgtgacaagagtgatgacaagaacacagtgaacctgtttgggaaggtgattgagaccacagagcaggaccaggagcccagcgaggccaccgtgggcaatggagaggtgaccctgacctacgccaccggcaccaaggaggagagcgctggggtgcaggacaacctcttcctggagaaggccatgcagctggccaagagacatgccaatgccctgtttgattatgctgtgactggagatgtgaagatgctgctggccgtgcagaggcacctgacagctgtgcaggatgaaaatggagacagcgtgctgcacctggccatcatccacctgcacagccagctggtgcgggacctgctggaggtgaccagcggcctcatcagtgatgacatcatcaacatgagaaatgacctgtaccagacccccctgcacctggccgtcatcaccaagcaggaggatgtggtggaggacctgctgcgggccggggctgacctgagcctgctggaccggctgggcaacagcgtgctgcacctggccgccaaggagggccatgacaaggtgctgagcatcctgctgaagcacaagaaggccgccctgctgctggaccaccccaatggagatggcctgaatgccatccacctggccatgatgagcaacagcctgccctgcctgctgctgctggtggccgccggggctgatgtgaatgcccaggagcagaagagcggccgcacagccctgcacctggccgtggagcatgacaacatcagcctggccggctgcctgctgctggagggagatgcccacgtggacagcaccacctatgatggcaccacccccctgcacatcgctgctggccggggcagcacccggctggccgccctgctgaaggctgctggagctgaccccctggtggagaactttgagcccctgtatgacctggatgacagctgggagaatgctggagaagatgagggcgtggtgcccggcaccacccccctggacatggccacctcctggcaggtgtttgacatcctgaatggcaagccctatgagcctgagttcaccagtgatgacctgctggcccagggcgacatgaagcagctggctgaagatgtgaagctgcagctgtacaagctgctggagatcccagaccctgacaagaactgggccaccctggcccagaagctgggcctgggcatcctgaacaatgccttccggctgagccctgcccccagcaagaccctgatggacaactatgaggtgtctgggggcaccgtgcgggagctggtggaggccctgcggcagatgggctacacagaggccattgaagtcatccaggccgccagcagccctgtgaagaccaccagccaggcccacagcctgcccctgagccctgccagcacccggcagcagattgatgagctgcgggacagcgacagcgtgtgtgacagcggcgtggagaccagcttcaggaagctgtccttcacagagagcctgaccagcggggccagcctgctgaccctgaacaagatgcctcatgactatggccaggagggccccctggagggcaagatctag

SEQ ID NO: 20908 - DNA, 2907 bp, Artificial Sequence; identical to SEQ ID NO: 20907
  Description of Artificial Sequence: Synthetic coding sequence

SEQ ID NO: 20909 - DNA, 438 bp, Artificial Sequence
  Description of Artificial Sequence: Synthetic coding sequence
atggctgaagatgacccctacctgggccggcctgagcagatgttccacctggaccccagcctgacccacaccatcttcaaccctgaggtgttccagccccagatggccctgcccacagcagatggcccctacctgcagatcctggagcagcccaagcagaggggcttccgcttccgctacgtgtgtgagggccccagccatggaggcctgcccggggccagcagcgagaagaacaagaagagctacccccaggtgaagatctgcaactacgtgggccctgccaaggtgattgtgcagctggtgaccaacgggaagaacatccacctgcacgcccacagcctggtgggcaagcactgtgaagatggcatctgcaccgtgacagctggccccaaggacatggtggtgggctttgccaacctgggcatcctgcacgtgtag

SEQ ID NO: 20910 - DNA, 225 bp, Artificial Sequence
  Description of Artificial Sequence: Synthetic coding sequence
atgaagaggaccaccagcttcaggatggctgaagatgacccctacctgggccggcctgagcagatgttccacctggaccccagcctgacccacaccatcttcaaccctgaggtgttccagccccagatggccctgcccacagatggcccctacctgcagatcctggagcagcccaagcagaggggcttccgcttccgctacgtgtgtgagggccccagccactag

SEQ ID NO: 20911 - DNA, 1923 bp, Artificial Sequence
  Description of Artificial Sequence: Synthetic coding sequence
atggccgccctgtacagacctggcctgcggctgaactggcacggcctgagccccctgggctggcccagctgccgcagcatccagaccctgcgggtgctgagcggggacctgggccagctgcccaccggcatccgggactttgtggagcacagcgcccggctgtgccagcctgagggcatccacatctgtgatggaacagaagcagaaaatacagccaccctgaccctgctggagcagcagggcctcatcaggaagctgcccaagtacaacaactgctggctggccaggacagaccccaaggatgtggcccgggtggagagcaagacagtgattgtgacccccagccagagggacacagtgcagctgcccccaggaggagcccggggccagctgggcaactggatgagccctgctgacttccagagagctgtggatgagcgcttccctggctgcatgcagggccgcaccatgtatgtgctgcccttctccatgggccctgtgggcagccccctgagccgcatcggcgtgcagctgacagattctgcctacgtggtggcctccatgaggatcatgacccggctgggcacccctgtgctgcaggccctgggagatggagactttgtgaagtgcctgcacagcgtgggccagcccctgaccggccagggcgagcctgtgtcccagtggccctgcaaccctgagaagaccctgattggacatgtgcctgaccagcgggagatcatcagctttggaagtggctatggaggcaacagcctgctgggcaagaagtgctttgccctgcgcatcgccagccggctggccagagatgagggctggctggccgagcacatgctgatcctgggcatcaccagccctgctgggaagaagagatatgtggccgccgccttccccagcgcctgtgggaagaccaacctggccatgatgaggcctgccctgcccggctggaaggtggagtgtgtgggagatgacatcgcctggatgagatttgattctgagggccgcctgcgggccatcaacccagaaaatggcttctttggagtggcccctggcaccagcgccaccaccaaccccaatgccatggccaccatccagagcaacaccatcttcaccaacgtggccgagaccagtgatggaggagtgtactgggagggcatcgaccagcccctgcccccaggagtgacagtgacctcctggctgggcaagccctggaagccaggggacaaggagccctgtgcccaccccaacagccgcttctgtgccccagcccggcagtgccccatcatggaccctgcctgggaggcccctgagggcgtgcccattgatgccatcatctttggaggccggcggcccaagggcgtgcccctggtgtatgaggccttcaactggaggcatggagtgtttgtgggcagcgccatgaggtctgagagcacagctgctgctgagcacaagggcaagatcatcatgcatgacccctttgccatgaggcccttcttcggctacaactttggccactacctggagcactggctgtccatggagggcaggaagggggcccagctgccccgcatcttccacgtgaactggttcagaagagatgaggccggccacttcctgtggccaggctttggagaaaatgcccgggtgctggactggatctgccggcggctggagggagaagattctgcccgggagacccccatcggcctggtgcccaaggagggcgccctggacctgagcggcctgcgggccatcgacaccacccagctgttcagcctgcccaaggacttctgggagcaggaggtgcgggacatccgcagctacctgacagagcaggtgaaccaggacctgcccaaggaggtgctggccgagctggaggccctggagaggagagtgcacaagatgtag

SEQ ID NO: 20912 - DNA, 3477 bp, Artificial Sequence
  Description of Artificial Sequence: Synthetic coding sequence
atgacccatggagaggagctgggcagtgatgtgcaccaggacagcatcgtgctgacctacctggagggcctgctgatgcaccaggccgccggcggcagcggcacagctgtggacaagaagtctgctggccacaatgaggaggaccagaacttcaacatcagcggcagcgccttccccacctgccagagcaatggacctgtgctgaacacccacacctaccagggcagcggcatgctgcacctgaagaaggcccggctgctgcagagcagcgaggactggaatgctgccaagaggaagaggctgagtgacagcatcatgaacctgaatgtgaagaaggaggccctgctggccggcatggtggacagcgtgcccaagggcaagcaggacagcaccctgctggccagcctgctgcagagcttcagcagccggctgcagacagtggccctgagccagcagatccggcagagcctgaaggagcagggctacgccctgagccatgacagcctgaaggtggagaaggacctgcgctgctacggcgtggccagcagccacctgaagaccctgctgaagaagagcaaggtgaaggaccagaagccagacaccaacctgcctgatgtgaccaagaacctgatccgggacagatttgctgagagcccccaccacgtgggccagagcggcaccaaggtgatgtctgagcccctgagctgtgccgcccggctgcaggccgtggcctccatggtggagaagagggccagccctgccaccagccccaagcccagcgtggcctgcagccagctggccctgctgctgagcagcgaggcccacctgcagcagtacagccgggagcacgccctgaagacccagaatgccaaccaggccgccagcgagcggctggccgccatggcccggctgcaggagaatggccagaaggatgtgggcagctaccagctgcccaagggcatgagcagccacctgaatggccaggcccggaccagcagcagcaagctgatggccagcaagagcagcgccaccgtcttccagaaccccatgggcatcatccccagcagccccaagaatgccggctacaagaacagcctggagaggaacaacatcaagcaggccgccaacaacagcctgctgctgcacctgctgaagagccagaccatccccaagcccatgaatggccacagccacagcgagcggggcagcatctttgaggagagcagcacccccaccaccattgatgagtacagcgacaacaaccccagcttcacagatgacagcagtggagatgagagcagctacagcaactgtgtgcccatcgacctgagctgcaagcacaggacagagaagtctgagagtgaccagcctgtgtccctggacaacttcacccagagcctgctgaacacctgggaccccaaggtgcctgatgtggacatcaaggaggaccaggacaccagcaagaacagcaagctgaacagccaccagaaggtgaccctgctgcagctgctgctgggccacaagaatgaagaaaatgtggagaagaacaccagcccccagggcgtgcacaatgatgtgtccaagttcaacacccagaactatgcccggaccagcgtcatcgagagccccagcaccaacagaaccacccctgtgtccaccccacccctgctgaccagcagcaaggccggcagccccatcaacctgagccagcacagcctggtgatcaagtggaacagccccccctacgtgtgcagcacccagagcgagaagctgaccaacacagccagcaaccacagcatggacctgaccaagagcaaggaccccccaggagagaagccagcccagaatgaaggagcccagaacagcgccaccttcagcgccagcaagctgctgcagaacctggcccagtgtggcatgcagagctccatgtctgtggaggagcagaggcccagcaagcagctgctgaccggcaacacagacaagcccatcggcatgattgaccggctgaacagccccctgctgagcaacaagaccaatgctgtggaggagaacaaggccttcagcagccagcccaccggccctgagcccggcctgagcggcagcgagattgagaacctgctggagaggagaacagtgctgcagctgctgctgggcaaccccaacaagggcaagtctgagaagaaggagaagacccccctgagagatgagagcacccaggagcacagcgagcgggccctgtctgagcagatcctgatggtgaagatcaagtctgagccctgtgatgacctgcagatccccaacaccaacgtgcacctgagccatgatgccaagagcgcccccttcctgggcatggccccagctgtgcagaggtctgccccagccctgcctgtgtctgaggacttcaagtctgagcctgtgagcccccaggacttctccttcagcaagaatggcctgctgagccggctgctgcggcagaaccaggacagctacctggctgatgacagcgacaggagccacaggaacaatgagatggccctgctggagagcaagaacctgtgcatggtgcccaagaagaggaagctgtacacagagcccctggagaaccccttcaagaagatgaagaacaacatcgtggatgctgccaacaaccacagcgcccctgaggtgctgtatggcagcctgctgaaccaggaggagctgaagttcagcagaaatgacctggagttcaagtacccagctggccacggcagcgccagcgagagcgagcaccgctcctgggcccgggagagcaagagcttcaacgtgctgaagcagctgctgctgtctgagaactgtgtgcgggacctgagcccccacaggagcaacagcgtggccgacagcaagaagaagggccacaagaacaacgtgaccaacagcaagccagagttcagcatcagcagcctgaatggcctgatgtacagcagcacccagcccagcagctgcatggacaacagaaccttctcctacccaggagtggtgaagacccctgtgagccccaccttccctgagcacctgggctgtgccggcagcaggcctgagagcggcctgctgaatggctgcagcatgcccagcgagaagggccccatcaagtgggtgatcacagatgctgagaagaatgaatatgagaaggacagcccccggctgaccaagaccaaccccatcctgtactacatgctgcagaagggcggcaacagcgtgaccagccgggagacccaggacaaggacatctggagggaggccagcagcgctgagagcgtgtcccaggtgacagccaaggaggagctgctgcccacagctgagaccaaggccagcttcttcaacctgcggagcccctacaacagccacatgggcaacaatgccagccggccccacagcgccaacggggaggtgtatggcctgctgggctctgtgctgaccatcaagaaggagagcgagtag

SEQ ID NO: 20913 - DNA, 3477 bp, Artificial Sequence; identical to SEQ ID NO: 20912
  Description of Artificial Sequence: Synthetic coding sequence

SEQ ID NO: 20914 - DNA, 3477 bp, Artificial Sequence; identical to SEQ ID NO: 20912
  Description of Artificial Sequence: Synthetic coding sequence

SEQ ID NO: 20915 - DNA, 201 bp, Artificial Sequence
  Description of Artificial Sequence: Synthetic coding sequence
atgacccatggagaggagctgggcagtgatgtgcaccaggacagcatcgtgctgacctacctggagggcctgctgatgcaccaggccgccggcggcagcggcacagctgtggacaagaagtctgctggccacaatgaggaggaccagaacttcaacatcagcggcagcgccttccccacctgccagagcaatggcccctag

SEQ ID NO: 20916 - DNA, 4176 bp, Artificial Sequence
  Description of Artificial Sequence: Synthetic coding sequence
atgcccagcagcctgctgggcgccgccatgcctgccagcaccagcgctgctgccctgcaggaggccctggagaatgccggccgcctgattgaccggcagctgcaggaggacaggatgtacccagacctgtctgagctgctgatggtgtctgcccccaacaaccccaccgtgtctggcatgtctgacatggactaccccctgcagggccctggcctgctgtctgtgcccaacctgcctgagatcagcagcatcagaagagtgcccctgcccccagagctggtggagcagtttggccacatgcagtgcaactgcatgatgggcgtcttcccccccatcagccgggcctggctgaccatcgacagcgacatcttcatgtggaactatgaagatggaggagacctggcctactttgatggcctgtctgagaccatcctggccgtgggcctggtgaagcccaaggccggcatcttccagccccacgtgcgccacctgctggtgctggccacccctgtggacatcgtcatcctgggcctgtcctatgccaacctgcagacaggcagcggcgtgctgaatgacagcctgagcggcggcatgcagctgctgcctgaccccctgtacagcctgcccacagacaacacctacctgctgaccatcaccagcacagacaatggccgcatcttcctggccggcaaggatggctgcctgtatgaggtggcctaccaggccgaggccggctggttcagccagcgctgcaggaagatcaaccacagcaagagcagcctgtccttcctggtgcccagcctgctgcagttcaccttctctgaagatgaccccatcctgcagatcgccatcgacaacagcaggaacatcctgtacaccaggtctgagaagggcgtcatccaggtgtatgacctgggccaggacggccagggcatgagccgggtggcctctgtgtcccagaatgccatcgtgtctgctgctggcaacatcgcccggaccatcgacagatctgtgttcaagcccatcgtgcagattgctgtgattgaaaattctgagagcctggactgccagctgctggccgtgacccacgccggcgtgcggctgtacttcagcacctgccccttccggcagcccctggcccggcccaacaccctgaccctggtgcacgtgcggctgcccccaggcttcagcgccagcagcacagtggagaagcccagcaaggtgcaccgggccctgtacagcaagggcatcctgctgatggccgcctctgaaaatgaagataatgacatcctgtggtgtgtgaaccacgacaccttccccttccagaagcccatgatggagacccagatgacagctggggtggatggccacagctgggccctgagcgccattgatgagctgaaggtggacaagatcatcacccccctgaacaaggaccacatccccatcacagacagccctgtggtggtgcagcagcacatgctgccccccaagaagtttgtgctgctgagcgcccagggcagcctgatgttccacaagctgcggcctgtggaccagctgcggcacctgctggtgtccaatgtgggcggagatggagaggagattgagcgcttcttcaagctgcaccaggaggaccaggcctgtgccacctgcctgatcctggcctgcagcacagctgcctgtgaccgggaggtgtctgcctgggccacccgggccttcttccgctatggaggagaggcccagatgaggttccccaccaccctgcccccacccagcaatgtgggccccatcctgggcagccctgtgtacagcagcagccctgtgcccagcggcagcccctaccccaaccccagcttcctgggcacccccagccacggcatccagcccccagccatgagcacccctgtgtgtgccctgggcaacccagccacccaggccaccaacatgagctgtgtgactggacctgagatcgtgtacagcggcaagcacaacggcatctgcatctacttcagccgcatcatgggcaacatctgggatgccagcctggtggtggagcgcatcttcaagagcggcaaccgggagatcacagccatcgagagctctgtgccctgccagctgctggagagcgtgctgcaggagctgaagggcctgcaggagttcctggacaggaacagccagtttgctgggggccccctgggcaaccccaacaccacagccaaggtgcagcagaggctcatcggcttcatgaggccagaaaatggaaacccccagcagatgcagcaggagctgcagaggaagttccacgaggcccagctgtctgagaagatcagcctgcaggccatccagcagctggtgaggaagagctaccaggccctggccctgtggaagctgctgtgtgagcaccagttcaccatcatcgtggccgagctgcagaaggagctgcaggagcagctgaagatcaccaccttcaaggacctggtgatccgggacaaggagctgaccggggccctgattgccagcctcatcaactgctacatccgggacaatgctgctgtggatggcatcagcctgcacctgcaggacatctgccccctgctgtacagcacagatgatgccatctgcagcaaggccaatgagctgctgcagaggagccggcaggtgcagaacaagacagagaaggagaggatgctgcgggagagcctgaaggagtaccagaagatcagcaaccaggtggacctgagcaatgtgtgtgcccagtaccggcaggtgcgcttctatgagggcgtggtggagctgagcctgacagctgctgagaagaaggacccccagggcctgggcctgcacttctacaagcacggggagccagaagaagatattgtgggcctgcaggccttccaggagcggctgaacagctacaagtgcatcacagacaccctgcaggagctggtgaaccagagcaaggccgccccccagagccccagcgtgcccaagaagccaggcccccctgtgctgagcagtgaccccaacatgctgagcaatgaggaggccggccaccactttgagcagatgctgaagctgagccagaggagcaaggatgagctgttcagcatcgccctgtacaactggctgatccaggtggacctggccgacaagctgctgcaggtggccagccccttcctggagccccacctggtgaggatggccaaggtggaccagaacagagtgcgctacatggacctgctgtggagatactatgagaagaacagaagcttcagcaatgctgcccgggtgctgagccggctggccgacatgcacagcacagagatcagcctgcagcagaggctggagtacatcgcccgggccatcctgagcgccaagagcagcacagccatcagcagcattgctgctgatggagagttcctgcacgagctggaggagaagatggaggtggcccgcatccagctgcagatccaggagaccctgcagaggcagtacagccaccacagctctgtgcaggatgctgtgtcccagctggacagcgagctgatggacatcaccaagctgtatggagaatttgctgaccccttcaagctggccgagtgcaagctggccatcatccactgtgccggctacagcgaccccatcctggtgcagaccctgtggcaggacatcatcgagaaggagctgagtgacagcgtgaccctgagcagcagtgacaggatgcacgccctgagcctgaagatcgtgctgctgggcaagatctatgccggcaccccccgcttcttccccctggacttcatcgtgcagttcctggagcagcaggtgtgcaccctgaactgggatgtgggcttcgtcatccagaccatgaatgaaattggagtgcccctgccccggctgctggaggtgtatgaccagctgttcaagagccgggaccccttctggaacaggatgaagaagcccctgcacctgctggactgcatccacgtgctgctgatccgctacgtggagaaccccagccaggtgctgaactgtgagcggcggcgcttcaccaacctgtgcctggatgctgtgtgtggctacctggtggagctgcagagcatgagcagctctgtggccgtgcaggccatcactggaaacttcaagagcctgcaggccaagctggagcggctgcactag

SEQ ID NO: 20917 - DNA, 2334 bp, Artificial Sequence
  Description of Artificial Sequence: Synthetic coding sequence
atggacagcaaggagagcctgaccccaggccgggaggagaaccccagctctgtgctggcccaggagagaggagatgtgatggacttctacaagaccctgcggggcggggccaccgtgaaggtgtctgccagcagccccagcctggccgtggccagccagagcgacagcaagcagaggcggctgctggtggacttccccaagggctctgtgtccaatgcccagcagcctgacctgagcaaggctgtgtccctgtccatgggcctgtacatgggagaaacagagaccaaggtgatgggaaatgacctgggcttcccccagcagggccagatcagcctgagcagcggggagacagacctgaagctgctggaggagagcatcgccaacctgaacagaagcacctctgtgcctgagaaccccaagagcagcgccagcacagctgtgtctgctgcccccacagagaaggagttccccaagacccacagtgatgtgtcctctgagcagcagcacctgaagggccagacaggcaccaatggaggaaatgtgaagctgtacaccacagaccagagcacctttgacatcctgcaggacctggagttcagcagcggcagccctgggaaggagaccaatgaaagcccctggaggagtgacctgctgattgatgagaactgcctgctgagccccctggccggagaagatgacagcttcctgctggagggcaacagcaatgaagactgcaagcccctcatcctgcctgacaccaagcccaagatcaaggacaacggggacctggtgctgagcagccccagcaatgtgaccctgccccaggtgaagacagagaaggaggacttcatcgagctgtgcaccccaggagtcatcaagcaggagaagctgggcaccgtgtactgccaggccagcttccctggggccaacatcatcggcaacaagatgtctgccatctctgtgcacggcgtgtccaccagcggcggccagatgtaccactatgacatgaacacagccagcctgagccagcagcaggaccagaagcccatcttcaacgtcatcccccccatccctgtgggcagcgagaactggaaccgctgccagggcagcggagatgacaacctgaccagcctgggcaccctgaacttccctggccgcacagtgttcagcaatggctacagcagccccagcatgaggccagatgtgagcagcccccccagcagcagcagcacagccaccaccggccccccacccaagctgtgcctggtgtgcagtgatgaggccagcggctgccactatggagtgctgacctgtggcagctgcaaggtgttcttcaagagagctgtggagggccagcacaactacctgtgtgccggcagaaatgactgcatcatcgacaagatccggaggaagaactgcccagcctgccgctacaggaagtgcctgcaggccggcatgaacctggaggccaggaagaccaagaagaagatcaagggcatccagcaggccaccactggagtgtcccaggagaccagtgaaaatcctggcaacaagaccatcgtgcctgccaccctgccccagctgacccccaccctggtgtccctgctggaggtgattgagcctgaggtgctgtatgccggctatgacagctctgtgcctgacagcacctggaggatcatgaccaccctgaacatgctgggcggccggcaggtgattgctgctgtgaagtgggccaaggccatccctggcttcaggaacctgcacctggatgaccagatgaccctgctgcagtacagctggatgttcctgatggcctttgccctgggctggaggagctaccggcagagcagcgccaacctgctgtgctttgccccagacctgatcatcaatgagcagaggatgaccctgccctgcatgtatgaccagtgcaagcacatgctgtatgtgtcctctgagctgcaccggctgcaggtgtcctatgaggagtacctgtgcatgaagaccctgctgctgctgagctctgtgcccaaggatggcctgaagagccaggagctgtttgatgagatccgcatgacctacatcaaggagctgggcaaggccatcgtgaagcgggagggcaacagcagccagaactggcagcgcttctaccagctgaccaagctgctggacagcatgcatgaggtggtggagaacctgctgaactactgcttccagaccttcctggacaagaccatgagcattgagttccctgagatgctggccgagatcatcaccaaccagatccccaagtacagcaatggaaacatcaagaagctgctcttccaccagaagtag

SEQ ID NO: 20918 - DNA, 1782 bp, Artificial Sequence
  Description of Artificial Sequence: Synthetic coding sequence
atggacagcaaggagagcctgaccccaggccgggaggagaaccccagctctgtgctggcccaggagagaggagatgtgatggacttctacaagaccctgcggggcggggccaccgtgaaggtgtctgccagcagccccagcctggccgtggccagccagagcgacagcaagcagaggcggctgctggtggacttccccaagggctctgtgtccaatgcccagcagcctgacctgagcaaggctgtgtccctgtccatgggcctgtacatgggagaaacagagaccaaggtgatgggaaatgacctgggcttcccccagcagggccagatcagcctgagcagcggggagacagacctgaagctgctggaggagagcatcgccaacctgaacagaagcacctctgtgcctgagaaccccaagagcagcgccagcacagctgtgtctgctgcccccacagagaaggagttccccaagacccacagtgatgtgtcctctgagcagcagcacctgaagggccagacaggcaccaatggaggaaatgtgaagctgtacaccacagaccagagcacctttgacatcctgcaggacctggagttcagcagcggcagccctgggaaggagaccaatgaaagcccctggaggagtgacctgctgattgatgagaactgcctgctgagccccctggccggagaagatgacagcttcctgctggagggcaacagcaatgaagactgcaagcccctcatcctgcctgacaccaagcccaagatcaaggacaacggggacctggtgctgagcagccccagcaatgtgaccctgccccaggtgaagacagagaaggaggacttcatcgagctgtgcaccccaggagtcatcaagcaggagaagctgggcaccgtgtactgccaggccagcttccctggggccaacatcatcggcaacaagatgtctgccatctctgtgcacggcgtgtccaccagcggcggccagatgtaccactatgacatgaacacagccagcctgagccagcagcaggaccagaagcccatcttcaacgtcatcccccccatccctgtgggcagcgagaactggaaccgctgccagggcagcggagatgacaacctgaccagcctgggcaccctgaacttccctggccgcacagtgttcagcaatggctacagcagccccagcatgaggccagatgtgagcagcccccccagcagcagcagcacagccaccaccggccccccacccaagctgtgcctggtgtgcagtgatgaggccagcggctgccactatggagtgctgacctgtggcagctgcaaggtgttcttcaagagagctgtggagggccagcacaactacctgtgtgccggcagaaatgactgcatcatcgacaagatccggaggaagaactgcccagcctgccgctacaggaagtgcctgcaggccggcatgaacctggaggtggtgcccaaggatggcctgaagagccaggagctgtttgatgagatccgcatgacctacatcaaggagctgggcaaggccatcgtgaagcgggagggcaacagcagccagaactggcagcgcttctaccagctgaccaagctgctggacagcatgcatgaggtggtggagaacctgctgaactactgcttccagaccttcctggacaagaccatgagcattgagttccctgagatgctggccgagatcatcaccaaccagatccccaagtacagcaatggaaacatcaagaagctgctcttccaccagaagtag

SEQ ID NO: 20919 - DNA, 2334 bp, Artificial Sequence; identical to SEQ ID NO: 20917
  Description of Artificial Sequence: Synthetic coding sequence

SEQ ID NO: 20920 - DNA, 2337 bp, Artificial Sequence
  Description of Artificial Sequence: Synthetic coding sequence
atggacagcaaggagagcctgaccccaggccgggaggagaaccccagctctgtgctggcccaggagagaggagatgtgatggacttctacaagaccctgcggggcggggccaccgtgaaggtgtctgccagcagccccagcctggccgtggccagccagagcgacagcaagcagaggcggctgctggtggacttccccaagggctctgtgtccaatgcccagcagcctgacctgagcaaggctgtgtccctgtccatgggcctgtacatgggagaaacagagaccaaggtgatgggaaatgacctgggcttcccccagcagggccagatcagcctgagcagcggggagacagacctgaagctgctggaggagagcatcgccaacctgaacagaagcacctctgtgcctgagaaccccaagagcagcgccagcacagctgtgtctgctgcccccacagagaaggagttccccaagacccacagtgatgtgtcctctgagcagcagcacctgaagggccagacaggcaccaatggaggaaatgtgaagctgtacaccacagaccagagcacctttgacatcctgcaggacctggagttcagcagcggcagccctgggaaggagaccaatgaaagcccctggaggagtgacctgctgattgatgagaactgcctgctgagccccctggccggagaagatgacagcttcctgctggagggcaacagcaatgaagactgcaagcccctcatcctgcctgacaccaagcccaagatcaaggacaacggggacctggtgctgagcagccccagcaatgtgaccctgccccaggtgaagacagagaaggaggacttcatcgagctgtgcaccccaggagtcatcaagcaggagaagctgggcaccgtgtactgccaggccagcttccctggggccaacatcatcggcaacaagatgtctgccatctctgtgcacggcgtgtccaccagcggcggccagatgtaccactatgacatgaacacagccagcctgagccagcagcaggaccagaagcccatcttcaacgtcatcccccccatccctgtgggcagcgagaactggaaccgctgccagggcagcggagatgacaacctgaccagcctgggcaccctgaacttccctggccgcacagtgttcagcaatggctacagcagccccagcatgaggccagatgtgagcagcccccccagcagcagcagcacagccaccaccggccccccacccaagctgtgcctggtgtgcagtgatgaggccagcggctgccactatggagtgctgacctgtggcagctgcaaggtgttcttcaagagagctgtggagggccggcagcacaactacctgtgtgccggcagaaatgactgcatcatcgacaagatccggaggaagaactgcccagcctgccgctacaggaagtgcctgcaggccggcatgaacctggaggccaggaagaccaagaagaagatcaagggcatccagcaggccaccaccggggtgtcccaggagaccagcgagaaccctggcaacaagaccatcgtgcctgccaccctgccccagctgacccccaccctggtgtccctgctggaggtgattgagcctgaggtgctgtatgccggctatgacagctctgtgcctgacagcacctggaggatcatgaccaccctgaacatgctgggcggccggcaggtgattgctgctgtgaagtgggccaaggccatccctggcttcaggaacctgcacctggatgaccagatgaccctgctgcagtacagctggatgttcctgatggcctttgccctgggctggaggagctaccggcagagcagcgccaacctgctgtgctttgccccagacctgatcatcaatgagcagaggatgaccctgccctgcatgtatgaccagtgcaagcacatgctgtatgtgagcagcgagctgcaccggctgcaggtgtcctatgaggagtacctgtgcatgaagaccctgctgctgctgagctctgtgcccaaggatggcctgaagagccaggagctgtttgatgagatccgcatgacctacatcaaggagctgggcaaggccatcgtgaagcgggagggcaacagcagccagaactggcagcgcttctaccagctgaccaagctgctggacagcatgcatgaggtggtggagaacctgctgaactactgcttccagaccttcctggacaagaccatgagcattgagttccctgagatgctggccgagatcatcaccaaccagatccccaagtacagcaatggaaacatcaagaagctgctcttccaccagaagtag

SEQ ID NO: 20921 - DNA, 2229 bp, Artificial Sequence
  Description of Artificial Sequence: Synthetic coding sequence
atggacagcaaggagagcctgaccccaggccgggaggagaaccccagctctgtgctggcccaggagagaggagatgtgatggacttctacaagaccctgcggggcggggccaccgtgaaggtgtctgccagcagccccagcctggccgtggccagccagagcgacagcaagcagaggcggctgctggtggacttccccaagggctctgtgtccaatgcccagcagcctgacctgagcaaggctgtgtccctgtccatgggcctgtacatgggagaaacagagaccaaggtgatgggaaatgacctgggcttcccccagcagggccagatcagcctgagcagcggggagacagacctgaagctgctggaggagagcatcgccaacctgaacagaagcacctctgtgcctgagaaccccaagagcagcgccagcacagctgtgtctgctgcccccacagagaaggagttccccaagacccacagtgatgtgtcctctgagcagcagcacctgaagggccagacaggcaccaatggaggaaatgtgaagctgtacaccacagaccagagcacctttgacatcctgcaggacctggagttcagcagcggcagccctgggaaggagaccaatgaaagcccctggaggagtgacctgctgattgatgagaactgcctgctgagccccctggccggagaagatgacagcttcctgctggagggcaacagcaatgaagactgcaagcccctcatcctgcctgacaccaagcccaagatcaaggacaacggggacctggtgctgagcagccccagcaatgtgaccctgccccaggtgaagacagagaaggaggacttcatcgagctgtgcaccccaggagtcatcaagcaggagaagctgggcaccgtgtactgccaggccagcttccctggggccaacatcatcggcaacaagatgtctgccatctctgtgcacggcgtgtccaccagcggcggccagatgtaccactatgacatgaacacagccagcctgagccagcagcaggaccagaagcccatcttcaacgtcatcccccccatccctgtgggcagcgagaactggaaccgctgccagggcagcggagatgacaacctgaccagcctgggcaccctgaacttccctggccgcacagtgttcagcaatggctacagcagccccagcatgaggccagatgtgagcagcccccccagcagcagcagcacagccaccaccggccccccacccaagctgtgcctggtgtgcagtgatgaggccagcggctgccactatggagtgctgacctgtggcagctgcaaggtgttcttcaagagagctgtggagggccagcacaactacctgtgtgccggcagaaatgactgcatcatcgacaagatccggaggaagaactgcccagcctgccgctacaggaagtgcctgcaggccggcatgaacctggaggccaggaagaccaagaagaagatcaagggcatccagcaggccaccactggagtgtcccaggagaccagtgaaaatcctggcaacaagaccatcgtgcctgccaccctgccccagctgacccccaccctggtgtccctgctggaggtgattgagcctgaggtgctgtatgccggctatgacagctctgtgcctgacagcacctggaggatcatgaccaccctgaacatgctgggcggccggcaggtgattgctgctgtgaagtgggccaaggccatccctggcttcaggaacctgcacctggatgaccagatgaccctgctgcagtacagctggatgttcctgatggcctttgccctgggctggaggagctaccggcagagcagcgccaacctgctgtgctttgccccagacctgatcatcaatgagcagaggatgaccctgccctgcatgtatgaccagtgcaagcacatgctgtatgtgtcctctgagctgcaccggctgcaggtgtcctatgaggagtacctgtgcatgaagaccctgctgctgctgagctctgtgcccaaggatggcctgaagagccaggagctgtttgatgagatccgcatgacctacatcaaggagctgggcaaggccatcgtgaagcgggagggcaacagcagccagaactggcagcgcttctaccagctgaccaagctgctggacagcatgcatgaaaatgtgatgtggctgaagccagagagcaccagccacaccctcatctag

SEQ ID NO: 20922 - DNA, 1143 bp, Artificial Sequence
  Description of Artificial Sequence: Synthetic coding sequence
atgaggccagatgtgagcagcccccccagcagcagcagcacagccaccactggacctccacccaagctgtgcctggtgtgcagtgatgaggccagcggctgccactacggcgtgctgacctgtggcagctgcaaggtgttcttcaagagagctgtggagggccagcacaactacctgtgtgccggcagaaatgactgcatcatcgacaagatccggaggaagaactgcccagcctgccgctacaggaagtgcctgcaggccggcatgaacctggaggccaggaagaccaagaagaagatcaagggcatccagcaggccaccaccggggtgtcccaggagaccagcgagaaccctggcaacaagaccatcgtgcctgccaccctgccccagctgacccccaccctggtgtccctgctggaggtgattgagcctgaggtgctgtatgccggctatgacagctctgtgcctgacagcacctggaggatcatgaccaccctgaacatgctgggcggccggcaggtgattgctgctgtgaagtgggccaaggccatccctggcttcaggaacctgcacctggatgaccagatgaccctgctgcagtacagctggatgttcctgatggcctttgccctgggctggaggagctaccggcagagcagcgccaacctgctgtgctttgccccagacctgatcatcaatgagcagaggatgaccctgccctgcatgtatgaccagtgcaagcacatgctgtatgtgagcagcgagctgcaccggctgcaggtgtcctatgaggagtacctgtgcatgaagaccctgctgctgctgagctctgtgcccaaggatggcctgaagagccaggagctgtttgatgagatccgcatgacctacatcaaggagctgggcaaggccatcgtgaagcgggagggcaacagcagccagaactggcagcgcttctaccagctgaccaagctgctggacagcatgcatgaggtggtggagaacctgctgaactactgcttccagaccttcctggacaagaccatgagcattgagttccctgagatgctggccgagatcatcaccaaccagatccccaagtacagcaatggaaacatcaagaagctgctcttccaccagaagtag

SEQ ID NO: 20923 - DNA, 2256 bp, Artificial Sequence
  Description of Artificial Sequence: Synthetic coding sequence
atggacagcaaggagagcctgaccccaggccgggaggagaaccccagctctgtgctggcccaggagagaggagatgtgatggacttctacaagaccctgcggggcggggccaccgtgaaggtgtctgccagcagccccagcctggccgtggccagccagagcgacagcaagcagaggcggctgctggtggacttccccaagggctctgtgtccaatgcccagcagcctgacctgagcaaggctgtgtccctgtccatgggcctgtacatgggagaaacagagaccaaggtgatgggaaatgacctgggcttcccccagcagggccagatcagcctgagcagcggggagacagacctgaagctgctggaggagagcatcgccaacctgaacagaagcacctctgtgcctgagaaccccaagagcagcgccagcacagctgtgtctgctgcccccacagagaaggagttccccaagacccacagtgatgtgtcctctgagcagcagcacctgaagggccagacaggcaccaatggaggaaatgtgaagctgtacaccacagaccagagcacctttgacatcctgcaggacctggagttcagcagcggcagccctgggaaggagaccaatgaaagcccctggaggagtgacctgctgattgatgagaactgcctgctgagccccctggccggagaagatgacagcttcctgctggagggcaacagcaatgaagactgcaagcccctcatcctgcctgacaccaagcccaagatcaaggacaacggggacctggtgctgagcagccccagcaatgtgaccctgccccaggtgaagacagagaaggaggacttcatcgagctgtgcaccccaggagtcatcaagcaggagaagctgggcaccgtgtactgccaggccagcttccctggggccaacatcatcgccagcctgagccagcagcaggaccagaagcccatcttcaacgtcatcccccccatccctgtgggcagcgagaactggaaccgctgccagggcagcggagatgacaacctgaccagcctgggcaccctgaacttccctggccgcacagtgttcagcaatggctacagcagccccagcatgaggccagatgtgagcagcccccccagcagcagcagcacagccaccaccggccccccacccaagctgtgcctggtgtgcagtgatgaggccagcggctgccactatggagtgctgacctgtggcagctgcaaggtgttcttcaagagagctgtggagggccagcacaactacctgtgtgccggcagaaatgactgcatcatcgacaagatccggaggaagaactgcccagcctgccgctacaggaagtgcctgcaggccggcatgaacctggaggccaggaagaccaagaagaagatcaagggcatccagcaggccaccactggagtgtcccaggagaccagtgaaaatcctggcaacaagaccatcgtgcctgccaccctgccccagctgacccccaccctggtgtccctgctggaggtgattgagcctgaggtgctgtatgccggctatgacagctctgtgcctgacagcacctggaggatcatgaccaccctgaacatgctgggcggccggcaggtgattgctgctgtgaagtgggccaaggccatccctggcttcaggaacctgcacctggatgaccagatgaccctgctgcagtacagctggatgttcctgatggcctttgccctgggctggaggagctaccggcagagcagcgccaacctgctgtgctttgccccagacctgatcatcaatgagcagaggatgaccctgccctgcatgtatgaccagtgcaagcacatgctgtatgtgtcctctgagctgcaccggctgcaggtgtcctatgaggagtacctgtgcatgaagaccctgctgctgctgagctctgtgcccaaggatggcctgaagagccaggagctgtttgatgagatccgcatgacctacatcaaggagctgggcaaggccatcgtgaagcgggagggcaacagcagccagaactggcagcgcttctaccagctgaccaagctgctggacagcatgcatgaggtggtggagaacctgctgaactactgcttccagaccttcctggacaagaccatgagcattgagttccctgagatgctggccgagatcatcaccaaccagatccccaagtacagcaatggaaacatcaagaagctgctcttccaccagaagtag

SEQ ID NO: 20924 - DNA, 435 bp, Artificial Sequence
  Description of Artificial Sequence: Synthetic coding sequence
atggacagcaaggagagcctgaccccaggccgggaggagaaccccagctctgtgctggcccaggagagaggagatgtgatggacttctacaagaccctgcggggcggggccaccgtgaaggtgtctgccagcagccccagcctggccgtggccagccagagcgacagcaagcagaggcggctgctggtggacttccccaagggctctgtgtccaatgcccagcagcctgacctgagcaaggctgtgtccctgtccatgggcctgtacatgggagaaacagagaccaaggtgatgggaaatgacctgggcttcccccagcagggccagatcagcctgagcagcggggagacagacctgaagctgctggaggagagcatcgccaacctgaacagaagcacctctgtgcctgagaaccccaagagcagcgccagctag

SEQ ID NO: 20925 - DNA, 438 bp, Artificial Sequence
  Description of Artificial Sequence: Synthetic coding sequence
atggacagcaaggagagcctgaccccaggccgggaggagaaccccagctctgtgctggcccaggagagaggagatgtgatggacttctacaagaccctgcggggcggggccaccgtgaaggtgtctgccagcagccccagcctggccgtggccagccagagcgacagcaagcagaggcggctgctggtggacttccccaagggctctgtgtccaatgcccagcagcctgacctgagcaaggctgtgtccctgtccatgggcctgtacatgggagaaacagagaccaaggtgatgggaaatgacctgggcttcccccagcagggccagatcagcctgagcagcggggagacagacctgaagctgctggaggagagcatcgccaacctgaacagaagcacctctgtgcctgagaaccccaagagcagcgccagcacctag

SEQ ID NO: 20926 - DNA, 2334 bp, Artificial Sequence; identical to SEQ ID NO: 20917
  Description of Artificial Sequence: Synthetic coding sequence

SEQ ID NO: 20927 - DNA, 2337 bp, Artificial Sequence; identical to SEQ ID NO: 20920
  Description of Artificial Sequence: Synthetic coding sequence

SEQ ID NO: 20928 - DNA, 438 bp, Artificial Sequence; identical to SEQ ID NO: 20925
  Description of Artificial Sequence: Synthetic coding sequence

SEQ ID NO: 20929 - DNA, 438 bp, Artificial Sequence; identical to SEQ ID NO: 20925
  Description of Artificial Sequence: Synthetic coding sequence

SEQ ID NO: 20930 - DNA, 438 bp, Artificial Sequence; identical to SEQ ID NO: 20925
  Description of Artificial Sequence: Synthetic coding sequence

SEQ ID NO: 20931 - DNA, 1914 bp, Artificial Sequence
  Description of Artificial Sequence: Synthetic coding sequence
atgcatgacagcatccgctttggaaatgtggacatgccctgtgtgcaggcccagtacagccccagccccccaggcagcagctatgctgcccagacctacagcagcgagtacaccacagagatcatgaacccagactacaccaagctgaccatggacctgggcagcacagagatcacagccacagccaccaccagcctgcccagcatcagcacctttgtggagggctacagcagcaactatgagctgaagcccagctgtgtgtaccagatgcagaggcccctcatcaaggtggaggagggccgggcccccagctaccaccaccaccaccaccaccaccaccaccaccaccaccaccaccagcagcagcaccagcagcccagcatccccccagccagcagcccagaagatgaggtgctgcccagcacctccatgtacttcaagcagagcccccccagcacccccaccaccccagccttccccccccaggccggggccctgtgggatgaggccctgcccagcgcccctggctgcatcgcccctggccccctgctggacccccccatgaaggctgtgcccaccgtggccggggcccgcttccccctcttccacttcaagcccagccccccccaccccccagcccccagccctgctgggggccaccacctgggctatgaccccacagctgctgctgccctgagcctgcccctgggcgctgctgctgctgctggcagccaggccgccgccctggagagccacccctacggcctgcccctggccaagagagctgcccccctggccttcccccccctgggcctgacccccagccccacagccagcagcctgctgggggagagccccagcctgcccagcccccccagccgcagcagcagcagcggggagggcacctgtgctgtgtgtggggacaatgctgcctgccagcactatggagtgaggacctgtgagggctgcaagggcttcttcaagaggacagtgcagaagaatgccaagtatgtgtgcctggccaacaagaactgccctgtggacaagagaagaagaaaccgctgccagtactgccgcttccagaagtgcctgtctgtgggcatggtgaaggaggtggtgaggacagacagcctgaagggcagaagaggccgcctgcccagcaagcccaagagccccctgcagcaggagcccagccagcccagcccccccagcccccccatctgcatgatgaatgccctggtgcgggccctgacagacagcaccccccgggacctggactacagccgctactgccccacagaccaggccgccgccggcacagatgctgagcacgtgcagcagttctacaacctgctgacagccagcattgatgtgagccgctcctgggccgagaagatccctggcttcacagacctgcccaaggaggaccagaccctgctgattgaaagtgccttcctggagctgtttgtgctgcggctgagcatccgcagcaacacagctgaggacaagtttgtgttctgcaatggcctggtgctgcaccggctgcagtgcctgcggggctttggagagtggctggacagcatcaaggacttcagcctgaacctgcagagcctgaacctggacatccaggccctggcctgcctgagcgccctgtccatgatcacagagcggcacggcctgaaggagcccaagagggtggaggagctgtgcaacaagatcaccagcagcctgaaggaccaccagagcaagggccaggccctggagcccacagagagcaaggtgctgggcgccctggtggagctgaggaagatctgcaccctgggcctgcagaggatcttctacctgaagctggaggacctggtgtccccacccagcatcatcgacaagctgttcctggacaccctgcccttctag

SEQ ID NO: 20932 - DNA, 1332 bp, Artificial Sequence
  Description of Artificial Sequence: Synthetic coding sequence
atgccctgtgtgcaggcccagtacagccccagccccccaggcagcagctatgctgcccagacctacagcagcgagtacaccacagagatcatgaacccagactacaccaagctgaccatggacctgggcagcacagagatcacagccacagccaccaccagcctgcccagcatcagcacctttgtggagggctacagcagcaactatgagctgaagcccagctgtgtgtaccagatgcagaggcccctcatcaaggtggaggagggccgggcccccagctaccaccaccaccaccaccaccaccaccaccaccaccaccaccaccagcagcagcaccagcagcccagcatccccccagccagcagcccagaagatgaggtgctgcccagcacctccatgtacttcaagcagagcccccccagcacccccaccaccccagccttccccccccaggccggggccctgtgggatgaggccctgcccagcgcccctggctgcatcgcccctggccccctgctggacccccccatgaaggctgtgcccaccgtggccggggcccgcttccccctcttccacttcaagcccagccccccccaccccccagcccccagccctgctgggggccaccacctgggctatgaccccacagctgctgctgccctgagcctgcccctgggcgctgctgctgctgctggcagccaggccgccgccctggagagccacccctacggcctgcccctggccaagagagctgcccccctggccttcccccccctgggcctgacccccagccccacagccagcagcctgctgggggagagccccagcctgcccagcccccccagccgcagcagcagcagtggagagggcacctgtgctgtgtgtggggacaatgctgcctgccagcactacggcgtgaggacctgtgagggctgcaagggcttcttcaagaggacagtgcagaagaatgccaagtatgtgtgcctggccaacaagaactgccctgtggacaagagaagaagaaaccgctgccagtactgccgcttccagaagtgcctgtctgtgggcatggtgaaggaggtggtgaggacagacagcctgaagggccggcggggccgcctgcccagcaagcccaagagccccctgcagcaggagcccagccagcccagcccccccagcccccccatctgcatgatgaatgccctggtgcgggccctgacagacagcaccccccgggacctggactacagccgggtgtccttcatgatcagctgcttccagatgaatgaccagggcctgtacctgtggctgctggtgatccgggtggactag

SEQ ID NO: 20933 - DNA, 894 bp, Artificial Sequence
  Description of Artificial Sequence: Synthetic coding sequence
atgaaggctgtgcccaccgtggccggggcccgcttccccctcttccacttcaagcccagccccccccaccccccagcccccagccctgctgggggccaccacctgggctatgaccccacagctgctgctgccctgagcctgcccctgggcgctgctgctgctgctggcagccaggccgccgccctggagagccacccctacggcctgcccctggccaagagagctgcccccctggccttcccccccctgggcctgacccccagccccacagccagcagcctgctgggggagagccccagcctgcccagcccccccagccgcagcagcagcagtggagagggcacctgtgctgtgtgtggggacaatgctgcctgccagcactacggcgtgaggacctgtgagggctgcaagggcttcttcaagaggacagtgcagaagaatgccaagtatgtgtgcctggccaacaagaactgccctgtggacaagagaagaagaaaccgctgccagtactgccgcttccagaagtgcctgtctgtgggcatggtgaaggaggtggtgaggacagacagcctgaagggccggcggggccgcctgcccagcaagcccaagagccccctgcagcaggagcccagccagcccagcccccccagcccccccatctgcatgatgaatgccctggtgcgggccctgacagacagcaccccccgggacctggactacagccgggtgtccttcatgatcagctgcttccagatgaatgaccagggcctgtacctgtggctgctggtgatccgggtgctggacagcttccacaccttcagcatcttcctggccagcttcagcaacagcgtgcaccccctgcagcagatcatctttgccctgctgaacctgtag

SEQ ID NO: 20934 - DNA, 1881 bp, Artificial Sequence
  Description of Artificial Sequence: Synthetic coding sequence
atgccctgtgtgcaggcccagtacagccccagccccccaggcagcagctatgctgcccagacctacagcagcgagtacaccacagagatcatgaacccagactacaccaagctgaccatggacctgggcagcacagagatcacagccacagccaccaccagcctgcccagcatcagcacctttgtggagggctacagcagcaactatgagctgaagcccagctgtgtgtaccagatgcagaggcccctcatcaaggtggaggagggccgggcccccagctaccaccaccaccaccaccaccaccaccaccaccaccaccaccaccagcagcagcaccagcagcccagcatccccccagccagcagcccagaagatgaggtgctgcccagcacctccatgtacttcaagcagagcccccccagcacccccaccaccccagccttccccccccaggccggggccctgtgggatgaggccctgcccagcgcccctggctgcatcgcccctggccccctgctggacccccccatgaaggctgtgcccaccgtggccggggcccgcttccccctcttccacttcaagcccagccccccccaccccccagcccccagccctgctgggggccaccacctgggctatgaccccacagctgctgctgccctgagcctgcccctgggcgctgctgctgctgctggcagccaggccgccgccctggagagccacccctacggcctgcccctggccaagagagctgcccccctggccttcccccccctgggcctgacccccagccccacagccagcagcctgctgggggagagccccagcctgcccagcccccccagccgcagcagcagcagtggagagggcacctgtgctgtgtgtggggacaatgctgcctgccagcactacggcgtgaggacctgtgagggctgcaagggcttcttcaagaggacagtgcagaagaatgccaagtatgtgtgcctggccaacaagaactgccctgtggacaagagaagaagaaaccgctgccagtactgccgcttccagaagtgcctgtctgtgggcatggtgaaggaggtggtgaggacagacagcctgaagggccggcggggccgcctgcccagcaagcccaagagccccctgcagcaggagcccagccagcccagcccccccagcccccccatctgcatgatgaatgccctggtgcgggccctgacagacagcaccccccgggacctggactacagccgctactgccccacagaccaggccgctgctggaacagatgctgagcacgtgcagcagttctacaacctgctgacagccagcattgatgtgagccgctcctgggccgagaagatccctggcttcacagacctgcccaaggaggaccagaccctgctgattgagagcgccttcctggagctgtttgtgctgcggctgagcatccgcagcaacacagctgaggacaagtttgtgttctgcaatggcctggtgctgcaccggctgcagtgcctgcggggctttggagagtggctggacagcatcaaggacttcagcctgaacctgcagagcctgaacctggacatccaggccctggcctgcctgagcgccctgtccatgatcacagaaagacatggcctgaaggagcccaagagggtggaggagctgtgcaacaagatcaccagcagcctgaaggaccaccagagcaagggccaggccctggagcccacagagagcaaggtgctgggcgccctggtggagctgaggaagatctgcaccctgggcctgcagaggatcttctacctgaagctggaggacctggtgagcccccccagcatcatcgacaagctgttcctggacaccctgcccttctag

SEQ ID NO: 20935 - DNA, 627 bp, Artificial Sequence
  Description of Artificial Sequence: Synthetic coding sequence
atgggaaatgcccaggagcggcccagcgagaccatcgaccgggagaggaagaggctggtggagaccctgcaggccgacagcggcctgctgctggatgccctgctggcccggggcgtgctgactggaccagaatatgaggccctggatgccctgcctgatgctgagcggcgggtgcggcggctgctgctgctggtgcagggcaagggggaggccgcctgccaggagctgctgcgctgtgcccagaggacagctggggccccagaccctgcctgggactggcagcacgtgggccctggctacagagacaggagctatgaccccccctgccccggccactggaccccagaggcccctggcagcggcaccacctgccccggcctgccccgggccagtgaccctgatgaggccggcggccctgagggcagcgaggccgtgcagagcggcaccccagaggagcctgagcctgagctggaggccgaggccagcaaggaggccgagcctgagcctgagcctgagcctgagctggagcctgaggccgaggccgagcctgagcctgagctggagcctgagccagaccctgagcctgagccagactttgaggagagagatgaaagtgaggacagctag

SEQ ID NO: 20936 - DNA, 627 bp, Artificial Sequence; identical to SEQ ID NO: 20935
  Description of Artificial Sequence: Synthetic coding sequence

SEQ ID NO: 20937 - DNA, 2133 bp, Artificial Sequence
  Description of Artificial Sequence: Synthetic coding sequence
atggtgaagctggccaaggccggcaagaaccagggcgaccccaagaagatggcccccccacccaaggaggtggaggaggacagtgaagatgaggagatgtctgaagatgaggaggatgacagcagcggggaggaggtggtgatcccccagaagaagggcaagaaggctgctgccaccagcgccaagaaggtggtggtgagccccaccaagaaggtggccgtggccaccccagccaagaaggctgctgtgaccccaggcaagaaggccgccgccaccccagccaagaagacagtgaccccagccaaggctgtgaccaccccaggcaagaagggggccacccctgggaaggccctggtggccacccctgggaagaagggagctgccatcccagccaagggggccaagaatggcaagaatgccaagaaggaggacagtgatgaggaggaggatgatgattctgaagaagatgaggaggatgatgaagatgaagatgaagatgaagatgaaattgagcctgctgccatgaaggctgctgctgctgccccagcctctgaagatgaagatgatgaagatgatgaagatgatgaagatgatgatgatgatgaagaagatgacagcgaggaggaggccatggagaccaccccagccaagggcaagaaggccgccaaggtggtgcctgtgaaggccaagaatgtggccgaggatgaagatgaggaggaggatgatgaagatgaagatgatgatgatgatgaagatgatgaagatgatgatgatgaagatgatgaggaggaggaggaggaggaggaggaggagcctgtgaaggaggcccctgggaagaggaagaaggagatggccaagcagaaggccgcccctgaggccaagaagcagaaggtggagggcacagagcccaccacagccttcaacctgtttgtgggcaacctgaacttcaacaagagcgcccctgagctgaagacaggcatcagtgatgtgtttgccaagaatgacctggccgtggtggatgtgagaattggcatgaccaggaagtttggctacgtggactttgagagcgctgaggacctggagaaggccctggagctgaccggcctgaaggtgtttggaaatgagatcaagctggagaagcccaagggcaaggacagcaagaaggagagagatgcccggaccctgctggccaagaacctgccctacaaggtgacccaggatgagctgaaggaggtgtttgaagatgctgctgagatccggctggtgtccaaggatggcaagagcaaaggaattgcctacatcgagttcaagacagaagcagatgctgagaagacctttgaggagaagcagggcacagaaattgatggccgcagcatcagcctgtactacaccggggagaagggccagaaccaggactacagaggaggcaagaacagcacctggagcggggagagcaagaccctggtgctgagcaacctgagctacagcgccacagaggagaccctgcaggaggtgtttgagaaggccaccttcatcaaggtgccccagaaccagaatggcaagagcaagggctacgccttcatcgagtttgccagctttgaagatgccaaggaggccctgaacagctgcaacaagcgggagattgagggccgggccatccggctggagctgcagggcccccggggcagccccaatgcccggagccagcccagcaagaccctgtttgtgaagggcctgtctgaggacaccacagaggagaccctgaaggagagctttgatggctctgtgcgggcccgcatcgtgacagaccgggagaccggcagcagcaagggcttcggctttgtggacttcaacagtgaagaagatgccaaggccgccaaggaggccatggaggatggagaaattgatggcaacaaggtgaccctggactgggccaagcccaagggggagggcggctttggaggccggggcggcggccggggcggctttggaggccggggcggcggccggggcggccggggcggctttggaggccggggccggggcggctttggaggccggggcggcttccggggcggccggggcggcggcggggaccacaagccccagggcaagaagaccaagtttgaatag

SEQ ID NO: 20938 - DNA, 1449 bp, Artificial Sequence
  Description of Artificial Sequence: Synthetic coding sequence
atggtgaagctggccaaggccggcaagaaccagggcgaccccaagaagatggcccccccacccaaggaggtggaggaggacagtgaagatgaggagatgtctgaagatgaggaggatgacagcagcggggaggaggtggtgatcccccagaagaagggcaagaaggctgctgccaccagcgccaagaaggtggtggtgagccccaccaagaaggtggccgtggccaccccagccaagaaggctgctgtgaccccaggcaagaaggccgccgccaccccagccaagaagacagtgaccccagccaaggctgtgaccaccccaggcaagaagggggccacccctgggaaggccctggtggccacccctgggaagaagggagctgccatcccagccaagggggccaagaatggcaagaatgccaagaaggaggacagtgatgaggaggaggatgatgattctgaagaagatgaggaggatgatgaagatgaagatgaagatgaagatgaaattgagcctgctgccatgaaggctgctgctgctgccccagcctctgaagatgaagatgatgaagatgatgaagatgatgaagatggcaagagcaaaggaattgcctacatcgagttcaagacagaagcagatgctgagaagacctttgaggagaagcagggcacagaaattgatggccgcagcatcagcctgtactacaccggggagaagggccagaaccaggactacagaggaggcaagaacagcacctggagcggggagagcaagaccctggtgctgagcaacctgagctacagcgccacagaggagaccctgcaggaggtgtttgagaaggccaccttcatcaaggtgccccagaaccagaatggcaagagcaagggctacgccttcatcgagtttgccagctttgaagatgccaaggaggccctgaacagctgcaacaagcgggagattgagggccgggccatccggctggagctgcagggcccccggggcagccccaatgcccggagccagcccagcaagaccctgtttgtgaagggcctgtctgaggacaccacagaggagaccctgaaggagagctttgatggctctgtgcgggcccgcatcgtgacagaccgggagaccggcagcagcaagggcttcggctttgtggacttcaacagtgaagaagatgccaaggccgccaaggaggccatggaggatggagaaattgatggcaacaaggtgaccctggactgggccaagcccaagggggagggcggctttggaggccggggcggcggccggggcggctttggaggccggggcggcggccggggcggccggggcggctttggaggccggggccggggcggctttggaggccggggcggcttccggggcggccggggcggcggcggggaccacaagccccagggcaagaagaccaagtttgaatag

SEQ ID NO: 20939 - DNA, 1809 bp, Artificial Sequence
  Description of Artificial Sequence: Synthetic coding sequence
atggtgaagctggccaaggccggcaagaaccagggcgaccccaagaagatggcccccccacccaaggaggtggaggaggacagtgaagatgaggagatgtctgaagatgaggaggatgacagcagcggggaggagctgaatgatgacttctaccagaccaccatgcacaccctgtggaagaagggcaagaaggccgccgccaccagcgccatcccagccaagggggccaagaatggcaagaatgccaagaaggaggacagtgatgaggaggaggatgatgattctgaagaagatgaggaggatgatgaagatgaagatgaagatgaagatgaaattgagcctgctgccatgaaggctgctgctgctgccccagcctctgaagatgaagatgatgaagatgatgaagatgatgaagatgatgatgatgatgaagaagatgatgatgatgatgaagatgatgaggaggaggaggaggaggaggaggaggagcctgtgaaggaggcccctgggaagaggaagaaggagatggccaagcagaaggccgcccctgaggccaagaagcagaaggtggagggcacagagcccaccacagccttcaacctgtttgtgggcaacctgaacttcaacaagagcgcccctgagctgaagacaggcatcagtgatgtgtttgccaagaatgacctggccgtggtggatgtgagaattggcatgaccaggaagtttggctacgtggactttgagagcgctgaggacctggagaaggccctggagctgaccggcctgaaggtgtttggaaatgagatcaagctggagaagcccaagggcaaggacagcaagaaggagagagatgcccggaccctgctggccaagaacctgccctacaaggtgacccaggatgagctgaaggaggtgtttgaagatgctgctgagatccggctggtgtccaaggatggcaagagcaaaggaattgcctacatcgagttcaagacagaagcagatgctgagaagacctttgaggagaagcagggcacagaaattgatggccgcagcatcagcctgtactacaccggggagaagggccagaaccaggactacagaggaggcaagaacagcacctggagcggggagagcaagaccctggtgctgagcaacctgagctacagcgccacagaggagaccctgcaggaggtgtttgagaaggccaccttcatcaaggtgccccagaaccagaatggcaagagcaagggctacgccttcatcgagtttgccagctttgaagatgccaaggaggccctgaacagctgcaacaagcgggagattgagggccgggccatccggctggagctgcagggcccccggggcagccccaatgcccggagccagcccagcaagaccctgtttgtgaagggcctgtctgaggacaccacagaggagaccctgaaggagagctttgatggctctgtgcgggcccgcatcgtgacagaccgggagaccggcagcagcaagggcttcggctttgtggacttcaacagtgaagaagatgccaaggccgccaaggaggccatggaggatggagaaattgatggcaacaaggtgaccctggactgggccaagcccaagggggagggcggctttggaggccggggcggcggccggggcggctttggaggccggggcggcggccggggcggccggggcggctttggaggccggggccggggcggctttggaggccggggcggcttccggggcggccggggcggcggcggggaccacaagccccagggcaagaagaccaagtttgaatag

SEQ ID NO: 20940 - DNA, 885 bp, Artificial Sequence
  Description of Artificial Sequence: Synthetic coding sequence
atggaggacagcatggacatggacatgagccccctgcggccccagaactacctgtttggctgtgagctgaaggctgacaaggactaccacttcaaggtggacaatgatgaaaatgagcaccagctgagcctgaggacagtgtccctgggcgctggggccaaggatgagctgcacatcgtggaggccgaggccatgaactatgagggcagccccatcaaggtgaccctggccaccctgaagatgtctgtgcagcccaccgtgtccctgggcggctttgagatcaccccacctgtggtgctgcggctgaagtgtggcagcggccctgtgcacatcagcggccagcacctggtggccgtggaggaggatgctgagagtgaagatgaggaggaggaggatgtgaagctgctgagcatcagcggcaagaggtctgcccctgggggcggcagcaaggtgccccagaagaaggtgaagctggccgcagatgaagatgatgatgatgatgatgaggaggatgatgatgaagatgatgatgatgatgactttgatgatgaggaggccgaggagaaggcccctgtgaagaagagcatccgggacaccccagccaagaatgcccagaagagcaaccagaatggcaaggacagcaagcccagcagcacccccaggagcaagggccaggagagcttcaagaagcaggagaagacccccaagacccccaagggccccagctctgtggaggacatcaaggccaagatgcaggccagcattgaaaaaggaggcagcctgcccaaggtggaggccaagttcatcaactacgtgaagaactgcttcaggatgacagaccaggaggccatccaggacctgtggcagtggaggaagagcctgtag

SEQ ID NO: 20941 - DNA, 798 bp, Artificial Sequence
  Description of Artificial Sequence: Synthetic coding sequence
atggaggacagcatggacatggacatgagccccctgcggccccagaactacctgtttggctgtgagctgaaggctgacaaggactaccacttcaaggtggacaatgatgaaaatgagcaccagctgagcctgaggacagtgtccctgggcgctggggccaaggatgagctgcacatcgtggaggccgaggccatgaactatgagggcagccccatcaaggtgaccctggccaccctgaagatgtctgtgcagcccaccgtgtccctgggcggctttgagatcaccccacctgtggtgctgcggctgaagtgtggcagcggccctgtgcacatcagcggccagcacctggtggccgtggaggaggatgctgagagtgaagatgaggaggaggaggatgtgaagctgctgagcatcagcggcaagaggtctgcccctgggggcggcagcaaggtgccccagaagaaggtgaagctggccgcagatgaagatgatgatgatgatgatgaggaggatgatgatgaagatgatgatgatgatgactttgatgatgaggaggccgaggagaaggcccctgtgaagaagggccaggagagcttcaagaagcaggagaagacccccaagacccccaagggccccagctctgtggaggacatcaaggccaagatgcaggccagcattgagaagggcggcagcctgcccaaggtggaggccaagttcatcaactacgtgaagaactgcttcaggatgacagaccaggaggccatccaggacctgtggcagtggaggaagagcctgtag

SEQ ID NO: 20942 - DNA, 780 bp, Artificial Sequence
  Description of Artificial Sequence: Synthetic coding sequence
atggaggacagcatggacatggacatgagccccctgcggccccagaactacctgtttggctgtgagctgaaggctgacaaggactaccacttcaaggtggacaatgatgaaaatgagcaccagctgagcctgaggacagtgtccctgggcgctggggccaaggatgagctgcacatcgtggaggccgaggccatgaactatgagggcagccccatcaaggtgaccctggccaccctgaagatgtctgtgcagcccaccgtgtccctgggcggctttgagatcaccccacctgtggtgctgcggctgaagtgtggcagcggccctgtgcacatcagcggccagcacctggtggccgtggaggaggatgctgagagtgaagatgaggaggaggaggatgtgaagctgctgagcatcagcggcaagaggtctgcccctgggggcggcagcaaggtgccccagaagaaggtgaagctggccgcagatgaagatgatgatgatgatgatgaggaggatgatgatgaagatgatgatgatgatgactttgatgatgaggaggccgaggagaaggcccctgtgaagaagagcatccgggacaccccagccaagaatgcccagaagagcaaccagaatggcaaggacagcaagcccagcagcacccccaggagcaagggccaggagagcttcaagaagcaggagaagacccccaagacccccaagggccccagctctgtggaggacatcaaggccaagatgcaggccagcattgagaaggcccactag

SEQ ID NO: 20943 - DNA, 885 bp, Artificial Sequence; identical to SEQ ID NO: 20940
  Description of Artificial Sequence: Synthetic coding sequence

SEQ ID NO: 20944 - DNA, 867 bp, Artificial Sequence
  Description of Artificial Sequence: Synthetic coding sequence
atgaaggacaggacccaggagctgaggacagccaaggacagtgatgatgatgatgatgtggccgtgacagtggaccgggaccgcttcatggatgagttctttgagcaggtggaggagatccggggcttcatcgacaagattgctgaaaatgtggaggaggtgaagaggaagcacagcgccatcctggccagccccaacccagatgagaagaccaaggaggagctggaggagctgatgtctgacatcaagaagacagccaacaaggtgcgcagcaagctgaagagcattgagcagagcattgagcaggaggagggcctgaacagaagcagcgctgacctgcgcatcaggaagacccagcacagcaccctgagcaggaagtttgtggaggtgatgtctgagtacaatgccacccagagcgactaccgggagcgctgcaagggccgcatccagaggcagctggagatcaccggccgcaccaccaccagcgaggagctggaggacatgctggagagcggcaacccagccatctttgccagcggcatcatcatggacagcagcatcagcaagcaggccctgtctgaaattgagaccaggcacagcgagatcatcaagctggagaacagcatccgggagctgcatgacatgttcatggacatggccatgctggtggagagccagggcgagatgattgacagaattgagtacaacgtggagcacgctgtggactatgtggagagagctgtgtctgacaccaagaaggctgtgaagtaccagagcaaggcccggaggaagaagatcatgatcatcatctgctgcgtcatcctgggcatcgtgattgccagcacagtgggcggcatctttgcctag

SEQ ID NO: 20945 - DNA, 183 bp, Artificial Sequence
  Description of Artificial Sequence: Synthetic coding sequence
atggaggagcagggccacagcgagatggagatcatccccagcgagagccacccccacatccagctgctgaagagcaaccgggagctgctggtgacccacatccggaacacccagtgcctggtggacaacctgctgaagaatgactacttcagcgcagaagatgctgagatcgtgtgtgcctag

SEQ ID NO: 20946 - DNA, 183 bp, Artificial Sequence; identical to SEQ ID NO: 20945
  Description of Artificial Sequence: Synthetic coding sequence

SEQ ID NO: 20947 - DNA, 138 bp, Artificial Sequence
  Description of Artificial Sequence: Synthetic coding sequence
atggaggagcagggccacagcgagatggagatcatccccagcgagagccacccccacatccagctgctgaagagcaaccgggagctgctggtgacccacatccggaacacccagtgcctggtggacaacctgctgtag

SEQ ID NO: 20948 - DNA, 183 bp, Artificial Sequence; identical to SEQ ID NO: 20945
  Description of Artificial Sequence: Synthetic coding sequence

SEQ ID NO: 20949 - DNA, 750 bp, Artificial Sequence
  Description of Artificial Sequence: Synthetic coding sequence
atggaggagcagggccacagcgagatggagatcatccccagcgagagccacccccacatccagctgctgaagagcaaccgggagctgctggtgacccacatccggaacacccagtgcctggtggacaacctgctgaagaatgactacttcagcgcagaagatgctgagatcgtgtgtgcctgccccacccagcctgacaaggtgaggaagatcctggacctggtgcagagcaagggggaggaggtgtctgagttcttcctgtacctgctgcagcagctggctgatgcctacgtggacctgcggccctggctgctggagatcggcttcagccccagcctgctgacccagagcaaggtggtggtgaacacagatcctgtgagccgctacacccagcagctgcggcaccacctgggccgggacagcaagtttgtgctgtgctacgcccagaaggaggagctgctgctggaggagatctacatggacaccatcatggagctggtgggcttcagcaatgaaagcctgggcagcctgaacagcctggcctgcctgctggaccacaccaccggcatcctgaatgagcaggccgccagcaggaaggtgacaggctgtgtgtgcaggacctgcagcagcagcaccacagccacccagagcggcaccccccggcgctgcctgcccagctgctgtgccagccccacctggcccagcagccccagcatggcctggaccagctgcaccaggacctggacctag

SEQ ID NO: 20950 - DNA, 2340 bp, Artificial Sequence
  Description of Artificial Sequence: Synthetic coding sequence
atggaggagcagggccacagcgagatggagatcatccccagcgagagccacccccacatccagctgctgaagagcaaccgggagctgctggtgacccacatccggaacacccagtgcctggtggacaacctgctgaagaatgactacttcagcgcagaagatgctgagatcgtgtgtgcctgccccacccagcctgacaaggtgaggaagatcctggacctggtgcagagcaagggggaggaggtgtctgagttcttcctgtacctgctgcagcagctggctgatgcctacgtggacctgcggccctggctgctggagatcggcttcagccccagcctgctgacccagagcaaggtggtggtgaacacagatcctgtgagccgctacacccagcagctgcggcaccacctgggccgggacagcaagtttgtgctgtgctacgcccagaaggaggagctgctgctggaggagatctacatggacaccatcatggagctggtgggcttcagcaatgaaagcctgggcagcctgaacagcctggcctgcctgctggaccacaccaccggcatcctgaatgagcagggcgagaccatcttcatcctgggagatgctggggtgggcaagtccatgctgctgcagaggctgcagagcctgtgggccaccggccgcctggatgctggggtgaagttcttcttccacttccgctgcaggatgttcagctgcttcaaggagagtgaccggctgtgcctgcaggacctgctcttcaagcactactgctacccagagcgggaccctgaggaggtgtttgccttcctgctgcgcttcccccacgtggccctcttcacctttgatggcctggatgagctgcacagcgacctggacctgagccgggtgcctgacagcagctgcccctgggagcccgcccaccccctggtgctgctggccaacctgctgagcggcaagctgctgaagggggccagcaagctgctgacagccaggacaggcatcgaggtgccccggcagttcctgaggaagaaggtgctgctgcggggcttcagccccagccacctgcgggcctatgcccggaggatgtttcctgagcgggccctgcaggaccggctgctgagccagctggaggccaaccccaacctgtgcagcctgtgcagcgtgcccctcttctgctggatcatcttccgctgcttccagcacttccgggccgcctttgagggcagcccccagctgcctgactgcaccatgaccctgacagatgtgttcctgctggtgacagaggtgcacctgaacaggatgcagcccagcagcctggtgcagaggaacaccaggagccctgtggagaccctgcatgctggccgggacaccctgtgcagcctgggccaggtggcccaccggggcatggagaagagcctgtttgtgttcacccaggaggaggtgcaggccagcggcctgcaggagcgggacatgcagctgggcttcctgcgggccctgcctgagctgggccctggaggagaccagcagagctatgagttcttccacctgaccctgcaggccttcttcaccgccttcttcctggtgctggatgacagagtgggcacccaggagctgctgcgcttcttccaggagtggatgcctcctgctggagctgccaccaccagctgctacccacccttcctgcccttccagtgcctgcagggcagcggccctgcccgggaggacctcttcaagaacaaggaccacttccagttcaccaacctcttcctgtgtggcctgctgagcaaggccaagcagaagctgctgcggcacctggtgcctgctgctgccctgcggaggaagaggaaggccctgtgggcccacctgttcagcagcctgcggggctacctgaagagcctgccccgggtgcaggtggagagcttcaaccaggtgcaggccatgcccaccttcatctggatgctgcgctgcatctatgagacccagagccagaaggtgggccagctggccgcccggggcatctgtgccaactacctgaagctgacctactgcaatgcctgcagcgctgactgcagcgccctgagctttgtgctgcaccacttccccaagaggctggccctggacctggacaacaacaacctgaatgactatggagtgcgggagctgcagccctgcttcagccggctgactgtgctgcggctgtctgtgaaccagatcacagatggcggcgtgaaggtgctgtctgaggagctgaccaagtacaagatcgtgacctacctgggcctgtggaagtctgtggacaccatctgcttcaagaagcagggcctgctgaagtag

SEQ ID NO: 20951 - DNA, 495 bp, Artificial Sequence
  Description of Artificial Sequence: Synthetic coding sequence
atgaagtgcaagcccaaccagaccaggacctatgaccctgagggcttcaagaagagagctgcctgcctgtgcttccgctctgagcgggaggatgaggtgctgctggtgagcagcagccgctacccagaccgctggatcgtgcctgggggcggcatggagcctgaggaggagcccggcggcgctgctgtgcgggaggtgtatgaggaggccggcgtgaagggcaagctgggccgcctgctgggcgtgtttgagcagaaccaggacaggaagcacaggacctacgtgtatgtgctgactgtgacagagctgctggaggactgggaggacagcgtgtccattggaaggaagcgggagtggttcaaggtggaggatgccatcaaggtgctgcagtgccacaagcctgtgcatgctgagtacctggagaagctgaagctgggcggcagccccaccaatggaaacagcatggcccccagcagcccagacagcgacccctag

SEQ ID NO: 20952 - DNA, 792 bp, Artificial Sequence
  Description of Artificial Sequence: Synthetic coding sequence
atgagcctgtactgcggcatcgcctgcaggaggaagttcttctggtgctaccgcctgctgagcacctacgtgaccaagacccgctacctgtttgagctgaaggaggatgatgatgcctgcaagaaggcccagcagacaggagccttctacctgttccacagcctggcccccctgctgcagaccagcgcccaccagtacctggcccccaggcacagcctgctggagctggagcggctgctgggcaagtttggccaggatgcccagagaattgaagattctgtgctgattggctgcagcgagcagcaggaggcctggtttgccctggacctgggcctggacagcagcttcagcatcagcgccagcctgcacaagccagagatggagacagagctgaagggcagcttcatcgagctgaggaaggccctcttccagctgaatgccagagatgccagcctgctgagcacagcccaggccctgctgcgctggcatgatgcccaccagttctgcagccgcagcggccagcccaccaagaagaatgtggccggcagcaagagggtgtgccccagcaacaacatcatctactacccccagatccaggtgaacctgcgggagctggagacagctgcctggttcagccatgatgaggtggccacagccctgaagaggaagggcccctacacccagcagcagaatggcaccttccccttctggctgccccccaagctggccatcagccaccagctgatcaaggagtgggtggagaagcagacctgcagcagcctgcctgcctag

SEQ ID NO: 20953 - DNA, 1059 bp, Artificial Sequence
  Description of Artificial Sequence: Synthetic coding sequence
atgagcctgtactgcggcatcgcctgcaggaggaagttcttctggtgctaccgcctgctgagcacctacgtgaccaagacccgctacctgtttgagctgaaggaggatgatgatgcctgcaagaaggcccagcagacaggagccttctacctgttccacagcctggcccccctgctgcagaccagcgcccaccagtacctggcccccaggcacagcctgctggagctggagcggctgctgggcaagtttggccaggatgcccagagaattgaagattctgtgctgattggctgcagcgagcagcaggaggcctggtttgccctggacctgggcctggacagcagcttcagcatcagcgccagcctgcacaagccagagatggagacagagctgaagggcagcttcatcgagctgaggaaggccctcttccagctgaatgccagagatgccagcctgctgagcacagcccaggccctgctgcgctggcatgatgcccaccagttctgcagccgcagcggccagcccaccaagaagaatgtggccggcagcaagagggtgtgccccagcaacaacatcatctactacccccagatggcccctgtggccatcaccctggtgtctgatggcacccgctgcctgctggcccggcagagcagcttccccaagggcatgtacagcgccctggccggcttctgtgacatcggggagagcgtggaggagaccatcagaagagaggtggccgaggaggtgggcctggaggtggagagcctgcagtactatgccagccagcactggcccttccccagcggcagcctgatgattgcctgccacgccaccgtgaagccaggccagacagagatccaggtgaacctgcgggagctggagacagctgcctggttcagccatgatgaggtggccacagccctgaagaggaagggcccctacacccagcagcagaatggcaccttccccttctggctgccccccaagctggccatcagccaccagctgatcaaggagtgggtggagaagcagacctgcagcagcctgcctgcctag

SEQ ID NO: 20954 - DNA, 708 bp, Artificial Sequence
  Description of Artificial Sequence: Synthetic coding sequence
atgagcctgtactgcggcatcgcctgcaggaggaagttcttctggtgctaccgcctgctgagcacctacgtgaccaagacccgctacctgtttgagctgaaggaggatgatgatgcctgcaagaaggcccagcagacaggagccttctacctgttccacagcctggcccccctgctgcagaccagcgcccaccagtacctggcccccaggcacagcctgctggagctggagcggctgctgggcaagtttggccaggatgcccagagaattgaagattctgtgctgattggctgcagcgagcagcaggaggcctggtttgccctggacctgggcctggacagcagcttcagcatcagcgccagcctgcacaagccagagatggagacagagctgaagggcagcttcatcgagctgaggaaggccctcttccagctgaatgccagagatgccagcctgctgagcacagcccaggccctgctgcgctggcatgatgcccaccagttctgcagccgcagcggccagcccaccaagaagaatgtggccggcagcaagagggtgtgccccagcaacaacatcatctactacccccaggtgaaggtgtggaagaggccttctgctgagaagctgcagaagcgctgggactggcgctggaaggcctgcagcaccatgcaccccagcatcggccccagcctggtggcccacagctag

SEQ ID NO: 20955 - DNA, 468 bp, Artificial Sequence
  Description of Artificial Sequence: Synthetic coding sequence
atggcccctgtggccatcaccctggtgtctgatggcacccgctgcctgctggcccggcagagcagcttccccaagggcatgtacagcgccctggccggcttctgtgacattggagagagcgtggaggagaccatccggcgggaggtggccgaggaggtgggcctggaggtggagagcctgcagtactatgccagccagcactggcccttccccagcggcagcctgatgattgcctgccacgccaccgtgaagccaggccagacagagatccaggtgaacctgcgggagctggagacagctgcctggttcagccatgatgaggtggccacagccctgaagaggaagggcccctacacccagcagcagaatggcaccttccccttctggctgccccccaagctggccatcagccaccagctgatcaaggagtgggtggagaagcagacctgcagcagcctgcctgcctag

SEQ ID NO: 20956 - DNA, 681 bp, Artificial Sequence
  Description of Artificial Sequence: Synthetic coding sequence
atggagacagagctgaagggcagcttcatcgagctgaggaaggccctcttccagctgaatgccagagatgccagcctgctgagcacagcccaggccctgctgcgctggcatgatgcccaccagttctgcagccgcagcggccagcccaccaagaagaatgtggccggcagcaagagggtgtgccccagcaacaacatcatctactacccccagatggcccctgtggccatcaccctggtgtctgatggcacccgctgcctgctggcccggcagagcagcttccccaagggcatgtacagcgccctggccggcttctgtgacatcggggagagcgtggaggagaccatcagaagagaggtggccgaggaggtgggcctggaggtggagagcctgcagtactatgccagccagcactggcccttccccagcggcagcctgatgattgcctgccacgccaccgtgaagccaggccagacagagatccaggtgaacctgcgggagctggagacagctgcctggttcagccatgatgaggtggccacagccctgaagaggaagggcccctacacccagcagcagaatggcaccttccccttctggctgccccccaagctggccatcagccaccagctgatcaaggagtgggtggagaagcagacctgcagcagcctgcctgcctag

SEQ ID NO: 20957 - DNA, 717 bp, Artificial Sequence
  Description of Artificial Sequence: Synthetic coding sequence
atgctgggccagcctgcccccctggagagatttgccagccggcggccccaggtgctggccgtgaggacagtgtgtgacctggtgctgggcaagatggacaaggactgtgagatgaagaggaccaccctggacagccccctgggcaagctggagctgagcggctgtgagcagggcctgcacgagatcaagctgctgggcaagggcaccagcgctgctgatgctgtggaggtgcctgccccagctgctgtgctgggcggccctgagcccctgatgcagtgcacagcctggctgaatgcctacttccaccagcctgaggccatcgaggagttccctgtgcctgccctgcaccaccctgtgttccagcaggagagcttcacccggcaggtgctgtggaagctgctgaaggtggtgaagtttggagaggtgatctcctaccagcagctggccgccctggccggcaaccccaaggccgcccgggctgtgggcggggccatgaggggcaaccctgtgcccatcctgatcccctgccaccgggtggtgtgcagcagtggagctgtgggcaactacagcggcggcctggccgtgaaggagtggctgctggcccacgagggccaccggctgggcaagccaggcctgggcggcagcagcggcctggccggggcctggctgaagggggccggggccaccagcggcagccccccagctggaagaaattag

SEQ ID NO: 20958 - DNA, 1569 bp, Artificial Sequence
  Description of Artificial Sequence: Synthetic coding sequence
atgagcagccggcccctggagagccccccaccctacagaccagatgagttcaagcccaaccactacgcccccagcaatgacatctatggaggagagatgcacgtgcggcccatgctgagccagcctgcctacagcttctacccagaagatgagatcctgcacttctacaagtggaccagccccccaggagtcatccgcatcctgtccatgctgatcatcgtgatgtgcatcgccatctttgcctgtgtggccagcaccctggcctgggaccggggctacggcaccagcctgctgggcggctctgtgggctacccctacggcggcagcggcttcggcagctatggcagcggctacggctacggctacggctacggctacggctacggcggctacacagacccccgggccgccaagggcttcatgctggccatggccgccttctgcttcatcgccgccctggtgatctttgtgaccagcgtcatccgctctgagatgagcaggacccggcgctactacctgagcgtcatcatcgtgtctgccatcctgggcatcatggtgttcatcgccaccatcgtgtacatcatgggcgtgaaccccacagcccagagcagcggcagcctgtatggcagccagatctatgccctgtgcaaccagttctacaccccagctgccaccggcctgtatgtggaccagtacctgtaccactactgtgtggtggacccccaggaggccatcgccatcgtgctgggcttcatgatcatcgtggcctttgccctgatcatcttctttgctgtgaagaccaggaggaagatggacagatatgacaagagcaacatcctgtgggacaaggagcacatctatgatgagcagcccccaaatgtggaggagtgggtgaagaatgtgtctgctggcacccaggatgtgcccagccccccaagtgactatgtggagcgggtggacagccccatggcctacagcagcaatggcaaggtgaatgacaagcgcttctacccagagagcagctacaagagcacccctgtgcctgaggtggtgcaggagctgcccctgaccagccctgtggatgacttccggcagccccgctacagcagcggcggcaactttgagacccccagcaagagggccccagccaagggccgggccggccgcagcaagaggacagagcaggaccactatgaaacagactacaccaccggcggggagagctgtgatgagctggaggaggactggatccgggagtacccacccatcaccagtgaccagcagaggcagctgtacaagaggaactttgacaccggcctgcaggagtacaagagcctgcagagcgagctggatgagatcaacaaggagctgagccggctggacaaggagctggatgactaccgggaggagagcgaggagtacatggctgctgctgatgagtacaaccggctgaagcaggtgaagggcagcgctgactacaagagcaagaagaaccactgcaagcagctgaagagcaagctgagccacatcaagaagatggtgggggactatgaccggcagaagacctag

SEQ ID NO: 20959 - DNA, 1407 bp, Artificial Sequence
  Description of Artificial Sequence: Synthetic coding sequence
atgagcagccggcccctggagagccccccaccctacagaccagatgagttcaagcccaaccactacgcccccagcaatgacatctatggaggagagatgcacgtgcggcccatgctgagccagcctgcctacagcttctacccagaagatgagatcctgcacttctacaagtggaccagccccccaggagtcatccgcatcctgtccatgctgatcatcgtgatgtgcatcgccatctttgcctgtgtggccagcaccctggcctgggaccggggctacggcaccagcctgctgggcggctctgtgggctacccctacggcggcagcggcttcggcagctatggcagcggctacggctacggctacggctacggctacggctacggcggctacacagacccccgggccgccaagggcttcatgctggccatggccgccttctgcttcatcgccgccctggtgatctttgtgaccagcgtcatccgctctgagatgagcaggacccggcgctactacctgagcgtcatcatcgtgtctgccatcctgggcatcatggtgttcatcgccaccatcgtgtacatcatgggcgtgaaccccacagcccagagcagcggcagcctgtatggcagccagatctatgccctgtgcaaccagttctacaccccagctgccaccggcctgtatgtggaccagtacctgtaccactactgtgtggtggacccccaggaggtgaagaatgtgtctgctggcacccaggatgtgcccagccccccaagtgactatgtggagcgggtggacagccccatggcctacagcagcaatggcaaggtgaatgacaagcgcttctacccagagagcagctacaagagcacccctgtgcctgaggtggtgcaggagctgcccctgaccagccctgtggatgacttccggcagccccgctacagcagcggcggcaactttgagacccccagcaagagggccccagccaagggccgggccggccgcagcaagaggacagagcaggaccactatgaaacagactacaccaccggcggggagagctgtgatgagctggaggaggactggatccgggagtacccacccatcaccagtgaccagcagaggcagctgtacaagaggaactttgacaccggcctgcaggagtacaagagcctgcagagcgagctggatgagatcaacaaggagctgagccggctggacaaggagctggatgactaccgggaggagagcgaggagtacatggctgctgctgatgagtacaaccggctgaagcaggtgaagggcagcgctgactacaagagcaagaagaaccactgcaagcagctgaagagcaagctgagccacatcaagaagatggtgggggactatgaccggcagaagacctag

SEQ ID NO: 20960 - DNA, 1569 bp, Artificial Sequence; identical to SEQ ID NO: 20958
  Description of Artificial Sequence: Synthetic coding sequence

SEQ ID NO: 20961 - DNA, 816 bp, Artificial Sequence
  Description of Artificial Sequence: Synthetic coding sequence
atgatcatcgtggcctttgccctgatcatcttctttgctgtgaagaccaggaggaagatggacagatatgacaagagcaacatcctgtgggacaaggagcacatctatgatgagcagccccccaacgtggaggagtgggtgaagaatgtgtctgctggcacccaggatgtgcccagcccccccagcgactatgtggagcgggtggacagccccatggcctacagcagcaatggcaaggtgaatgacaagcgcttctacccagagagcagctacaagagcacccctgtgcctgaggtggtgcaggagctgcccctgaccagccctgtggatgacttccggcagccccgctacagcagcggcggcaactttgagacccccagcaagagggccccagccaagggccgggccggccgcagcaagaggacagagcaggaccactatgaaacagactacaccactggaggagagagctgtgatgagctggaggaggactggatccgggagtacccacccatcaccagtgaccagcagaggcagctgtacaagaggaactttgacaccggcctgcaggagtacaagagcctgcagagcgagctggatgagatcaacaaggagctgagccggctggacaaggagctggatgactaccgggaggagagcgaggagtacatggctgctgctgatgagtacaaccggctgaagcaggtgaagggcagcgctgactacaagagcaagaagaaccactgcaagcagctgaagagcaagctgagccacatcaagaagatggtgggggactatgaccggcagaagacctag

SEQ ID NO: 20962 - DNA, 603 bp, Artificial Sequence
  Description of Artificial Sequence: Synthetic coding sequence
atggcctacagcagcaatggcaaggtgaatgacaagcgcttctacccagagagcagctacaagagcacccctgtgcctgaggtggtgcaggagctgcccctgaccagccctgtggatgacttccggcagccccgctacagcagcggcggcaactttgagacccccagcaagagggccccagccaagggccgggccggccgcagcaagaggacagagcaggaccactatgaaacagactacaccaccggcggggagagctgtgatgagctggaggaggactggatccgggagtacccacccatcaccagtgaccagcagaggcagctgtacaagaggaactttgacaccggcctgcaggagtacaagagcctgcagagcgagctggatgagatcaacaaggagctgagccggctggacaaggagctggatgactaccgggaggagagcgaggagtacatggctgctgctgatgagtacaaccggctgaagcaggtgaagggcagcgctgactacaagagcaagaagaaccactgcaagcagctgaagagcaagctgagccacatcaagaagatggtgggggactatgaccggcagaagacctag

SEQ ID NO: 20963 - DNA, 3114 bp, Artificial Sequence
  Description of Artificial Sequence: Synthetic coding sequence
atgtggaggtgtggcggccggcagggcctgtgtgtgctgcggcggctgagcggcggccacgcccaccaccgggcctggcgctggaacagcaacagagcctgtgagcgggccctgcagtacaagctgggggacaagatccacggcttcaccgtgaaccaggtgacctctgtgcctgagctgttcctgacagctgtgaagctgacccatgatgacaccggggcccgctacctgcacctggcccgggaggacaccaacaacctcttctctgtgcagttccgcaccacccccatggacagcactggagtgccccacatcctggagcacacagtgctgtgtggcagccagaagtacccctgccgggaccccttcttcaagatgctgaacagaagcctgagcaccttcatgaatgccttcaccgccagtgactacaccctgtaccccttcagcacccagaaccccaaggacttccagaacctgctgtctgtgtacctggatgccaccttcttcccctgcctgcgggagctggacttctggcaggagggctggaggctggagcacgagaaccccagcgacccccagacccccctggtgttcaagggcgtggtgttcaatgagatgaagggggcctttgtgaacaatgaaagaatcttcagccagcacctgcagaaccggctgctgcctgaccacacctacagcgtggtgtctggaggagaccccctgtgcatccctgagctgacctgggagcagctgaagcagttccacgccacccactaccaccccagcaatgcccgcttcttcacctacggcaacttccccctggagcagcacctgaagcagatccacgaggaggccctgagcaagttccagaagattgagcccagcacagtggtgcctgcccagaccccctgggacaagccccgggagttccagatcacctgtggccctgacagctttgccacagaccccagcaagcagaccaccatctctgtgtccttcctgctgcctgacatcacagacacctttgaggccttcaccctgagcctgctgagcagcctgctgaccagcggccccaacagccccttctacaaggccctgattgagagcggcctgggcacagacttctccccagatgtgggctacaacggctacacccgggaggcctacttctctgtgggcctgcagggcattgctgagaaggacattgaaacagtgcgcagcctgattgacaggaccattgatgaggtggtggagaagggctttgaagatgacagaattgaggccctgctgcacaagattgagatccagatgaagcaccagagcaccagctttggcctgatgctgaccagctacatcgccagctgctggaaccatgatggagaccctgtggagctgctgaagctgggcaaccagctggccaagttccggcagtgcctgcaggagaaccccaagttcctgcaggagaaggtgaagcagtacttcaagaacaaccagcacaagctgaccctgtccatgaggccagatgacaagtaccacgagaagcaggcccaggtggaggccaccaagctgaagcagaaggtggaggccctgagccctggggaccggcagcagatctatgagaagggcctggagctgcggagccagcagagcaagccccaggatgccagctgcctgcctgccctgaaggtgtctgacatcgagcccaccatccctgtgacagagctggatgtggtgctgacagctggggacatccctgtgcagtactgtgcccagcccaccaacggcatggtgtacttccgggccttcagcagcctgaacaccctgcctgaggagctgcggccctacgtgcccctcttctgcagcgtgctgaccaagctgggctgcggcctgctggactaccgggagcaggcccagcagatcgagctgaagacaggaggcatgtctgccagcccccacgtgctgcctgatgacagccacatggacacctatgagcagggcgtgctcttcagcagcctgtgcctggacaggaacctgcctgacatgatgcagctgtggagcgagatcttcaacaacccctgctttgaggaggaggagcacttcaaggtgctggtgaagatgacagcccaggagctggccaacggcatcccagattctggccacctgtatgccagcatccgggccggccgcaccctgaccccagctggggacctgcaggagaccttcagcggcatggaccaggtgcggctgatgaagagaattgctgagatgacagacatcaagcccatcctgaggaagctgccccgcatcaagaagcacctgctgaatggagacaacatgcgctgcagcgtgaatgccaccccccagcagatgccccagacagagaaggctgtggaggacttcctgcggagcatcggccgcagcaagaaggagcggcggcctgtgcggccccacacagtggagaagcctgtgcccagcagcagtggaggagatgcccacgtgccccacggcagccaggtgatcaggaagctggtgatggagcccaccttcaagccctggcagatgaagacccacttcctgatgcccttccctgtgaactacgtgggggagtgcatcagaacagtgccctacacagatcctgaccacgccagcctgaagatcctggcccggctgatgacagccaagttcctgcacacagagatccgggagaagggcggggcctacggcggcggggccaagctgagccacaacggcatcttcaccctgtacagctacagagaccccaacaccatcgagaccctgcagagctttgggaaggctgtggactgggccaagagcggcaagttcacccagcaggacattgatgaggccaagctgagcgtcttcagcacagtggatgcccctgtggcccccagcgacaagggcatggaccacttcctgtatggcctgagtgatgagatgaagcaggcccaccgggagcagctgtttgctgtgtcccatgacaagctgctggccgtgtctgaccgctacctgggcaccgggaagagcacccacggcctggccatcctgggccctgagaaccccaagatcgccaaggaccccagctggatcatccagtag

SEQ ID NO: 20964 - DNA, 1107 bp, Artificial Sequence
  Description of Artificial Sequence: Synthetic coding sequence
atgcagcccggcagcagccgctgtgaggaggagacccccagcctgctgtggggcctggaccctgtgttcctggcctttgccaagctgtacatccgggacatcctggacatgaaggagagccggcaggtgcctggggtcttcctgtacaacggccaccccatcaagcaggtggatgtgctgggcaccgtcatcggcgtgcgggagagagatgccttctacagctatggagtggatgacagcactggagtcatcaactgcatctgctggaagaagctgaacacagagagcgtgtctgctgcccccagcgctgcccgggagctgagcctgaccagccagctgaagaagctgcaggagaccatcgagcagaagaccaagattgagatcggggacaccatccgggtgcggggcagcatccgcacctaccgggaggagcgggagatccacgccaccacctactacaaggtggatgatcctgtgtggaacatccagatcgccaggatgctggagctgcccaccatctacaggaaggtgtatgaccagcccttccacagcagcgccctggagaaggaggaggccctgagcaaccctggggccctggacctgcccagcctgaccagcctgctgtctgagaaggccaaggagttcctgatggagaacagagtgcagagcttctaccagcaggagctggagatggtggagagcctgctgagcctggccaaccagcccgtcatccacagcgccagcagtgaccaggtgaacttcaagaaggacaccaccagcaaggccatccacagcatcttcaagaatgccatccagctgctgcaggagaagggcctggtgttccagaaggatgatggctttgacaacctgtactacgtgacccgggaggacaaggacctgcacaggaagatccaccgcatcatccagcaggactgccagaagcccaaccacatggagaagggctgccacttcctgcacatcctggcctgtgcccggctgagcatccggcccggcctgtctgaggccgtgctgcagcaggtgctggagctgctggaggaccagagcgacatcgtgtccaccatggagcactactacacagccttctag

SEQ ID NO: 20965 - DNA, 1038 bp, Artificial Sequence
  Description of Artificial Sequence: Synthetic coding sequence
atgggcgtgtgtggctacctgttcctgccctggaagtgcctggtggtggtgtccctgcggctgctcttcctggtgcccactggagtgcctgtgcgctctggagatgccaccttccccaaggccatggacaacgtgacagtgcggcagggcgagagcgccaccctgcgctgcaccattgatgacagagtgaccagggtggcctggctgaacagaagcaccatcctgtatgctggaaatgacaagtggagcattgaccccagggtcatcatcctggtgaacacccccacccagtacagcatcatgatccagaatgtggatgtgtatgatgagggcccctacacctgcagcgtgcagacagacaaccaccccaagaccagccgggtgcacctgattgtgcaggtgcccccccagatcatgaacatcagcagtgacatcaccgtgaatgaaggcagctctgtgaccctgctgtgcctggccatcggccggcctgagcccaccgtgacctggaggcacctgtctgtgaaggagggccagggctttgtgtctgaagatgagtacctggagatcagtgacatcaagagggaccagagcggggagtatgaatgttctgccctgaatgatgtggccgccccagatgtgaggaaggtgaagatcaccgtgaactacccaccctacatcagcaaggccaagaacacaggagtgtctgtgggccagaagggcatcctgagctgtgaggccagcgctgtgcccatggccgagttccagtggttcaaggaggagacccggctggccaccggcctggatggcatgagaattgaaaataaaggaaggatgagcaccctgaccttcttcaacgtgtctgagaaggactatggcaactacacctgtgtggccaccaacaagctgggcaacaccaatgccagcatcaccctgtatggccctggagctgtgattgatggagtgaacagcgccagccgggccctggcctgcctgtggctgagcggcaccctgctggcccacttcttcatcaagttctag

SEQ ID NO: 20966 - DNA, 939 bp, Artificial Sequence
  Description of Artificial Sequence: Synthetic coding sequence
atgtaccacccagcctactgggtggtgttttctgccaccacagccctgctcttcatccctggggtgcctgtgcgctctggagatgccaccttccccaaggccatggacaacgtgacagtgcggcagggcgagagcgccaccctgcgctgcaccattgatgacagagtgaccagggtggcctggctgaacagaagcaccatcatgatccagaatgtggatgtgtatgatgagggcccctacacctgcagcgtgcagacagacaaccaccccaagaccagccgggtgcacctgattgtgcaggtgcccccccagatcatgaacatcagcagtgacatcaccgtgaatgaaggcagctctgtgaccctgctgtgcctggccatcggccggcctgagcccaccgtgacctggaggcacctgtctgtgaaggagggccagggctttgtgtctgaagatgagtacctggagatcagtgacatcaagagggaccagagcggggagtatgagtgcagcgccctgaatgatgtggccgccccagatgtgaggaaggtgaagatcaccgtgaactacccaccctacatcagcaaggccaagaacacaggagtgtctgtgggccagaagggcatcctgagctgtgaggccagcgctgtgcccatggccgagttccagtggttcaaggaggagacccggctggccaccggcctggatggcatgagaattgagaacaagggccgcatgagcaccctgaccttcttcaacgtgtctgagaaggactatggcaactacacctgtgtggccaccaacaagctgggcaacaccaatgccagcatcaccctgtatggccctggagctgtgattgatggagtgaacagcgccagccgggccctggcctgcctgtggctgagcggcaccctgctggcccacttcttcatcaagttctag

SEQ ID NO: 20967 - DNA, 1017 bp, Artificial Sequence
  Description of Artificial Sequence: Synthetic coding sequence
atgtaccacccagcctactgggtggtgttttctgccaccacagccctgctcttcatccctggggtgcctgtgcgctctggagatgccaccttccccaaggccatggacaacgtgacagtgcggcagggcgagagcgccaccctgcgctgcaccattgatgacagagtgaccagggtggcctggctgaacagaagcaccatcctgtatgctggaaatgacaagtggagcattgaccccagggtcatcatcctggtgaacacccccacccagtacagcatcatgatccagaatgtggatgtgtatgatgagggcccctacacctgcagcgtgcagacagacaaccaccccaagaccagccgggtgcacctgattgtgcaggtgcccccccagatcatgaacatcagcagtgacatcaccgtgaatgaaggcagctctgtgaccctgctgtgcctggccatcggccggcctgagcccaccgtgacctggaggcacctgtctgtgaaggagggccagggctttgtgtctgaagatgagtacctggagatcagtgacatcaagagggaccagagcggggagtatgagtgcagcgccctgaatgatgtggccgccccagatgtgaggaaggtgaagatcaccgtgaactacccaccctacatcagcaaggccaagaacacaggagtgtctgtgggccagaagggcatcctgagctgtgaggccagcgctgtgcccatggccgagttccagtggttcaaggaggagacccggctggccaccggcctggatggcatgagaattgagaacaagggccgcatgagcaccctgaccttcttcaacgtgtctgagaaggactatggcaactacacctgtgtggccaccaacaagctgggcaacaccaatgccagcatcaccctgtatggccctggagctgtgattgatggagtgaacagcgccagccgggccctggcctgcctgtggctgagcggcaccctgctggcccacttcttcatcaagttctag

SEQ ID NO: 20968 - DNA, 1065 bp, Artificial Sequence
  Description of Artificial Sequence: Synthetic coding sequence
atgggcgtgtgtggctacctgttcctgccctggaagtgcctggtggtggtgtccctgcggctgctcttcctggtgcccactggagtgcctgtgcgctctggagatgccaccttccccaaggccatggacaacgtgacagtgcggcagggcgagagcgccaccctgcgctgcaccattgatgacagagtgaccagggtggcctggctgaacagaagcaccatcctgtatgctggaaatgacaagtggagcattgaccccagggtcatcatcctggtgaacacccccacccagtacagcatcatgatccagaatgtggatgtgtatgatgagggcccctacacctgcagcgtgcagacagacaaccaccccaagaccagccgggtgcacctgattgtgcaggtgcccccccagatcatgaacatcagcagtgacatcaccgtgaatgaaggcagctctgtgaccctgctgtgcctggccatcggccggcctgagcccaccgtgacctggaggcacctgtctgtgaaggagggccagggctttgtgtctgaagatgagtacctggagatcagtgacatcaagagggaccagagcggggagtatgaatgttctgccctgaatgatgtggccgccccagatgtgaggaaggtgaagatcaccgtgaactacccaccctacatcagcaaggccaagaacacaggagtgtctgtgggccagaagggcatcctgagctgtgaggccagcgctgtgcccatggccgagttccagtggttcaaggaggagacccggctggccaccggcctggatggcatgagaattgaaaataaaggaaggatgagcaccctgaccttcttcaacgtgtctgagaaggactatggcaactacacctgtgtggccaccaacaagctgggcaacaccaatgccagcatcaccctgtatgagatcagccccagcagcgctgtggccggccctggagctgtgattgatggagtgaacagcgccagccgggccctggcctgcctgtggctgagcggcaccctgctggcccacttcttcatcaagttctag

SEQ ID NO: 20969 - DNA, 1662 bp, Artificial Sequence
  Description of Artificial Sequence: Synthetic coding sequence
atgagcaacaacggcctggacatccaggacaagcccccagccccacccatgaggaacaccagcaccatgattggagctggcagcaaggatgctggcaccctgaaccacggcagcaagcccctgccccccaaccctgaggagaagaagaagaaggaccgcttctaccgcagcatcctgcccggggacaagaccaacaagaagaaggagaaggagaggcctgagatcagcctgcccagcgactttgagcacaccatccacgtgggctttgatgctgtgactggagagttcaccggcatgcctgagcagtgggcccggctgctgcagaccagcaacatcaccaagtctgagcagaagaagaacccccaggccgtgctggatgtgctggagttctacaacagcaagaagaccagcaacagccagaagtacatgtccttcacagacaagtctgctgaggactacaacagcagcaatgccctgaatgtgaaggctgtgtctgagaccccagctgtgccccctgtgtctgaagatgaagatgatgatgatgatgatgccaccccacctcctgtgattgcccccaggcctgagcacaccaagtctgtgtacaccaggagcgtcatcgagcccctgcctgtgacccccaccagagatgtggccaccagccccatcagccccacagagaacaacaccaccccaccagatgccctgaccaggaacacagagaagcagaagaagaagcccaagatgtctgatgaggagatcctggagaagctgcggagcatcgtgtctgtgggggaccccaagaagaagtacaccaggtttgagaagattggccagggcgccagcggcaccgtgtacacagccatggatgtggccaccggccaggaggtggccatcaagcagatgaacctgcagcagcagcccaagaaggagctgatcatcaatgagatcctggtgatgagggagaacaagaaccccaacatcgtgaactacctggacagctacctggtgggagatgagctgtgggtggtgatggagtacctggccggcggcagcctgacagatgtggtgacagagacctgcatggatgagggccagattgctgctgtgtgccgggagtgcctgcaggccctggagttcctgcacagcaaccaggtgatccaccgggacatcaagagtgacaacatcctgctgggcatggatggctctgtgaagctgacagactttggcttctgtgcccagatcaccccagagcagagcaagaggagcaccatggtgggcaccccctactggatggcccctgaggtggtgaccaggaaggcctacggccccaaggtggacatctggagcctgggcatcatggccatcgagatgattgaaggagagcccccctacctgaatgaaaaccccctgcgggccctgtacctgattgccaccaacggcaccccagagctgcagaaccctgagaagctgagcgccatcttccgggacttcctgaaccgctgcctggagatggatgtggagaagaggggcagcgccaaggagctgctgcaggtgaggaagctgcgcttccaggtgttcagcaacttctccatgattgctgccagcatccctgaggactgccaggcccccctgcagccccacagcacagactgctgcagctag

SEQ ID NO: 20970 - DNA, 1638 bp, Artificial Sequence
  Description of Artificial Sequence: Synthetic coding sequence
atgagcaacaacggcctggacatccaggacaagcccccagccccacccatgaggaacaccagcaccatgattggagctggcagcaaggatgctggcaccctgaaccacggcagcaagcccctgccccccaaccctgaggagaagaagaagaaggaccgcttctaccgcagcatcctgcccggggacaagaccaacaagaagaaggagaaggagaggcctgagatcagcctgcccagcgactttgagcacaccatccacgtgggctttgatgctgtgactggagagttcaccggcatgcctgagcagtgggcccggctgctgcagaccagcaacatcaccaagtctgagcagaagaagaacccccaggccgtgctggatgtgctggagttctacaacagcaagaagaccagcaacagccagaagtacatgtccttcacagacaagtctgctgaggactacaacagcagcaatgccctgaatgtgaaggctgtgtctgagaccccagctgtgccccctgtgtctgaagatgaagatgatgatgatgatgatgccaccccacctcctgtgattgcccccaggcctgagcacaccaagtctgtgtacaccaggagcgtcatcgagcccctgcctgtgacccccaccagagatgtggccaccagccccatcagccccacagagaacaacaccaccccaccagatgccctgaccaggaacacagagaagcagaagaagaagcccaagatgtctgatgaggagatcctggagaagctgcggagcatcgtgtctgtgggggaccccaagaagaagtacaccaggtttgagaagattggccagggcgccagcggcaccgtgtacacagccatggatgtggccaccggccaggaggtggccatcaagcagatgaacctgcagcagcagcccaagaaggagctgatcatcaatgagatcctggtgatgagggagaacaagaaccccaacatcgtgaactacctggacagctacctggtgggagatgagctgtgggtggtgatggagtacctggccggcggcagcctgacagatgtggtgacagagacctgcatggatgagggccagattgctgctgtgtgccgggagtgcctgcaggccctggagttcctgcacagcaaccaggtgatccaccgggacatcaagagtgacaacatcctgctgggcatggatggctctgtgaagctgacagactttggcttctgtgcccagatcaccccagagcagagcaagaggagcaccatggtgggcaccccctactggatggcccctgaggtggtgaccaggaaggcctacggccccaaggtggacatctggagcctgggcatcatggccatcgagatgattgaaggagagcccccctacctgaatgaaaaccccctgcgggccctgtacctgattgccaccaacggcaccccagagctgcagaaccctgagaagctgagcgccatcttccgggacttcctgaaccgctgcctggagatggatgtggagaagaggggcagcgccaaggagctgctgcagcaccagttcctgaagatcgccaagcccctgagcagcctgacccccctgattgctgctgccaaggaggccaccaagaacaaccactag

SEQ ID NO: 20971 - DNA, 300 bp, Artificial Sequence
  Description of Artificial Sequence: Synthetic coding sequence
atgagcaacaacggcctggacatccaggacaagcccccagccccacccatgaggaacaccagcaccatgattggagctggcagcaaggatgctggcaccctgaaccacggcagcaagcccctgccccccaaccctgaggagaagaagaagaaggaccgcttctaccgcagcatcctgcccggggacaagaccaacaagaagaaggagaaggagaggcctgagatcagcctgcccagcgactttgagcacaccatccacgtgggctttgatgctgtgactggagagttcaccggcatgtag

SEQ ID NO: 20972 - DNA, 81 bp, Artificial Sequence
  Description of Artificial Sequence: Synthetic coding sequence
atgagcaacaacggcctggacatccaggacaagcccccagccccacccatgaggaacaccagcaccatgattggagcctag

SEQ ID NO: 20973 - DNA, 270 bp, Artificial Sequence
  Description of Artificial Sequence: Synthetic coding sequence
atgagcaacaacggcctggacatccaggacaagcccccagccccacccatgaggaacaccagcaccatgattggagctggcagcaaggatgctggcaccctgaaccacggcagcaagcccctgccccccaaccctgaggagaagaagaagaaggaccgcttctaccgcagcatcctgcccggggacaagaccaacaagaagaaggagaaggagaggcctgagatcagcctgcccagcgactttgagcacaccatccacgtgggcttctag

SEQ ID NO: 20974 - DNA, 192 bp, Artificial Sequence
  Description of Artificial Sequence: Synthetic coding sequence
atgagcaacaacggcctggacatccaggacaagcccccagccccacccatgaggaacaccagcaccatgattggagctggcagcaaggatgctggcaccctgaaccacggcagcaagcccctgccccccaaccctgaggagaagaagaagaaggaccgcttctaccgcagcatcctgcccggggacaagtag

SEQ ID NO: 20975 - DNA, 321 bp, Artificial Sequence
  Description of Artificial Sequence: Synthetic coding sequence
atgagcaacaacggcctggacatccaggacaagcccccagccccacccatgaggaacaccagcaccatgattggagctggcagcaaggatgctggcaccctgaaccacggcagcaagcccctgccccccaaccctgaggagaagaagaagaaggaccgcttctaccgcagcatcctgcccggggacaagaccaacaagaagaaggagaaggagaggcctgagatcagcctgcccagcgactttgagcacaccatccacgtgggctttgatgctgtgactggagagttcaccggcatgcctgagcagtgggcccggctgtag

SEQ ID NO: 20976 - DNA, 1569 bp, Artificial Sequence
  Description of Artificial Sequence: Synthetic coding sequence
atgagcaacaacggcctggacatccaggacaagcccccagccccacccatgaggaacaccagcaccatgattggagctggcagcaaggatgctggcaccctgaaccacggcagcaagcccctgccccccaaccctgaggagaagaagaagaaggaccgcttctaccgcagcatcctgcccggggacaagaccaacaagaagaaggagaaggagaggcctgagatcagcctgcccagcgactttgagcacaccatccacgtgggctttgatgctgtgactggagagttcaccggcatgcctgagcagtgggcccggctgctgcagaccagcaacatcaccaagtctgagcagaagaagaacccccaggccgtgctggatgtgctggagttctacaacagcaagaagaccagcaacagccagaagtacatgtccttcacagacaagtctgctgaggactacaacagcagcaatgccctgaatgtgaaggctgtgtctgagaccccagctgtgccccctgtgtctgaagatgaagatgatgatgatgatgatgccaccccacctcctgtgattgcccccaggcctgagcacaccaagtctgtgtacaccaggagcgtcatcgagcccctgcctgtgacccccaccagagatgtggccaccagccccatcagccccacagagaacaacaccaccccaccagatgccctgaccaggaacacagagaagcagaagaagaagcccaagatgtctgatgaggagatcctggagaagctgcggagcatcgtgtctgtgggggaccccaagaagaagtacaccaggtttgagaagattggccagggcgccagcggcaccgtgtacacagccatggatgtggccaccggccaggaggtggccatcaagcagatgaacctgcagcagcagcccaagaaggagctgatcatcaatgagatcctggtgatgagggagaacaagaaccccaacatcgtgaactacctggacagctacctggtgggagatgagctgtgggtggtgatggagtacctggccggcggcagcctgacagatgtggtgacagagacctgcatggatgagggccagattgctgctgtgtgccgggagtgcctgcaggccctggagttcctgcacagcaaccaggtgatccaccgggacatcaagagtgacaacatcctgctgggcatggatggctctgtgaagctgacagactttggcttctgtgcccagatcaccccagagcagagcaagaggagcaccatggtgggcaccccctactggatggcccctgaggtggtgaccaggaaggcctacggccccaaggtggacatctggagcctgggcatcatggccatcgagatgattgaaggagagcccccctacctgaatgaaaaccccctgcgggccctgtacctgattgccaccaacggcaccccagagctgcagaaccctgagaagctgagcgccatcttccgggacttcctgaaccgctgcctggagatggatgtggagaagaggggcagcgccaaggagctgctgcagcacagcagccggctgtag

SEQ ID NO: 20977 - DNA, 1317 bp, Artificial Sequence
  Description of Artificial Sequence: Synthetic coding sequence
atgtttgggaagaggaagaagagggtggagatcagcgcccccagcaactttgagcaccgggtgcacactggatttgaccagcacgagcagaagttcaccggcctgccccggcagtggcagagcctgattgaggagagcgcccggcggcccaagcccctggtggaccctgcctgcatcaccagcatccagcccggggcccccaagggggagccccatgatgtggccccaaatggccccagcgctgggggcctggccatcccccagagcagcagcagcagcagccggccccccacccgggcccggggggcccccagccctggggtgctgggcccccacgccagcgagccccagctggcccccccagcctgcaccccagctgccccagctgtgcccggccccccaggccccaggagcccccagcgggagccccagagggtgtcccatgagcagttccgggccgccctgcagctggtggtggaccccggggaccccaggagctacctggacaacttcatcaagatcggggagggcagcactggaattgtgtgcatcgccaccgtgcgcagcagcggcaagctggtggccgtgaagaagatggacctgaggaagcagcagaggcgggagctgctcttcaatgaggtggtgatcatgagggactaccagcatgaaaatgtggtggagatgtacaacagctacctggtgggagatgagctgtgggtggtgatggagttcctggagggcggggccctgacagacatcgtgacccacaccaggatgaatgaggagcagattgctgctgtgtgcctggccgtgctgcaggccctgtctgtgctgcacgcccagggcgtcatccaccgggacatcaagagtgacagcatcctgctgacccatgatggccgggtgaagctgagtgactttggcttctgtgcccaggtgtccaaggaggtgcccaggaggaagagcctggtgggcaccccctactggatggcccctgagctgatcagccggctgccctacggccctgaggtggacatctggagcctgggcatcatggtgattgagatggtggatggagagcccccctacttcaatgagccccccctgaaggccatgaagatgatccgggacaacctgcccccccggctgaagaacctgcacaaggtgagccccagcctgaagggcttcctggaccggctgctggtgcgggaccctgcccagagggccacagctgctgagctgctgaagcaccccttcctggccaaggccggccccccagccagcatcgtgcccctgatgaggcagaacagaaccaggtag

SEQ ID NO: 20978 - DNA, 1776 bp, Artificial Sequence
  Description of Artificial Sequence: Synthetic coding sequence
atgtttgggaagaggaagaagagggtggagatcagcgcccccagcaactttgagcaccgggtgcacactggatttgaccagcacgagcagaagttcaccggcctgccccggcagtggcagagcctgattgaggagagcgcccggcggcccaagcccctggtggaccctgcctgcatcaccagcatccagcccggggcccccaagaccatcgtgcggggcagcaaaggagccaaggatggagccctgaccctgctgctggatgaatttgagaacatgtctgtgaccaggagcaacagcctgcggcgggacagccccccacctccagcccgggcccggcaggagaatggcatgcctgaggagcccgccaccacagcccggggcggccctgggaaggccggcagccggggccgctttgctggccacagcgaggccggcggcggcagcggggacagaagaagagctggccctgagaagaggcccaagagcagccgggagggcagcggcggcccccaggagagcagccgggacaagaggcccctgagcggcccagatgtgggcaccccccagcctgctggcctggccagcggggccaagctggccgccggccggcccttcaacacctaccccagggctgacacagaccaccccagcagaggagcccagggcgagccccatgatgtggcccccaacggccccagcgctgggggcctggccatcccccagagcagcagcagcagcagcaggcctcccacccgggcccggggggcccccagccctggggtgctgggcccccacgccagcgagccccagctggcccccccagcctgcaccccagctgccccagctgtgcccggccccccaggccccaggagcccccagcgggagccccagagggtgtcccatgagcagttccgggccgccctgcagctggtggtggaccccggggaccccaggagctacctggacaacttcatcaagattggagagggcagcacaggcatcgtgtgcatcgccaccgtgcgcagcagcggcaagctggtggccgtgaagaagatggacctgaggaagcagcagaggcgggagctgctcttcaatgaggtggtgatcatgagggactaccagcatgaaaatgtggtggagatgtacaacagctacctggtgggagatgagctgtgggtggtgatggagttcctggagggcggggccctgacagacatcgtgacccacaccaggatgaatgaggagcagattgctgctgtgtgcctggccgtgctgcaggccctgtctgtgctgcacgcccagggcgtcatccaccgggacatcaagagtgacagcatcctgctgacccatgatggccgggtgaagctgagtgactttggcttctgtgcccaggtgtccaaggaggtgcccaggaggaagagcctggtgggcaccccctactggatggcccctgagctgatcagccggctgccctacggccctgaggtggacatctggagcctgggcatcatggtgattgagatggtggatggagagcccccctacttcaatgaaccacccctgaaggccatgaagatgatccgggacaacctgcccccccggctgaagaacctgcacaaggtgagccccagcctgaagggcttcctggaccggctgctggtgcgggaccctgcccagagggccacagctgctgagctgctgaagcaccccttcctggccaaggccggccccccagccagcatcgtgcccctgatgaggcagaacagaacaagatag

SEQ ID NO: 20979 - DNA, 1188 bp, Artificial Sequence
  Description of Artificial Sequence: Synthetic coding sequence
atgggctgccagaggagccggcccttcaacacctaccccagggctgacacagaccaccccagcagaggagcccagggcgagccccatgatgtggcccccaacggccccagcgctgggggcctggccatcccccagagcagcagcagcagcagcaggcctcccacccgggcccggggggcccccagccctggggtgctgggcccccacgccagcgagccccagctggcccccccagcctgcaccccagctgccccagctgtgcccggccccccaggccccaggagcccccagcgggagccccagagggtgtcccatgagcagttccgggccgccctgcagctggtggtggaccccggggaccccaggagctacctggacaacttcatcaagattggagagggcagcacaggcatcgtgtgcatcgccaccgtgcgcagcagcggcaagctggtggccgtgaagaagatggacctgaggaagcagcagaggcgggagctgctcttcaatgaggtggtgatcatgagggactaccagcatgaaaatgtggtggagatgtacaacagctacctggtgggagatgagctgtgggtggtgatggagttcctggagggcggggccctgacagacatcgtgacccacaccaggatgaatgaggagcagattgctgctgtgtgcctggccgtgctgcaggccctgtctgtgctgcacgcccagggcgtcatccaccgggacatcaagagtgacagcatcctgctgacccatgatggccgggtgaagctgagtgactttggcttctgtgcccaggtgtccaaggaggtgcccaggaggaagagcctggtgggcaccccctactggatggcccctgagctgatcagccggctgccctacggccctgaggtggacatctggagcctgggcatcatggtgattgagatggtggatggagagcccccctacttcaatgaaccacccctgaaggccatgaagatgatccgggacaacctgcccccccggctgaagaacctgcacaaggtgagccccagcctgaagggcttcctggaccggctgctggtgcgggaccctgcccagagggccacagctgctgagctgctgaagcaccccttcctggccaaggccggccccccagccagcatcgtgcccctgatgaggcagaacagaacaagatag

SEQ ID NO: 20980 - DNA, 1776 bp, Artificial Sequence; identical to SEQ ID NO: 20978
  Description of Artificial Sequence: Synthetic coding sequence

SEQ ID NO: 20981 - DNA, 1776 bp, Artificial Sequence; identical to SEQ ID NO: 20978
  Description of Artificial Sequence: Synthetic coding sequence

SEQ ID NO: 20982 - DNA, 1044 bp, Artificial Sequence
  Description of Artificial Sequence: Synthetic coding sequence
atgacctggcccctgaccggccaccagagaggagcctggcccagccccagccccccacctcctcctcctggcctgcccccagagcctgaggtgcccccagccctggagtgctgggaccccaccccccagagccccaggagcccccagcgggagccccagagggtgtcccatgagcagttccgggccgccctgcagctggtggtggaccccggggaccccaggagctacctggacaacttcatcaagattggagagggcagcacaggcatcgtgtgcatcgccaccgtgcgcagcagcggcaagctggtggccgtgaagaagatggacctgaggaagcagcagaggcgggagctgctcttcaatgaggtggtgatcatgagggactaccagcatgaaaatgtggtggagatgtacaacagctacctggtgggagatgagctgtgggtggtgatggagttcctggagggcggggccctgacagacatcgtgacccacaccaggatgaatgaggagcagattgctgctgtgtgcctggccgtgctgcaggccctgtctgtgctgcacgcccagggcgtcatccaccgggacatcaagagtgacagcatcctgctgacccatgatggccgggtgaagctgagtgactttggcttctgtgcccaggtgtccaaggaggtgcccaggaggaagagcctggtgggcaccccctactggatggcccctgagctgatcagccggctgccctacggccctgaggtggacatctggagcctgggcatcatggtgattgagatggtggatggagagcccccctacttcaatgaaccacccctgaaggccatgaagatgatccgggacaacctgcccccccggctgaagaacctgcacaaggtgagccccagcctgaagggcttcctggaccggctgctggtgcgggaccctgcccagagggccacagctgctgagctgctgaagcaccccttcctggccaaggccggccccccagccagcatcgtgcccctgatgaggcagaacagaacaagatag

SEQ ID NO: 20983 - DNA, 1776 bp, Artificial Sequence; identical to SEQ ID NO: 20978
  Description of Artificial Sequence: Synthetic coding sequence

SEQ ID NO: 20984 - DNA, 1317 bp, Artificial Sequence; identical to SEQ ID NO: 20977
  Description of Artificial Sequence: Synthetic coding sequence

SEQ ID NO: 20985 - DNA, 1458 bp, Artificial Sequence
  Description of Artificial Sequence: Synthetic coding sequence
atggcccccaccatccagacccaggcccagcgggaggatggccacaggtctggagtggtgtgccgggtgaagtactgcaacagcctgcctgacatcccctttgaccccaagttcatcacctacccctttgaccagaacagatttgtgcagtacaaggccaccagcctggagaagcagcacaagcatgacctgctgacagagccagacctgggcgtgaccatcgacctgatcaacccagacacctacagaattgaccccaacgtgctgctggaccctgcagatgagaagctgctggaggaggagatccaggcccccaccagcagcaagaggagccagcagcacgccaaggtggtgccctggatgaggaagacagagtacatcagcacagagttcaacagatatggcatcagcaatgagaagccagaggtgaagattggagtgtctgtgaagcagcagttcacagaggaggagatctacaaggaccgggacagccagatcacagccatcgagaagacctttgaagatgcccagaagagcatcagccagcactacagcaagccccgggtgacccctgtggaggtgatgcctgtgtttcctgacttcaagatgtggatcaacccctgtgcccaggtgatctttgacagcgaccctgcccccaaggacaccagcggggccgccgccctggagatgatgagccaggccatgatccggggcatgatggatgaggagggcaaccagtttgtggcctacttcctgcctgtggaggagaccctgaagaagaggaagagggaccaggaggaggagatggactatgccccagatgatgtgtatgactacaagatcgcccgggagtacaactggaatgtgaagaacaaggccagcaagggctatgaggagaactacttcttcatcttccgggagggagatggagtgtactacaatgagctggagaccagggtgcggctgagcaagagaagagccaaggccggcgtgcagagcggcaccaatgccctgctggtggtgaagcaccgggacatgaatgagaaggagctggaggcccaggaggccaggaaggcccagctggagaaccacgagcctgaggaggaggaggaggaggagatggagacagaggagaaggaggccggcggctctgtgatgctgatcctgcggaccatgcccaccctgatgatgaggacagaggaccggcccaaggtggccgtgaccatgatccagacagctgctgccatgggcgtggccagcggggccggggccacagctgctgcccctgtgcccagccctgtggccgccagcacccggcccaggaggatggctgtgaagctgcagctgctgatccctgtgaagctgattgtgacagtgacagagagccagggcatccagggctggttccgccaccactactgtgagcagcagagcaccttcctggtggtgtgcctgtag

SEQ ID NO: 20986 - DNA, 873 bp, Artificial Sequence
  Description of Artificial Sequence: Synthetic coding sequence
atgggccacccccccctgctgcccctgctgctgctgctgcacacctgtgtgcctgcctcctggggcctgcgctgcatgcagtgcaagaccaatggagactgccgggtggaggagtgtgccctgggccaggacctgtgcaggaccaccatcgtgcggctgtgggaggagggggaggagctggagctggtggagaagagctgcacccacagcgagaagaccaacagaaccctgagctacagaacaggcctgaagatcaccagcctgacagaggtggtgtgtggcctggacctgtgcaaccagggcaacagcggccgggctgtgacctacagccgcagccgctacctggagtgcatcagctgtggcagcagtgacatgagctgtgagcggggccgccaccagagcctgcagtgccgcagccctgaggagcagtgcctggatgtggtgacccactggatccaggagggggaggaggtgctggagctggagaacctgccccagaatggccggcagtgctacagctgcaagggcaacagcacccacggctgcagcagcgaggagaccttcctgattgactgccggggccccatgaaccagtgcctggtggccaccggcacccatgagcccaagaaccagagctacatggtgcggggctgtgccacagcctccatgtgccagcacgcccacctgggagatgccttctccatgaaccacattgatgtgtcctgctgcaccaagagcggctgcaaccacccagacctggatgtgcagtacagaagtggagctgccccccagcccggccctgcccacctgagcctgaccatcaccctgctgatgacagcccggctgtggggcggcaccctgctgtggacctag

SEQ ID NO: 20987 - DNA, 1596 bp, Artificial Sequence
  Description of Artificial Sequence: Synthetic coding sequence
atggcccccaccatccagacccaggcccagcgggaggatggccaccggcccaacagccacaggaccctgcctgagaggtctggagtggtgtgccgggtgaagtactgcaacagcctgcctgacatcccctttgaccccaagttcatcacctacccctttgaccagaacagatttgtgcagtacaaggccaccagcctggagaagcagcacaagcatgacctgctgacagagccagacctgggcgtgaccatcgacctgatcaacccagacacctacagaattgaccccaacgtgctgctggaccctgcagatgagaagctgctggaggaggagatccaggcccccaccagcagcaagaggagccagcagcacgccaaggtggtgccctggatgaggaagacagagtacatcagcacagagttcaacagatatggcatcagcaatgagaagccagaggtgaagattggagtgtctgtgaagcagcagttcacagaggaggagatctacaaggaccgggacagccagatcacagccatcgagaagacctttgaagatgcccagaagagcatcagccagcactacagcaagccccgggtgacccctgtggaggtgatgcctgtgtttcctgacttcaagatgtggatcaacccctgtgcccaggtgatctttgacagcgaccctgcccccaaggacaccagcggggccgccgccctggagatgatgagccaggccatgatccggggcatgatggatgaggagggcaaccagtttgtggcctacttcctgcctgtggaggagaccctgaagaagaggaagagggaccaggaggaggagatggactatgccccagatgatgtgtatgactacaagatcgcccgggagtacaactggaatgtgaagaacaaggccagcaagggctatgaggagaactacttcttcatcttccgggagggagatggagtgtactacaatgagctggagaccagggtgcggctgagcaagagaagagccaaggccggcgtgcagagcggcaccaatgccctgctggtggtgaagcaccgggacatgaatgagaaggagctggaggcccaggaggccaggaaggcccagctggagaaccacgagcctgaggaggaggaggaggaggagatggagacagaggagaaggaggccggcggcagtgatgaggagcaggagaagggcagcagcagcgagaaggagggctctgaagatgagcacagcggcagcgagagcgagcgggaggagggggacagagatgaggccagtgacaagagcggcagcggggaggatgagagcagtgaagatgaggcccgggccgcccgggacaaggaggagatcttcggcagtgatgctgacagtgaagatgatgctgacagtgatgatgaagatcggggccaggcccagggcggcagtgacaatgacagcgacagcggcagcaatggaggcggccagaggagccgcagccacagccgcagcgccagccccttccccagcggcagcgagcacagcgcccaggaggatggcagcgaggccgccgccagtgacagcagcgaggccgacagcgacagcgactag

SEQ ID NO: 20988 - DNA, 867 bp, Artificial Sequence
  Description of Artificial Sequence: Synthetic coding sequence
atggccaccggccccatccccaccggcctgtgcctgcggggcctggagtggagcgctgagagcagcacagccatcgccagcctcatcagccccagcacccccagcagcagccccacccccagcaccaggacagtgctgctggaccctgcagatgagaagctgctggaggaggagatccaggcccccaccagcagcaagaggagccagcagcacgccaaggtggtgccctggatgaggaagacagagtacatcagcacagagttcaacagatatggcatcagcaatgagaagccagaggtgaagattggagtgtctgtgaagcagcagttcacagaggaggagatctacaaggaccgggacagccagatcacagccatcgagaagacctttgaagatgcccagaagagcatcagccagcactacagcaagccccgggtgacccctgtggaggtgatgcctgtgtttcctgacttcaagatgtggatcaacccctgtgcccaggtgatctttgacagcgaccctgcccccaaggacaccagcggggctgctgccctggagatgatgagccaggccatgatccggggcatgatggatgaggagggcaaccagtttgtggcctacttcctgcctgtggaggagaccctgaagaagaggaagagggaccaggaggaggagatggactatgccccagatgatgtgtatgactacaagatcgcccgggagtacaactggaatgtgaagaacaaggccagcaagggctatgaggagaactacttcttcatcttccgggagggagatggagtgtactacaatgagctggagaccagcatccagtacagccacatgctgtacaacctggtggcctag

SEQ ID NO: 20989 - DNA, 1176 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggagaagattgctgagtacaagaggcagaaccccaccatgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagaccacagagtacagcgccatggccagcctggccggcggcctggatgacatgaaggccaacctggccagccccaccccagctgacatcggcagctctgtgcccggcccccagagctaccccatcgtgacaggccgggacctggccagcaccaccctgcccggctacccaccccacgtgcccccagctggccagggcagctacagcgcccccaccctgaccggcatggtgcccggcagcgagttcagcggcagcccctacagccacccccagtacagcagctacaatgacagctggaggttccccaaccctggcctgctgggcagcccctactactacagcgctgctgcccggggagctgcccctcctgctgctgccacagcctatgacagacactag

SEQ ID NO: 20990 - DNA, 867 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggagaagattgctgagtacaagaggcagaaccccaccatgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcaggccgtgacctggagggcccggcccagccctggcaccctgcacaccagcccccccctggaccgggccgccacccagcacagaagatag

SEQ ID NO: 20991 - DNA, 987 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggagaagattgctgagtacaagaggcagaaccccaccatgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagaccacagagtacagcgccatggccagcctggccggcggcctggatgacatgaaggccaacctggccagccccaccccagctgacatcggcagctctgtgcccggcccccagagctaccccatcgtgacaggcagcccctactactacagcgctgctgcccggggggccgcccccccagctgctgccacagcctatgacagacactag

SEQ ID NO: 20992 - DNA, 909 bp, Artificial Sequence
  Description of Artificial Sequence: Synthetic coding sequence
atgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagtggtgccctgtgctgatgaggcagtacctggtgcagccccaggccgtgctcttccagaccacagagtacagcgccatggccagcctggccggcggcctggatgacatgaaggccaacctggccagccccaccccagctgacatcggcagctctgtgcccggcccccagagctaccccatcgtgacaggccgggacctggccagcaccaccctgcccggctacccacctcatgtgcccccagctggccagggcagctacagcgcccccaccctgaccggcatggtgcccggcagcgagttcagcggcagcccctacagccacccccagtacagcagctacaatgacagctggaggttccccaaccctggcctgctgggcagcccctactactacagcgctgctgcccggggggccgcccccccagctgctgccacagcctatgacagacactag

SEQ ID NO: 20993 - DNA, 1074 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggagaagattgctgagtacaagaggcagaaccccaccatgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagaccacagagtacagcgccatggccagcctggccggcggcctggatgacatgaaggccaacctggccagccccaccccagctgacatcggcagctctgtgcccggcccccagagctaccccatcgtgactggaagtgagttcagcggcagcccctacagccacccccagtacagcagctacaatgacagctggaggttccccaaccctggcctgctgggcagcccctactactacagcgctgctgcccggggagctgcccctcctgctgctgccacagcctatgacagacactag

SEQ ID NO: 20994 - DNA, 1089 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggagaagattgctgagtacaagaggcagaaccccaccatgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagaccacagagtacagcgccatggccagcctggccggcggcctggatgacatgaaggccaacctggccagccccaccccagctgacatcggcagctctgtgcccggcccccagagctaccccatcgtgacaggccgggacctggccagcaccaccctgcccggctacccaccccacgtgcccccagctggccagggcagctacagcgcccccaccctgaccggcatggtgcccggcagcccctactactacagcgctgctgcccggggggccgcccccccagctgctgccacagcctatgacagacactag

SEQ ID NO: 20995 - DNA, 1047 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggagaagattgctgagtacaagaggcagaaccccaccatgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagaccacagagtacagcgccatggccagcctggccggcggcctggatgacatgaaggccaacctggccagccccaccccagctgacatcggcagctctgtgcccggcccccagagctaccccatcgtgacaggccgggacctggccagcaccaccctgcccggctacccacctcatgtgcccccagctggccagggcagctacagcgcccccaccctgaccggcatggtgcccggcagcgagttcagcggcagcccctacagccacccccagtacagcagctacaatgacagctggaggttccccaaccctggcctgctgggcagcccctactactacagcgctgctgcccggggggccgcccccccagctgctgccacagcctatgacagacactag

SEQ ID NO: 20996 - DNA, 876 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagaccacagagtacagcgccatggccagcctggccggcggcctggatgacatgaaggccaacctggccagccccaccccagctgacatcggcagctctgtgcccggcccccagagctaccccatcgtgactggaagtgagttcagcggcagcccctacagccacccccagtacagcagctacaatgacagctggaggttccccaaccctggcctgctgggcagcccctactactacagcgctgctgcccggggagctgcccctcctgctgctgccacagcctatgacagacactag

SEQ ID NO: 20997 - DNA, 960 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggagaagattgctgagtacaagaggcagaaccccaccatgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagaccacagagtacagcgccatggccagcctggccggcggcctggatgacatgaaggccaacctggccagccccaccccagctgacatcggcagctctgtgcccggcccccagagctaccccatcgtgacaggccgggacctggccagcaccaccctgcccggctacccacctcatgtgcccccagctggccagggcagctacagcgcccccaccctgaccggcatggtgcccggcagcccctactactacagcgctgctgcccggggagctgcccctcctgctgctgccacagcctatgacagacactag

SEQ ID NO: 20998 - DNA, 852 bp, Artificial Sequence
  Description of Artificial Sequence: Synthetic coding sequence
atgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagaccacagagtacagcgccatggccagcctggccggcggcctggatgacatgaaggccaacctggccagccccaccccagctgacatcggcagctctgtgcccggcccccagagctaccccatcgtgacaggccgggacctggccagcaccaccctgcccggctacccaccccacgtgcccccagctggccagggcagctacagcgcccccaccctgaccggcatggtgcccggcagcgagttcagcggcagcccctacagccacccccagtacagcagctacaatgacagctggaggttccccaaccctggcctgctgggcagcccctactactacagcgctgctgcccggggagctgcccctcctgctgctgccacagcctatgacagacactag

SEQ ID NO: 20999 - DNA, 924 bp, Artificial Sequence
  Description of Artificial Sequence: Synthetic coding sequence
atggacctggagaagaactaccccacccccaggaccagcaggactggacatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggagaagattgctgagtacaagaggcagaaccccaccatgtttgcctgggagatccgggaccggctgctggccgagcgggtgtgtgacaatgacacagtgcccagcgtgagcagcatcaaccgcatcatccgcaccaaggtgcagcagccccccaaccagcctgtgcctgccagcagccacagcatcgtgtccactggatctgtgacccaggtgtcctctgtgtccacagacagcgctggcagcagctacagcatcagcggcatcctgggcatcaccagccccagcgctgacaccaacaagaggaagagagatgagggcatccaggagagccctgtgcccaacggccacagcctgcccggccgggacttcctgaggaagcagatgagaggagacctcttcacccagcagcagctggaggtgctggacagagtgtttgagcggcagcactacagcgacatcttcaccaccacagagcccatcaagccagagcagtggtgccctgtgctgatgaggcagtacctggtgcagccccaggccgtgctcttccaggccgtgacctggagggcccggcccagccctggcaccctgcacaccagcccccccctggacagagctgccacccagcacagaagatag

SEQ ID NO: 21000 - DNA, 1197 bp, Artificial Sequence
  Description of Artificial Sequence: Synthetic coding sequence
atgccccacaacagcatccgcagcggccacggcggcctgaaccagctgggcggggcctttgtgaatggccggcccctgcctgaggtggtgcggcagagaattgtggacctggcccaccagggcgtgcggccctgtgacatcagccggcagctgcgggtgagccacggctgtgtgtccaagatcctgggccgctactatgagaccggcagcatccggcctggggtcatcggcggcagcaagcccaaggtggccacccccaaggtggtggagaagatcggggactacaagaggcagaaccccaccatgtttgcctgggagatccgggaccggctgctggccgagggcgtgtgtgacaatgacacagtgcccagcgtgagcagcatcaaccgcatcatccgcaccaaggtgcagcagcccttcaacctgcccatggacagctgtgtggccaccaagagcctgagccctggccacaccctcatccccagcagcgctgtgaccccacctgagagcccccagagcgacagcctgggcagcacctacagcatcaatggcctgctgggcatcgcccagcccggcagtgacaagaggaagatggatgacagcgaccaggacagctgccgcctgagcattgacagccagagcagcagcagcggccccaggaagcacctgaggacagatgccttcagccagcaccacctggagcccctggagtgcccctttgagcggcagcactacccagaggcctatgccagccccagccacaccaagggggagcagggcctgtaccccctgcccctgctgaacagcaccctggatgatggcaaggccaccctgacccccagcaacacccccctgggcaggaacctgagcacccaccagacctaccctgtggtggccgccccacccttctggatctgcagcaagagcgcccctggcagccggcccagcatgcccttccccatgctgcccccctgcaccggcagcagccgggcccggcccagcagccagggcgagcgctggtggggcccccgctgcccagacacccaccccaccagccccccagctgaccgggccgccatgccacccctgcccagccaggcctggtggcaggaggtgaacaccctggccatgcccatggccaccccacccaccccacccacagcccggcctggggccagccccaccccagcctgctag

SEQ ID NO: 21001 - DNA, 966 bp, Artificial Sequence
  Description of Artificial Sequence: Synthetic coding sequence
atgccccacaacagcatccgcagcggccacggcggcctgaaccagctgggcggggcctttgtgaatggccggcccctgcctgaggtggtgcggcagagaattgtggacctggcccaccagggcgtgcggccctgtgacatcagccggcagctgcgggtgagccacggctgtgtgtccaagatcctgggccgctactatgagaccggcagcatccggcctggggtcatcggcggcagcaagcccaaggtggccacccccaaggtggtggagaagatcggggactacaagaggcagaaccccaccatgtttgcctgggagatccgggaccggctgctggccgagggcgtgtgtgacaatgacacagtgcccagcgtgagcagcatcaaccgcatcatccgcaccaaggtgcagcagcccttcaacctgcccatggacagctgtgtggccaccaagagcctgagccctggccacaccctcatccccagcagcgctgtgaccccacctgagagcccccagagcgacagcctgggcagcacctacagcatcaatggcctgctgggcatcgcccagcccggcagtgacaagaggaagatggatgacagcgaccaggacagctgccgcctgagcattgacagccagagcagcagcagcggccccaggaagcacctgaggacagatgccttcagccagcaccacctggagcccctggagtgcccctttgagcggcagcactacccagaggcctatgccagccccagccacaccaagggggagcagggcgagcgctggtggggcccccgctgcccagacacccaccccaccagccccccagctgacagagctgccatgccacccctgcccagccaggcctggtggcaggaggtgaacaccctggccatgcccatggccaccccacccaccccacccacagcccggcctggggccagccccaccccagcctgctag

SEQ ID NO: 21002 - DNA, 1197 bp, Artificial Sequence; identical to SEQ ID NO: 21000
  Description of Artificial Sequence: Synthetic coding sequence

SEQ ID NO: 21003 - DNA, 864 bp, Artificial Sequence
  Description of Artificial Sequence: Synthetic coding sequence
atgccccacaacagcatccgcagcggccacggcggcctgaaccagctgggcggggcctttgtgaatggccggcccctgcctgaggtggtgcggcagagaattgtggacctggcccaccagggcgtgcggccctgtgacatcagccggcagctgcgggtgagccacggctgtgtgtccaagatcctgggccgctactatgagaccggcagcatccggcctggggtcatcggcggcagcaagcccaaggtggccacccccaaggtggtggagaagatcggggactacaagaggcagaaccccaccatgtttgcctgggagatccgggaccggctgctggccgagggcgtgtgtgacaatgacacagtgcccagcgtgagcagcatcaaccgcatcatccgcaccaaggtgcagcagcccttcaacctgcccatggacagctgtgtggccaccaagagcctgagccctggccacaccctcatccccagcagcgctgtgaccccacctgagagcccccagagcgacagcctgggcagcacctacagcatcaatggcctgctgggcatcgcccagcccggcagtgacaagaggaagatggatgacagcgaccaggacagctgccgcctgagcattgacagccagagcagcagcagcggccccaggaagcacctgaggacagatgccttcagccagcaccacctggagcccctggagtgcccctttgagcggcagcactacccagaggcctatgccagccccagccacaccaagggggagcaggaggtgaacaccctggccatgcccatggccaccccacccaccccacccacagcccggcctggggccagccccaccccagcctgctag

SEQ ID NO: 21004 - DNA, 1353 bp, Artificial Sequence
  Description of Artificial Sequence: Synthetic coding sequence
atgccccacaacagcatccgcagcggccacggcggcctgaaccagctgggcggggcctttgtgaatggccggcccctgcctgaggtggtgcggcagagaattgtggacctggcccaccagggcgtgcggccctgtgacatcagccggcagctgcgggtgagccacggctgtgtgtccaagatcctgggccgctactatgagaccggcagcatccggcctggggtcatcggcggcagcaagcccaaggtggccacccccaaggtggtggagaagatcggggactacaagaggcagaaccccaccatgtttgcctgggagatccgggaccggctgctggccgagggcgtgtgtgacaatgacacagtgcccagcgtgagcagcatcaaccgcatcatccgcaccaaggtgcagcagcccttcaacctgcccatggacagctgtgtggccaccaagagcctgagccctggccacaccctcatccccagcagcgctgtgaccccacctgagagcccccagagcgacagcctgggcagcacctacagcatcaatggcctgctgggcatcgcccagcccggcagtgacaagaggaagatggatgacagcgaccaggacagctgccgcctgagcattgacagccagagcagcagcagcggccccaggaagcacctgaggacagatgccttcagccagcaccacctggagcccctggagtgcccctttgagcggcagcactacccagaggcctatgccagccccagccacaccaagggggagcagggcctgtaccccctgcccctgctgaacagcaccctggatgatggcaaggccaccctgacccccagcaacacccccctgggcaggaacctgagcacccaccagacctaccctgtggtggccgacccccacagcccctttgccatcaagcaggagaccccagaggtgagcagcagcagcagcacccccagcagcctgagcagcagcgccttcctggacctgcagcaggtgggcagcggcgtgccccccttcaatgccttcccccacgccgcctctgtgtatggccagttcaccggccaggccctgctgagcggccgggagatggtgggccccaccctgcccggctacccaccccacatccccaccagcggccagggcagctatgccagcagcgccatcgccggcatggtggccggcagcgagtacagcggaaatgcctacggccacaccccctacagcagctacagcgaggcctggaggttccccaacagcagcctgctgagcagcccctactactacagcagcaccagccggcccagcgccccacccaccacagccacagcctttgaccacctgtag

SEQ ID NO: 21005 - DNA, 570 bp, Artificial Sequence
  Description of Artificial Sequence: Synthetic coding sequence
atggccagcaagagggccctggtgatcctggccaagggagctgaggagatggagaccgtcatccctgtggatgtgatgagaagagctggcatcaaggtgacagtggccggcctggccggcaaggaccctgtgcagtgcagcagagatgtggtgatctgcccagatgccagcctggaggatgccaagaaggagggcccctatgatgtggtggtgctgcccggcggcaacctgggcgcccagaacctgtctgagagcgctgctgtgaaggagatcctgaaggagcaggagaacaggaagggcctgattgctgccatctgtgccggccccacagccctgctggcccatgaaattggatttggcagcaaggtgaccacccaccccctggccaaggacaagatgatgaatggaggccactacacctacagtgaaaatagagtggagaaggatggcctcatcctgaccagccggggccctggcaccagctttgaatttgccctggccatcgtggaggccctgaatggcaaggaggtggccgcccaggtgaaggcccccctggtgctgaaggactag

SEQ ID NO: 21006 - DNA, 570 bp, Artificial Sequence; identical to SEQ ID NO: 21005
  Description of Artificial Sequence: Synthetic coding sequence

SEQ ID NO: 21007 - DNA, 570 bp, Artificial Sequence; identical to SEQ ID NO: 21005
  Description of Artificial Sequence: Synthetic coding sequence

SEQ ID NO: 21008 - DNA, 570 bp, Artificial Sequence; identical to SEQ ID NO: 21005
  Description of Artificial Sequence: Synthetic coding sequence

SEQ ID NO: 21009 - DNA, 3561 bp, Artificial Sequence
  Description of Artificial Sequence: Synthetic coding sequence
atggatgagcccccaggcaagcccctgagctgtgaggagaaggagaagctgaaggagaagctggccttcctgaagcgggagtacagcaagaccctggcccggctgcagagggcccagagagctgagaagatcaagcacagcatcaagaagacagtggaggagcaggactgcctgagccagcaggacctgagcccccagctgaagcacagcgagcccaagaacaagatctgtgtgtatgacaagctgcacatcaagacccacctggatgaggagaccggggagaagaccagcatcaccctggatgtgggccctgagagcttcaaccctggagatggccctgggggcctgcccatccagaggacagatgacacccaggagcacttcccccaccgggtgtctgaccccagcggggagcagaagcagaagctgcccagcaggaggaagaagcagcagaagaggaccttcatcagccaggagcgggactgtgtgtttggaacagacagcctgcggctgagcggcaagaggctgaaggagcaggaggagatcagcagcaagaacccagcccggagccctgtgacagagatccgcacccacctgctgagcctgaagtctgagctgcctgacagccctgagcctgtgacagagatcaatgaagacagcgtgctgatccccccaacagcccagcctgagaagggcgtggacaccttcctgcggcggcccaacttcacccgggccaccaccgtgcccctgcagaccctgagtgacagcggcagcagccagcacctggagcacatcccccccaagggcagcagcgagctgaccacccatgacctgaagaacatccgcttcaccagccctgtgtccctggaggcccagggcaagaagatgacagtgtccacagacaacctgctggtgaacaaggccatcagcaagagcggccagctgcccaccagcagcaacctggaggccaacatcagctgcagcctgaatgagctgacctacaacaacctgcctgccaatgaaaaccagaacctgaaggagcagaaccagacagagaagagcctgaagagccccagcgacaccctggatggaagaaatgaaaacctgcaggagagcgagatcctgagccagcccaagagcctgagcctggaggccaccagccccctgtctgctgagaagcacagctgcaccgtgcctgagggcctgctcttccctgctgagtactacgtgaggaccaccaggtccatgagcaactgccagaggaaggtggccgtggaggccgtcatccagagccacctggatgtgaagaagaagggcttcaagaacaagaacaaggatgccagcaagaacctgaacctgagcaatgaggagacagaccagagcgagatccgcatgagcggcacctgcaccggccagcccagcagcaggaccagccagaagctgctgagcctgaccaaggtgagcagccctgctggccccacagaagataatgacctgagcaggaaggctgtggcccaggcccctggccgccgctacacaggcaagaggaagagcgcctgcaccccagccagtgaccactgtgagcccctgctgcccaccagcagcctgagcatcgtgaacagaagcaaggaggaggtgaccagccacaagtaccagcacgagaagctgttcatccaggtgaagggcaagaagagccgccaccagaaggaggacagcctgtcctggagcaacagcgcctacctgagcctggatgatgatgccttcaccgcccccttccacagagatggcatgctgagcctgaagcagctgctgtccttcctgagcatcacagacttccagctgcctgatgaagattttggccccctgaagctggagaaggtgaagagctgcagcgagaagcctgtggagccctttgagagcaagatgtttggagagcggcacctgaaggagggcagctgcatcttccctgaggagctgagccccaagaggatggacacagagatggaggacctggaggaggacctgattgtgctgcccgggaagagccaccccaagaggcccaacagccagagccagcacaccaagacaggcctgagcagcagcatcctgctgtacacccccctgaacacagtggccccagatgacaatgaccggcccaccacagacatgtgcagccctgccttccccatcctgggcaccaccccagccttcggcccccagggcagctatgagaaggccagcacagaggtggccggccgcacctgctgcaccccccagctggcccacctgaaggacagcgtgtgcctggccagtgacaccaagcagtttgacagcagcggcagccctgccaagccccacaccaccctgcaggtgtctggccggcagggccagcccacctgtgactgtgacagcgtgcccccaggcaccccaccacccatcgagagcttcaccttcaaggagaaccagctgtgcaggaacacctgccaggagctgcacaagcacagcgtggagcagacagaaacagctgagctgcctgccagtgacagcatcaaccctggcaacctgcagctggtgtctgagctgaagaaccccagcggcagctgcagcgtggatgtgtctgccatgttctgggagcgggccggctgcaaggagccctgcatcatcacagcctgtgaagatgtggtgtccctgtggaaggccctggatgcctggcagtgggagaagctgtacacctggcactttgctgaggtgcctgtgctgcagatcgtgcctgtgcctgatgtgtacaacctggtgtgtgtggccctgggcaacctggagatccgggagatccgggccctcttctgcagcagtgatgatgaaagtgagaagcaggtgctgctgaagagcggcaacatcaaggctgtgctgggcctgaccaagaggcggctggtgagcagcagcggcaccctgagtgaccagcaggtggaggtgatgacctttgctgaagatggcggcggcaaggagaaccagttcctgatgcctcctgaggagaccatcctgacctttgctgaggtgcagggcatgcaggaggccctgctgggcaccaccatcatgaacaacatcgtcatctggaacctgaagacaggccagctgctgaagaagatgcacattgatgacagctaccaggcctctgtgtgccacaaggcctacagcgagatgggcctgctcttcatcgtgctgagccacccctgtgccaaggagagcgagagcctgcggagccctgtgttccagctgattgtcatcaaccccaagaccaccctgtctgtgggcgtgatgctgtactgcctgcccccaggccaggccggccgcttcctggagggagatgtgaaggaccactgtgccgccgccatcctgaccagcggcaccatcgccatctgggacctgctgctgggccagtgcacagccctgctgccccctgtgtctgaccagcactggagctttgtgaagtggagcggcacagacagccacctgctggccggccagaaggatggcaacatctttgtgtaccactacagctag

SEQ ID NO: 21010 - DNA, 4344 bp, Artificial Sequence
  Description of Artificial Sequence: Synthetic coding sequence
atggccagcgctggaaatgctgctgagccccaggaccggggcggcggcggcagcggctgcattggagcccctggccggcctgctgggggcggcagaagaagaagaactggaggcctgcggcgggctgctgccccagaccgggactacctgcaccggcccagctactgtgatgctgcctttgccctggagcagatcagcaagggcaaggccactggaaggaaggcccccctgtggctgcgggccaagttccagaggctgctcttcaagctgggctgctacatccagaagaactgtgggaagttcctggtggtgggcctgctgatctttggagcctttgctgtgggcctgaaggccgccaacctggagaccaacgtggaggagctgtgggtggaggtgggcggccgggtgtcccgggagctgaactacacccggcagaagattggagaggaggccatgttcaacccccagctgatgatccagacccccaaggaggagggcgccaacgtgctgaccacagaggccctgctgcagcacctggacagcgccctgcaggccagccgggtgcacgtgtacatgtacaaccggcagtggaagctggagcacctgtgctacaagagcggggagctgatcacagaaacaggctacatggaccagatcatcgagtacctgtacccctgcctgatcatcacccccctggactgcttctgggagggcgccaagctgcagagcggcacagcctacctgctgggcaagccacccctgcgctggaccaactttgaccccctggagttcctggaggagctgaagaagatcaactaccaggtggacagctgggaggagatgctgaacaaggccgaggtgggccacggctacatggaccggccctgcctgaacccagctgaccctgactgcccagccacagcccccaacaagaacagcaccaagcccctggacatggccctggtgctgaatggaggctgccacggcctgagcaggaagtacatgcactggcaggaggagctgattgtgggcggcaccgtgaagaacagcacaggcaagctggtgtctgcccacgccctgcagaccatgttccagctgatgacccccaagcagatgtatgagcacttcaagggctatgaatatgtgagccacatcaactggaatgaagacaaggctgctgccatcctggaggcctggcagaggacctacgtggaggtggtgcaccagagcgtggcccagaacagcacccagaaggtgctgtccttcaccaccaccaccctggatgacatcctgaagagcttcagtgatgtgtctgtcatccgggtggccagcggctacctgctgatgctggcctatgcctgcctgaccatgctgcgctgggactgcagcaagagccagggcgctgtgggcctggccggcgtgctgctggtggccctgtctgtggccgccggcctgggcctgtgcagcctgattggcatctccttcaatgctgccaccacccaggtgctgcccttcctggccctgggcgtgggcgtggatgatgtgttcctgctggcccacgccttcagcgagaccggccagaacaagaggatcccctttgaggacagaactggagaatgtctgaagaggactggagcctctgtggccctgaccagcatcagcaatgtgacagccttcttcatggccgccctgatccccatcccagccctgcgggccttcagcctgcaggccgctgtggtggtggtgttcaactttgccatggtgctgctgatcttccctgccatcctgtccatggacctgtaccgccgggaggaccggcggctggacatcttctgctgcttcaccagcccctgtgtgtccagggtcatccaggtggagccccaggcctacacagacacccatgacaacacccgctacagccccccaccaccctacagcagccacagctttgcccacgagacccagatcaccatgcagagcacagtgcagctgaggacagaatatgacccccacacccacgtgtactacaccacagctgagcccaggtctgagatctctgtgcagcctgtgacagtgacccaggacaccctgagctgccagagccctgagagcaccagcagcacccgggacctgctgagccagttcagtgacagcagcctgcactgcctggagcccccctgcaccaagtggaccctgagcagctttgctgagaagcactacgcccccttcctgctgaagcccaaggccaaggtggtggtgatcttcctgttcctgggcctgctgggcgtgtccctgtatggcaccaccagggtgagagatggcctggacctgacagacatcgtgccccgggagacccgggagtatgacttcatcgccgcccagttcaagtacttctccttctacaacatgtacatcgtgacccagaaggctgactaccccaacatccagcacctgctgtatgacctgcaccgctccttcagcaatgtgaagtatgtgatgctggaggagaacaagcagctgcccaagatgtggctgcactacttccgggactggctgcagggcctgcaggatgcctttgacagcgactgggagaccgggaagatcatgcccaacaactacaagaatggaagtgatgatggagtgctggcctacaagctgctggtgcagacaggcagccgggacaagcccatcgacatcagccagctgaccaagcagaggctggtggatgctgatggcatcatcaaccccagcgccttctacatctacctgacagcctgggtgtccaatgaccctgtggcctatgctgccagccaggccaacatccggccccacaggcctgagtgggtgcatgacaaggctgactacatgcctgagacccggctgcgcatcccagctgctgagcccattgaatatgcccagttccccttctacctgaatggcctgcgggacaccagtgactttgtggaggccatcgagaaggtgaggaccatctgcagcaactacaccagcctgggcctgagcagctacccaaatggctaccccttcctgttctgggagcagtacatcggcctgcggcactggctgctgctcttcatctctgtggtgctggcctgcaccttcctggtgtgtgctgtgttcctgctgaacccctggacagctggcatcatcgtgatggtgctggccctgatgacagtggagctgtttggcatgatgggcctcatcggcatcaagctgtctgctgtgcctgtggtgatcctgattgcctctgtgggcatcggcgtggagttcaccgtgcacgtggccctggccttcctgacagccatcggggacaagaacagaagagctgtgctggccctggagcacatgtttgcccctgtgctggatggagctgtgtccaccctgctgggcgtgctgatgctggccggcagcgagtttgacttcatcgtgcgctacttctttgctgtgctggccatcctgaccatcctgggcgtgctgaatggcctggtgctgctgcctgtgctgctgtccttcttcggcccctacccagaggtgtccccagccaacggcctgaaccggctgcccacccccagccctgagcccccaccttctgtggtgcgctttgccatgcctcctggccacacccacagcggcagtgacagcagtgacagcgagtacagcagccagaccaccgtgtctggcctgtctgaggagctgcggcactatgaggcccagcagggcgccggcggccctgcccaccaggtgattgtggaggccacagagaaccctgtgtttgcccacagcacagtggtgcaccctgagagccgccaccacccccccagcaacccccggcagcagccccacctggacagcggcagcctgcccccaggccggcagggccagcagccccggcgggaccccccccgggagggcctgtggcccccaccctaccggcccaggagagatgcctttgagatcagcacagagggccacagcggccccagcaacagagcccgctggggccccaggggggcccggagccacaaccccaggaacccagccagcacagccatgggcagctctgtgcccggctactgccagcccatcaccaccgtgacagccagcgcctctgtgacagtggccgtgcaccccccacctgtgcccggccctggaagaaacccccggggcggcctgtgccccggctacccagagacagaccacggcctgtttgaggacccccacgtgcccttccacgtgcgctgtgagcggcgggacagcaaggtggaggtgattgagctgcaggatgtggagtgtgaggagcggccccggggcagcagcagcaactag

SEQ ID NO: 21011 - DNA, 1059 bp, Artificial Sequence
  Description of Artificial Sequence: Synthetic coding sequence
aaggccgaggtgggccacggctacatggaccggccctgcctgaacccagctgaccctgactgcccagccacagcccccaacaagaacagcaccaagcccctggacatggccctggtgctgaatggaggctgccacggcctgagcaggaagtacatgcactggcaggaggagctgattgtgggcggcaccgtgaagaacagcacaggcaagctggtgtctgcccacgccctgcagaccatgttccagctgatgacccccaagcagatgtatgagcacttcaagggctatgaatatgtgagccacatcaactggaatgaagacaaggccgccgccatcctggaggcctggcagaggacctacgtggaggtggtgcaccagagcgtggcccagaacagcacccagaaggtgctgtccttcaccaccaccaccctggatgacatcctgaagagcttcagtgatgtgtctgtcatccgggtggccagcggctacctgctgatggtgctgcccttcctggccctgggcgtgggcgtggatgatgtgttcctgctggcccacgccttcagcgagaccggccagaacaagaggatcccctttgaggacagaactggagagtgcctgaagaggactggagcctctgtggccctgaccagcatcagcaatgtgacagccttcttcatggccgccctgatccccatcccagccctgcgggccttcagcctgcaggccgctgtggtggtggtgttcaactttgccatggtgctgctgatcttccctgccatcctgtccatggacctgtacagaagagaagatagaaggctggacatcttctgctgcttcaccagcccctgtgtgtccagggtcatccaggtggagccccaggcctacacagacacccatgacaacacccgctacagccccccaccaccctacagcagccacagctttgcccacgagacccagatcaccatgcagagcacagtgcagctgaggacagaatatgacccccacacccacgtgtactacaccacagctgagcccaggtctgagatctctgtgtag

SEQ ID NO: 21012 - DNA, 4341 bp, Artificial Sequence
  Description of Artificial Sequence: Synthetic coding sequence
atggagctgctgaacagaaaccggctggtgattgtgagcccccgctgcaccccacccaaggccagcggcggccctgcccggcggggcttctacaccttccgctccttctgcaaggatggcggcggcggggaggaggaggaggagaatggaggagaggagaaggatgacagaggagacaaggagaccaggagtgacaagggcaaggccaccggcaggaaggcccccctgtggctgcgggccaagttccagaggctgctcttcaagctgggctgctacatccagaagaactgtgggaagttcctggtggtgggcctgctgatctttggagcctttgctgtgggcctgaaggccgccaacctggagaccaacgtggaggagctgtgggtggaggtgggcggccgggtgtcccgggagctgaactacacccggcagaagatcggggaggaggccatgttcaacccccagctgatgatccagacccccaaggaggagggcgccaacgtgctgaccacagaggccctgctgcagcacctggacagcgccctgcaggccagccgggtgcacgtgtacatgtacaaccggcagtggaagctggagcacctgtgctacaagtctggagagctgatcacagagaccggctacatggaccagatcatcgagtacctgtacccctgcctgatcatcacccccctggactgcttctgggagggcgccaagctgcagagcggcacagcctacctgctgggcaagccacccctgcgctggaccaactttgaccccctggagttcctggaggagctgaagaagatcaactaccaggtggacagctgggaggagatgctgaacaaggccgaggtgggccacggctacatggaccggccctgcctgaacccagctgaccctgactgcccagccacagcccccaacaagaacagcaccaagcccctggacatggccctggtgctgaatggaggctgccacggcctgagcaggaagtacatgcactggcaggaggagctgattgtgggcggcaccgtgaagaacagcacaggcaagctggtgtctgcccacgccctgcagaccatgttccagctgatgacccccaagcagatgtatgagcacttcaagggctatgaatatgtgagccacatcaactggaatgaagacaaggccgccgccatcctggaggcctggcagaggacctacgtggaggtggtgcaccagagcgtggcccagaacagcacccagaaggtgctgtccttcaccaccaccaccctggatgacatcctgaagagcttcagtgatgtgtctgtcatccgggtggccagcggctacctgctgatgctggcctatgcctgcctgaccatgctgcgctgggactgcagcaagagccagggcgctgtgggcctggccggcgtgctgctggtggccctgtctgtggccgccggcctgggcctgtgcagcctcatcggcatctccttcaatgctgccaccacccaggtgctgcccttcctggccctgggcgtgggcgtggatgatgtgttcctgctggcccacgccttcagcgagaccggccagaacaagaggatcccctttgaggacagaactggagagtgcctgaagaggactggagcctctgtggccctgaccagcatcagcaatgtgacagccttcttcatggccgccctgatccccatcccagccctgcgggccttcagcctgcaggccgctgtggtggtggtgttcaactttgccatggtgctgctgatcttccctgccatcctgtccatggacctgtacagaagagaagatagaaggctggacatcttctgctgcttcaccagcccctgtgtgtccagggtcatccaggtggagccccaggcctacacagacacccatgacaacacccgctacagccccccaccaccctacagcagccacagctttgcccacgagacccagatcaccatgcagagcacagtgcagctgaggacagaatatgacccccacacccacgtgtactacaccacagctgagcccaggtctgagatctctgtgcagcctgtgacagtgacccaggacaccctgagctgccagagccctgagagcaccagcagcacccgggacctgctgagccagttcagtgacagcagcctgcactgcctggagcccccctgcaccaagtggaccctgagcagctttgctgagaagcactacgcccccttcctgctgaagcccaaggccaaggtggtggtgatcttcctgttcctgggcctgctgggcgtgtccctgtatggcaccaccagggtgagagatggcctggacctgacagacatcgtgccccgggagacccgggagtatgacttcatcgccgcccagttcaagtacttctccttctacaacatgtacatcgtgacccagaaggctgactaccccaacatccagcacctgctgtatgacctgcacaggagcttcagcaatgtgaagtatgtgatgctggaggagaacaagcagctgcccaagatgtggctgcactacttccgggactggctgcagggcctgcaggatgcctttgacagcgactgggagaccgggaagatcatgcccaacaactacaagaatggaagtgatgatggagtgctggcctacaagctgctggtgcagacaggcagccgggacaagcccatcgacatcagccagctgaccaagcagaggctggtggatgctgatggcatcatcaaccccagcgccttctacatctacctgacagcctgggtgtccaatgaccctgtggcctatgctgccagccaggccaacatccggccccacaggcctgagtgggtgcatgacaaggctgactacatgcctgagacccggctgcgcatcccagctgctgagcccatcgagtatgcccagttccccttctacctgaatggcctgcgggacaccagtgactttgtggaggccatcgagaaggtgaggaccatctgcagcaactacaccagcctgggcctgagcagctaccccaacggctaccccttcctgttctgggagcagtacatcggcctgcggcactggctgctgctcttcatctctgtggtgctggcctgcaccttcctggtgtgtgctgtgttcctgctgaacccctggacagctggcatcatcgtgatggtgctggccctgatgacagtggagctgtttggcatgatgggcctgattggcatcaagctgtctgctgtgcctgtggtgatcctgattgcctctgtgggcattggagtggagttcaccgtgcacgtggccctggccttcctgacagccatcggggacaagaacagaagagctgtgctggccctggagcacatgtttgcccctgtgctggatggagctgtgtccaccctgctgggcgtgctgatgctggccggcagcgagtttgacttcatcgtgcgctacttctttgctgtgctggccatcctgaccatcctgggcgtgctgaatggcctggtgctgctgcctgtgctgctgtccttcttcggcccctacccagaggtgtccccagccaacggcctgaaccggctgcccacccccagccctgagcccccacccagcgtggtgcgctttgccatgcctcctggccacacccacagcggcagtgacagcagtgacagcgagtacagcagccagaccaccgtgtctggcctgtctgaggagctgcggcactatgaggcccagcagggcgctgggggccctgcccaccaggtgattgtggaggccacagaaaatcctgtgtttgcccacagcacagtggtgcaccctgagagccgccaccacccccccagcaacccccggcagcagccccacctggacagcggcagcctgcccccaggccggcagggccagcagccccggcgggaccccccccgggagggcctgtggcccccaccctaccggcccaggagagatgcctttgagatcagcacagagggccacagcggccccagcaacagagcccgctggggccccaggggggcccggagccacaaccccagaaatcctgccagcacagccatgggcagctctgtgcccggctactgccagcccatcaccaccgtgacagccagcgcctctgtgacagtggccgtgcaccccccacctgtgcccggccctggcaggaacccccggggcggcctgtgccccggctacccagagacagaccacggcctgtttgaggacccccacgtgcccttccacgtgcgctgtgaaagaagagacagcaaggtggaggtgattgagctgcaggatgtggagtgtgaggagcggccccggggcagcagcagcaactag

SEQ ID NO: 21013 - DNA, 1758 bp, Artificial Sequence
  Description of Artificial Sequence: Synthetic coding sequence
ccctgcaggaagagcagcgccctgaacagccccaaggctgctgtggtggtggtgttcaactttgccatggtgctgctgatcttccctgccatcctgtccatggacctgtaccgccgggaggaccggcggctggacatcttctgctgcttcaccagcccctgtgtgtccagggtcatccaggtggagccccaggcctacacagacacccatgacaacacccgctacagccccccaccaccctacagcagccacagctttgcccacgagacccagatcaccatgcagagcacagtgcagctgaggacagaatatgacccccacacccacgtgtactacaccacagctgagcccaggtctgagatctctgtgcagcctgtgacagtgacccaggacaccctgagctgccagagccctgagagcaccagcagcacccgggacctgctgagccagttcagtgacagcagcctgcactgcctggagcccccctgcaccaagtggaccctgagcagctttgctgagaagcactacgcccccttcctgctgaagcccaaggccaaggtggtggtgatcttcctgttcctgggcctgctgggcgtgtccctgtatggcaccaccagggtgagagatggcctggacctgacagacatcgtgccccgggagacccgggagtatgacttcatcgccgcccagttcaagtacttctccttctacaacatgtacatcgtgacccagaaggctgactaccccaacatccagcacctgctgtatgacctgcaccgctccttcagcaatgtgaagtatgtgatgctggaggagaacaagcagctgcccaagatgtggctgcactacttccgggactggctgcagggcctgcaggatgcctttgacagcgactgggagaccgggaagatcatgcccaacaactacaagaatggaagtgatgatggagtgctggcctacaagctgctggtgcagacaggcagccgggacaagcccatcgacatcagccagctgaccaagcagaggctggtggatgctgatggcatcatcaaccccagcgccttctacatctacctgacagcctgggtgtccaatgaccctgtggcctatgctgccagccaggccaacatccggccccacaggcctgagtgggtgcatgacaaggctgactacatgcctgagacccggctgcgcatcccagctgctgagcccattgaatatgcccagttccccttctacctgaatggcctgcgggacaccagtgactttgtggaggccatcgagaaggtgaggaccatctgcagcaactacaccagcctgggcctgagcagctacccaaatggctaccccttcctgttctgggagcagtacatcggcctgcggcactggctgctgctcttcatctctgtggtgctggcctgcaccttcctggtgtgtgctgtgttcctgctgaacccctggacagctggcatcatcgtgatggtgctggccctgatgacagtggagctgtttggcatgatgggcctcatcggcatcaagctgtctgctgtgcctgtggtgatcctgattgcctctgtgggcatcggcgtggagttcaccgtgcacgtggccctggccttcctgacagccatcggggacaagaacagaagagctgtgctggccctggagcacatgtttgcccctgtgctggatggagctgtgtccaccctgctgggcgtgctgatgctggccggcagcgagtttgacttcatcgtgtag

SEQ ID NO: 21014 - DNA, 729 bp, Artificial Sequence
  Description of Artificial Sequence: Synthetic coding sequence
atgcctcctggccacacccacagcggcagtgacagcagtgacagcgagtacagcagccagaccaccgtgtctggcctgtctgaggagctgcggcactatgaggcccagcagggcgccggcggccctgcccaccaggtgattgtggaggccacagagaaccctgtgtttgcccacagcacagtggtgcaccctgagagccgccaccacccccccagcaacccccggcagcagccccacctggacagcggcagcctgcccccaggccggcagggccagcagccccggcgggaccccccccgggagggcctgtggcccccaccctaccggcccaggagagatgcctttgagatcagcacagagggccacagcggccccagcaacagagcccgctggggccccaggggggcccggagccacaaccccaggaacccagccagcacagccatgggcagctctgtgcccggctactgccagcccatcaccaccgtgacagccagcgcctctgtgacagtggccgtgcaccccccacctgtgcccggccctggaagaaacccccggggcggcctgtgccccggctacccagagacagaccacggcctgtttgaggaccccacctgcctgagcaccagcggcgtgcggggcggcatccgccgctggaagagcctgagctgcaggacctggaatgcccggcggggccctggagaggccgcccccacagaaggagactag

SEQ ID NO: 21015 - DNA, 1461 bp, Artificial Sequence
  Description of Artificial Sequence: Synthetic coding sequence
gggaaggccaccggcaggaaggcccccctgtggctgcgggccaagttccagaggctgctcttcaagctgggctgctacatccagaagaactgtgggaagttcctggtggtgggcctgctgatctttggagcctttgctgtgggcctgaaggccgccaacctggagaccaacgtggaggagctgtgggtggaggtgggcggccgggtgtcccgggagctgaactacacccggcagaagatcggggaggaggccatgttcaacccccagctgatgatccagacccccaaggaggagggcgccaacgtgctgaccacagaggccctgctgcagcacctggacagcgccctgcaggccagccgggtgcacgtgtacatgtacaacagaggcaagccacccctgcgctggaccaactttgaccccctggagttcctggaggagctgaagaagatcaactaccaggtggacagctgggaggagatgctgaacaaggccgaggtgggccacggctacatggaccggccctgcctgaacccagctgaccctgactgcccagccacagcccccaacaagaacagcaccaagcccctggacatggccctggtgctgaatggaggctgccacggcctgagcaggaagtacatgcactggcaggaggagctgattgtgggcggcaccgtgaagaacagcacaggcaagctggtgtctgcccacgccctgcagaccatgttccagctgatgacccccaagcagatgtatgagcacttcaagggctatgaatatgtgagccacatcaactggaatgaagacaaggccgccgccatcctggaggcctggcagaggacctacgtggaggtggtgcaccagagcgtggcccagaacagcacccagaaggtgctgtccttcaccaccaccaccctggatgacatcctgaagagcttcagtgatgtgtctgtcatccgggtggccagcggctacctgctgatgctggcctatgcctgcctgaccatgctgcgctgggactgcagcaagagccagggcgctgtgggcctggccggcgtgctgctggtggccctgtctgtggccgccggcctgggcctgtgcagcctcatcggcatctccttcaatgctgccaccacccaggtgctgcccttcctggccctgggcgtgggcgtggatgatgtgttcctgctggcccacgccttcagcgagaccggccagaacaagaggatcccctttgaggacagaactggagagtgcctgaagaggactggagcctctgtggccctgaccagcatcagcaatgtgacagccttcttcatggccgccctgatccccatcccagccctgcgggccttcagcctgcagtacatcctgatggcccaccggggccgcctgtccttcaatgacaccctgtggtgtggcggcctgaagagctacatgaggttcccctatgaggagtag

SEQ ID NO: 21016 - DNA, 3891 bp, Artificial Sequence
  Description of Artificial Sequence: Synthetic coding sequence
atgttcaacccccagctgatgatccagacccccaaggaggagggcgccaacgtgctgaccacagaggccctgctgcagcacctggacagcgccctgcaggccagccgggtgcacgtgtacatgtacaaccggcagtggaagctggagcacctgtgctacaagtctggagagctgatcacagagaccggctacatggaccagatcatcgagtacctgtacccctgcctgatcatcacccccctggactgcttctgggagggcgccaagctgcagagcggcacagcctacctgctgggcaagccacccctgcgctggaccaactttgaccccctggagttcctggaggagctgaagaagatcaactaccaggtggacagctgggaggagatgctgaacaaggccgaggtgggccacggctacatggaccggccctgcctgaacccagctgaccctgactgcccagccacagcccccaacaagaacagcaccaagcccctggacatggccctggtgctgaatggaggctgccacggcctgagcaggaagtacatgcactggcaggaggagctgattgtgggcggcaccgtgaagaacagcacaggcaagctggtgtctgcccacgccctgcagaccatgttccagctgatgacccccaagcagatgtatgagcacttcaagggctatgaatatgtgagccacatcaactggaatgaagacaaggccgccgccatcctggaggcctggcagaggacctacgtggaggtggtgcaccagagcgtggcccagaacagcacccagaaggtgctgtccttcaccaccaccaccctggatgacatcctgaagagcttcagtgatgtgtctgtcatccgggtggccagcggctacctgctgatgctggcctatgcctgcctgaccatgctgcgctgggactgcagcaagagccagggcgctgtgggcctggccggcgtgctgctggtggccctgtctgtggccgccggcctgggcctgtgcagcctcatcggcatctccttcaatgctgccaccacccaggtgctgcccttcctggccctgggcgtgggcgtggatgatgtgttcctgctggcccacgccttcagcgagaccggccagaacaagaggatcccctttgaggacagaactggagagtgcctgaagaggactggagcctctgtggccctgaccagcatcagcaatgtgacagccttcttcatggccgccctgatccccatcccagccctgcgggccttcagcctgcaggccgctgtggtggtggtgttcaactttgccatggtgctgctgatcttccctgccatcctgtccatggacctgtacagaagagaagatagaaggctggacatcttctgctgcttcaccagcccctgtgtgtccagggtcatccaggtggagccccaggcctacacagacacccatgacaacacccgctacagccccccaccaccctacagcagccacagctttgcccacgagacccagatcaccatgcagagcacagtgcagctgaggacagaatatgacccccacacccacgtgtactacaccacagctgagcccaggtctgagatctctgtgcagcctgtgacagtgacccaggacaccctgagctgccagagccctgagagcaccagcagcacccgggacctgctgagccagttcagtgacagcagcctgcactgcctggagcccccctgcaccaagtggaccctgagcagctttgctgagaagcactacgcccccttcctgctgaagcccaaggccaaggtggtggtgatcttcctgttcctgggcctgctgggcgtgtccctgtatggcaccaccagggtgagagatggcctggacctgacagacatcgtgccccgggagacccgggagtatgacttcatcgccgcccagttcaagtacttctccttctacaacatgtacatcgtgacccagaaggctgactaccccaacatccagcacctgctgtatgacctgcacaggagcttcagcaatgtgaagtatgtgatgctggaggagaacaagcagctgcccaagatgtggctgcactacttccgggactggctgcagggcctgcaggatgcctttgacagcgactgggagaccgggaagatcatgcccaacaactacaagaatggaagtgatgatggagtgctggcctacaagctgctggtgcagacaggcagccgggacaagcccatcgacatcagccagctgaccaagcagaggctggtggatgctgatggcatcatcaaccccagcgccttctacatctacctgacagcctgggtgtccaatgaccctgtggcctatgctgccagccaggccaacatccggccccacaggcctgagtgggtgcatgacaaggctgactacatgcctgagacccggctgcgcatcccagctgctgagcccatcgagtatgcccagttccccttctacctgaatggcctgcgggacaccagtgactttgtggaggccatcgagaaggtgaggaccatctgcagcaactacaccagcctgggcctgagcagctaccccaacggctaccccttcctgttctgggagcagtacatcggcctgcggcactggctgctgctcttcatctctgtggtgctggcctgcaccttcctggtgtgtgctgtgttcctgctgaacccctggacagctggcatcatcgtgatggtgctggccctgatgacagtggagctgtttggcatgatgggcctgattggcatcaagctgtctgctgtgcctgtggtgatcctgattgcctctgtgggcattggagtggagttcaccgtgcacgtggccctggccttcctgacagccatcggggacaagaacagaagagctgtgctggccctggagcacatgtttgcccctgtgctggatggagctgtgtccaccctgctgggcgtgctgatgctggccggcagcgagtttgacttcatcgtgcgctacttctttgctgtgctggccatcctgaccatcctgggcgtgctgaatggcctggtgctgctgcctgtgctgctgtccttcttcggcccctacccagaggtgtccccagccaacggcctgaaccggctgcccacccccagccctgagcccccacccagcgtggtgcgctttgccatgcctcctggccacacccacagcggcagtgacagcagtgacagcgagtacagcagccagaccaccgtgtctggcctgtctgaggagctgcggcactatgaggcccagcagggcgctgggggccctgcccaccaggtgattgtggaggccacagaaaatcctgtgtttgcccacagcacagtggtgcaccctgagagccgccaccacccccccagcaacccccggcagcagccccacctggacagcggcagcctgcccccaggccggcagggccagcagccccggcgggaccccccccgggagggcctgtggcccccaccctaccggcccaggagagatgcctttgagatcagcacagagggccacagcggccccagcaacagagcccgctggggccccaggggggcccggagccacaaccccagaaatcctgccagcacagccatgggcagctctgtgcccggctactgccagcccatcaccaccgtgacagccagcgcctctgtgacagtggccgtgcaccccccacctgtgcccggccctggcaggaacccccggggcggcctgtgccccggctacccagagacagaccacggcctgtttgaggacccccacgtgcccttccacgtgcgctgtgaaagaagagacagcaaggtggaggtgattgagctgcaggatgtggagtgtgaggagcggccccggggcagcagcagcaactag

SEQ ID NO: 21017 - DNA, 3891 bp, Artificial Sequence; identical to SEQ ID NO: 21016
  Description of Artificial Sequence: Synthetic coding sequence

SEQ ID NO: 21018 - DNA, 3891 bp, Artificial Sequence; identical to SEQ ID NO: 21016
  Description of Artificial Sequence: Synthetic coding sequence

SEQ ID NO: 21019 - DNA, 4146 bp, Artificial Sequence
  Description of Artificial Sequence: Synthetic coding sequence
atgggcaaggccactggaaggaaggcccccctgtggctgcgggccaagttccagaggctgctcttcaagctgggctgctacatccagaagaactgtgggaagttcctggtggtgggcctgctgatctttggagcctttgctgtgggcctgaaggccgccaacctggagaccaacgtggaggagctgtgggtggaggtgggcggccgggtgtcccgggagctgaactacacccggcagaagattggagaggaggccatgttcaacccccagctgatgatccagacccccaaggaggagggcgccaacgtgctgaccacagaggccctgctgcagcacctggacagcgccctgcaggccagccgggtgcacgtgtacatgtacaaccggcagtggaagctggagcacctgtgctacaagagcggggagctgatcacagaaacaggctacatggaccagatcatcgagtacctgtacccctgcctgatcatcacccccctggactgcttctgggagggcgccaagctgcagagcggcacagcctacctgctgggcaagccacccctgcgctggaccaactttgaccccctggagttcctggaggagctgaagaagatcaactaccaggtggacagctgggaggagatgctgaacaaggccgaggtgggccacggctacatggaccggccctgcctgaacccagctgaccctgactgcccagccacagcccccaacaagaacagcaccaagcccctggacatggccctggtgctgaatggaggctgccacggcctgagcaggaagtacatgcactggcaggaggagctgattgtgggcggcaccgtgaagaacagcacaggcaagctggtgtctgcccacgccctgcagaccatgttccagctgatgacccccaagcagatgtatgagcacttcaagggctatgaatatgtgagccacatcaactggaatgaagacaaggctgctgccatcctggaggcctggcagaggacctacgtggaggtggtgcaccagagcgtggcccagaacagcacccagaaggtgctgtccttcaccaccaccaccctggatgacatcctgaagagcttcagtgatgtgtctgtcatccgggtggccagcggctacctgctgatgctggcctatgcctgcctgaccatgctgcgctgggactgcagcaagagccagggcgctgtgggcctggccggcgtgctgctggtggccctgtctgtggccgccggcctgggcctgtgcagcctgattggcatctccttcaatgctgccaccacccaggtgctgcccttcctggccctgggcgtgggcgtggatgatgtgttcctgctggcccacgccttcagcgagaccggccagaacaagaggatcccctttgaggacagaactggagaatgtctgaagaggactggagcctctgtggccctgaccagcatcagcaatgtgacagccttcttcatggccgccctgatccccatcccagccctgcgggccttcagcctgcaggccgctgtggtggtggtgttcaactttgccatggtgctgctgatcttccctgccatcctgtccatggacctgtaccgccgggaggaccggcggctggacatcttctgctgcttcaccagcccctgtgtgtccagggtcatccaggtggagccccaggcctacacagacacccatgacaacacccgctacagccccccaccaccctacagcagccacagctttgcccacgagacccagatcaccatgcagagcacagtgcagctgaggacagaatatgacccccacacccacgtgtactacaccacagctgagcccaggtctgagatctctgtgcagcctgtgacagtgacccaggacaccctgagctgccagagccctgagagcaccagcagcacccgggacctgctgagccagttcagtgacagcagcctgcactgcctggagcccccctgcaccaagtggaccctgagcagctttgctgagaagcactacgcccccttcctgctgaagcccaaggccaaggtggtggtgatcttcctgttcctgggcctgctgggcgtgtccctgtatggcaccaccagggtgagagatggcctggacctgacagacatcgtgccccgggagacccgggagtatgacttcatcgccgcccagttcaagtacttctccttctacaacatgtacatcgtgacccagaaggctgactaccccaacatccagcacctgctgtatgacctgcaccgctccttcagcaatgtgaagtatgtgatgctggaggagaacaagcagctgcccaagatgtggctgcactacttccgggactggctgcagggcctgcaggatgcctttgacagcgactgggagaccgggaagatcatgcccaacaactacaagaatggaagtgatgatggagtgctggcctacaagctgctggtgcagacaggcagccgggacaagcccatcgacatcagccagctgaccaagcagaggctggtggatgctgatggcatcatcaaccccagcgccttctacatctacctgacagcctgggtgtccaatgaccctgtggcctatgctgccagccaggccaacatccggccccacaggcctgagtgggtgcatgacaaggctgactacatgcctgagacccggctgcgcatcccagctgctgagcccattgaatatgcccagttccccttctacctgaatggcctgcgggacaccagtgactttgtggaggccatcgagaaggtgaggaccatctgcagcaactacaccagcctgggcctgagcagctacccaaatggctaccccttcctgttctgggagcagtacatcggcctgcggcactggctgctgctcttcatctctgtggtgctggcctgcaccttcctggtgtgtgctgtgttcctgctgaacccctggacagctggcatcatcgtgatggtgctggccctgatgacagtggagctgtttggcatgatgggcctcatcggcatcaagctgtctgctgtgcctgtggtgatcctgattgcctctgtgggcatcggcgtggagttcaccgtgcacgtggccctggccttcctgacagccatcggggacaagaacagaagagctgtgctggccctggagcacatgtttgcccctgtgctggatggagctgtgtccaccctgctgggcgtgctgatgctggccggcagcgagtttgacttcatcgtgcgctacttctttgctgtgctggccatcctgaccatcctgggcgtgctgaatggcctggtgctgctgcctgtgctgctgtccttcttcggcccctacccagaggtgtccccagccaacggcctgaaccggctgcccacccccagccctgagcccccaccttctgtggtgcgctttgccatgcctcctggccacacccacagcggcagtgacagcagtgacagcgagtacagcagccagaccaccgtgtctggcctgtctgaggagctgcggcactatgaggcccagcagggcgccggcggccctgcccaccaggtgattgtggaggccacagagaaccctgtgtttgcccacagcacagtggtgcaccctgagagccgccaccacccccccagcaacccccggcagcagccccacctggacagcggcagcctgcccccaggccggcagggccagcagccccggcgggaccccccccgggagggcctgtggcccccaccctaccggcccaggagagatgcctttgagatcagcacagagggccacagcggccccagcaacagagcccgctggggccccaggggggcccggagccacaaccccaggaacccagccagcacagccatgggcagctctgtgcccggctactgccagcccatcaccaccgtgacagccagcgcctctgtgacagtggccgtgcaccccccacctgtgcccggccctggaagaaacccccggggcggcctgtgccccggctacccagagacagaccacggcctgtttgaggacccccacgtgcccttccacgtgcgctgtgagcggcgggacagcaaggtggaggtgattgagctgcaggatgtggagtgtgaggagcggccccggggcagcagcagcaactag

SEQ ID NO: 21020 - DNA, 4146 bp, Artificial Sequence; identical to SEQ ID NO: 21019
  Description of Artificial Sequence: Synthetic coding sequence

SEQ ID NO: 21021 - DNA, 255 bp, Artificial Sequence
  Description of Artificial Sequence: Synthetic coding sequence
atgggcaaggccactggaaggaaggcccccctgtggctgcgggccaagttccagaggctgctcttcaagctgggctgctacatccagaagaactgtgggaagttcctggtggtgggcctgctgatctttggagcctttgctgtgggcctgaaggccgccaacctggagaccaacgtggaggagctgtgggtggaggaggtgaacctgctgtgtggcggccagaccagcaccctgtggaacagctggaagagctag

SEQ ID NO: 21022 - DNA, 525 bp, Artificial Sequence
  Description of Artificial Sequence: Synthetic coding sequence
atgttcaacccccagctgatgatccagacccccaaggaggagggcgccaacgtgctgaccacagaggccctgctgcagcacctggacagcgccctgcaggccagccgggtgcacgtgtacatgtacaaccggcagtggaagctggagcacctgtgctacaagtctggagagctgatcacagagaccggctacatggaccagatcatcgagtacctgtacccctgcctgatcatcacccccctggactgcttctgggagggcgccaagctgcagagcggcacagcctacctgctgggcaagccacccctgcgctggaccaactttgaccccctggagttcctggaggagctgaagaagatcaactaccaggtggacagctgggaggagatgctgaacaaggccgaggtgggccacggctacatggaccggccctgcctgaacccagctgaccctgactgcccagccacagcccccaacaagaacagcaccaagcccctggacatggccctggtgctgaatggatag

SEQ ID NO: 21023 - DNA, 525 bp, Artificial Sequence; identical to SEQ ID NO: 21022
  Description of Artificial Sequence: Synthetic coding sequence

SEQ ID NO: 21024 - DNA, 279 bp, Artificial Sequence
  Description of Artificial Sequence: Synthetic coding sequence
atgttcaacccccagctgatgatccagacccccaaggaggagggcgccaacgtgctgaccacagaggccctgctgcagcacctggacagcgccctgcaggccagccgggtgcacgtgtacatgtacaaccggcagtggaagctggagcacctgtgctacaagtctggagagctgatcacagagaccggctacatggaccagatcatcgagtacctgtacccctgcctgatcatcacccccctggactgcttctgggagggcgccaagctgcagagctag

SEQ ID NO: 21025 - DNA, 525 bp, Artificial Sequence; identical to SEQ ID NO: 21022
  Description of Artificial Sequence: Synthetic coding sequence

SEQ ID NO: 21026 - DNA, 525 bp, Artificial Sequence; identical to SEQ ID NO: 21022
  Description of Artificial Sequence: Synthetic coding sequence

SEQ ID NO: 21027 - DNA, 954 bp, Artificial Sequence
  Description of Artificial Sequence: Synthetic coding sequence
atgccccgggaggaccgggccacctggaagagcaactacttcctgaagatcatccagctgctggatgactaccccaagtgcttcatcgtgggcgctgacaacgtgggcagcaagcagatgcagcagatccgcatgagcctgcggggcaaggctgtggtgctgatgggcaagaacaccatgatgaggaaggccatccggggccacctggagaacaacccagccctggagaagctgctgccccacatcagaggaaatgtgggctttgtgttcaccaaggaggacctgacagagatccgggacatgctgctggccaacaaggtgcctgctgctgcccgggccggggccatcgccccctgtgaggtgacagtgcctgcccagaacacaggcctgggccctgagaagaccagcttcttccaggccctgggcatcaccaccaagatcagccggggcaccatcgagatcctgagtgatgtgcagctgatcaagacaggagacaaggtgggcgccagcgaggccaccctgctgaacatgctgaacatcagccccttctcctttggcctggtgatccagcaggtgtttgacaatggcagcatctacaaccctgaggtgctggacatcacagaggagaccctgcacagccgcttcctggagggcgtgagaaatgtggcctctgtgtgcctgcagatcggctaccccaccgtggcctctgtgccccacagcatcatcaatggctacaagagggtgctggccctgtctgtggagacagactacaccttccccctggccgagaaggtgaaggccttcctggccgaccccagcgcctttgtggccgccgcccctgtggccgccgccaccacagctgccccagctgctgctgctgccccagccaaggtggaggccaaggaggagagcgaggagagtgatgaggacatgggcttcggcctgtttgattag

SEQ ID NO: 21028 - DNA, 1818 bp, Artificial Sequence
  Description of Artificial Sequence: Synthetic coding sequence
atggatgacctggatgccctgctggccgacctggagagcaccaccagccacatcagcaagaggcctgtgttcctgtctgaggagaccccctacagctaccccactggaaaccacacctaccaggagattgctgtgcccccacctgtgcccccaccacccagcagcgaggccctgaatggcaccatcctggaccccctggaccagtggcagcccagcagcagccgcttcatccaccagcagccccagagcagcagccctgtgtatggcagcagcgccaagaccagctctgtgagcaacccccaggacagcgtgggcagcccctgcagccgggtgggggaggaggagcacgtgtacagcttccccaacaagcagaagtctgctgagcccagccccaccgtgatgagcaccagcctgggcagcaacctgtctgagctggaccggctgctgctggagctgaatgctgtgcagcacaaccccccaggcttcccagcagatgaggccaacagcagcccccccctgcccggggccctgagccccctgtatggagtgcctgagaccaacagccccctgggcggcaaggccggccccctgaccaaggagaagcccaagagaaatggaggccggggcctggaggatgtgcggcccagcgtggagagcctgctggatgagctggagagctctgtgcccagccctgtgcctgccatcaccgtgaaccagggcgagatgagcagcccccagagggtgaccagcacccagcagcagacccgcatcagcgccagcagcgccacccgggagctggatgagctgatggccagcctgagtgacttcaagggctcctggcccctggaggaggtggtgctgctggtgtccatcagcagctctgtgcaggagggggagaagtacccccacccctgtgccgcccggcacaggacccccagcctgcggagcccagaccagcccccaccctgcccccagttcatggcccagggcaagacaggcagcagcagccccccaggcggcccccccaagccaggcagccagctggacagcatgctgggcagcctgcagagcgacctgaacaagctgggcgtggccaccgtggccaagggcgtgtgtggggcctgcaagaagcccatcgccggccaggtggtgacagccatgggcaagacctggcaccctgagcactttgtgtgcacccactgccaggaggagatcggcagcaggaacttctttgaaagagatggccagccctactgtgagaaggactaccacaacctcttcagcccccgctgctactactgcaatggccccatcctggacaaggtggtgacagccctggacaggacctggcaccctgagcacttcttctgtgcccagtgtggggccttcttcggccctgagggcttccacgagaaggatggcaaggcctactgcaggaaggactactttgacatgtttgcccccaagtgtggcggctgtgcccgggccatcctggagaactacatcagcgccctgaacaccctgtggcaccctgagtgctttgtgtgccgggagtgcttcaccccatttgtgaatggcagcttctttgaacatgatggccagccctactgtgaggtgcactaccacgagcggcggggcagcctgtgcagcggctgccagaagcccatcaccggccgctgcatcacagccatggccaagaagttccaccctgagcactttgtgtgtgccttctgcctgaagcagctgaacaagggcaccttcaaggagcagaatgacaagccctactgccagaactgcttcctgaagctgttctgctag

SEQ ID NO: 21029 - DNA, 702 bp, Artificial Sequence
  Description of Artificial Sequence: Synthetic coding sequence
atgggcaagacctggcaccctgagcactttgtgtgcacccactgccaggaggagatcggcagcaggaacttctttgaaagagatggccagccctactgtgagaaggactaccacaacctcttcagcccccgctgctactactgcaatggccccatcctggacaaggtggtgacagccctggacaggacctggcaccctgagcacttcttctgtgcccagtgtggggccttcttcggccctgagggcttccacgagaaggatggcaaggcctactgcaggaaggactactttgacatgtttgcccccaagtgtggcggctgtgcccgggccatcctggagaactacatcagcgccctgaacaccctgtggcaccctgagtgctttgtgtgccgggagtgcttcaccccatttgtgaatggcagcttctttgaacatgatggccagccctactgtgaggtgcactaccacgagcggcggggcagcctgtgcagcggctgccagaagcccatcaccggccgctgcatcacagccatggccaagaagttccacccagacccctgcaccagccccaggacaggcctggccagcaccccccactggagccacctgttcctgatcttccagcagtgcagcagaggagctgggaagggccggcagggcctgctgggcagcctcttcatcctgatccccccacccacctag

SEQ ID NO: 21030 - DNA, 1212 bp, Artificial Sequence
  Description of Artificial Sequence: Synthetic coding sequence
atgtctgcccccagcagcacaggcccccagtactgccccggcctgcccagcaggaaggaggccaccccagagggccggcctgagacctgcctgctgcccagcagcccccaggcccagaggcccatccagggcctggagcagagagcagatggagagcgctgctgggccgccggctggcccagagatggcggccgcagcagccctgggggccaggatgagggcggcggctcctggcccctggaggaggtggtgctgctggtgtccatcagcagctctgtgcaggagggggagaagtacccccacccctgtgccgcccggcacaggacccccagcctgcggagcccagaccagcccccaccctgcccccagttcatggcccagggcaagacaggcagcagcagccccccaggcggcccccccaagccaggcagccagctggacagcatgctgggcagcctgcagagcgacctgaacaagctgggcgtggccaccgtggccaagggcgtgtgtggggcctgcaagaagcccatcgccggccaggtggtgacagccatgggcaagacctggcaccctgagcactttgtgtgcacccactgccaggaggagatcggcagcaggaacttctttgaaagagatggccagccctactgtgagaaggactaccacaacctcttcagcccccgctgctactactgcaatggccccatcctggacaaggtggtgacagccctggacaggacctggcaccctgagcacttcttctgtgcccagtgtggggccttcttcggccctgagggcttccacgagaaggatggcaaggcctactgcaggaaggactactttgacatgtttgcccccaagtgtggcggctgtgcccgggccatcctggagaactacatcagcgccctgaacaccctgtggcaccctgagtgctttgtgtgccgggagtgcttcaccccatttgtgaatggcagcttctttgaacatgatggccagccctactgtgaggtgcactaccacgagcggcggggcagcctgtgcagcggctgccagaagcccatcaccggccgctgcatcacagccatggccaagaagttccaccctgagcactttgtgtgtgccttctgcctgaagcagctgaacaagggcaccttcaaggagcagaatgacaagccctactgccagaactgcttcctgaagctgttctgctag

SEQ ID NO: 21031 - DNA, 1674 bp, Artificial Sequence
  Description of Artificial Sequence: Synthetic coding sequence
atggatgacctggatgccctgctggccgacctggagagcaccaccagccacatcagcaagaggcctgtgttcctgtctgaggagaccccctacagctaccccactggaaaccacacctaccaggagattgctgtgcccccacctgtgcccccaccacccagcagcgaggccctgaatggcaccatcctggaccccctggaccagtggcagcccagcagcagccgcttcatccaccagcagccccagagcagcagccctgtgtatggcagcagcgccaagaccagctctgtgagcaacccccaggacagcgtgggcagcccctgcagccgggtgggggaggaggagcacgtgtacagcttccccaacaagcagaagtctgctgagcccagccccaccgtgatgagcaccagcctgggcagcaacctgtctgagctggaccggctgctgctggagctgaatgctgtgcagcacaaccccccaggcttcccagcagatgaggccaacagcagcccccccctgcccggggccctgagccccctgtatggagtgcctgagaccaacagccccctgggcggcaaggccggccccctgaccaaggagaagcccaagagaaatggaggccggggcctggaggatgtgcggcccagcgtggagagcctgctggatgagctggagagctctgtgcccagccctgtgcctgccatcaccgtgaaccagggcgagatgagcagcccccagagggtgaccagcacccagcagcagacccgcatcagcgccagcagcgccacccgggagctggatgagctgatggccagcctgagtgacttcaagttcatggcccagggcaagacaggcagcagcagccccccaggcggcccccccaagccaggcagccagctggacagcatgctgggcagcctgcagagcgacctgaacaagctgggcgtggccaccgtggccaagggcgtgtgtggggcctgcaagaagcccatcgccggccaggtggtgacagccatgggcaagacctggcaccctgagcactttgtgtgcacccactgccaggaggagatcggcagcaggaacttctttgaaagagatggccagccctactgtgagaaggactaccacaacctcttcagcccccgctgctactactgcaatggccccatcctggacaaggtggtgacagccctggacaggacctggcaccctgagcacttcttctgtgcccagtgtggggccttcttcggccctgagggcttccacgagaaggatggcaaggcctactgcaggaaggactactttgacatgtttgcccccaagtgtggcggctgtgcccgggccatcctggagaactacatcagcgccctgaacaccctgtggcaccctgagtgctttgtgtgccgggagtgcttcaccccatttgtgaatggcagcttctttgaacatgatggccagccctactgtgaggtgcactaccacgagcggcggggcagcctgtgcagcggctgccagaagcccatcaccggccgctgcatcacagccatggccaagaagttccaccctgagcactttgtgtgtgccttctgcctgaagcagctgaacaagggcaccttcaaggagcagaatgacaagccctactgccagaactgcttcctgaagctgttctgctag

SEQ ID NO: 21032 - DNA, 1275 bp, Artificial Sequence
  Description of Artificial Sequence: Synthetic coding sequence
atgagcaccagcctgggcagcaacctgtctgagctggaccggctgctgctggagctgaatgctgtgcagcacaaccccccaggcttcccagcagatgaggccaacagcagcccccccctgcccggggccctgagccccctgtatggagtgcctgagaccaacagccccctgggcggcaaggccggccccctgaccaaggagaagcccaagagaaatggaggccggggcctggaggatgtgcggcccagcgtggagagcctgctggatgagctggagagctctgtgcccagccctgtgcctgccatcaccgtgaaccagggcgagatgagcagcccccagagggtgaccagcacccagcagcagacccgcatcagcgccagcagcgccacccgggagctggatgagctgatggccagcctgagtgacttcaagttcatggcccagggcaagacaggcagcagcagccccccaggcggcccccccaagccaggcagccagctggacagcatgctgggcagcctgcagagcgacctgaacaagctgggcgtggccaccgtggccaagggcgtgtgtggggcctgcaagaagcccatcgccggccaggtggtgacagccatgggcaagacctggcaccctgagcactttgtgtgcacccactgccaggaggagatcggcagcaggaacttctttgaaagagatggccagccctactgtgagaaggactaccacaacctcttcagcccccgctgctactactgcaatggccccatcctggacaaggtggtgacagccctggacaggacctggcaccctgagcacttcttctgtgcccagtgtggggccttctttggacctgagggcttccacgagaaggatggcaaggcctactgcaggaaggactactttgacatgtttgcccccaagtgtggcggctgtgcccgggccatcctggagaactacatcagcgccctgaacaccctgtggcacccagaatgttttgtgtgccgggagtgcttcaccccatttgtgaatggcagcttctttgaacatgatggccagccctactgtgaggtgcactaccatgaaagaagaggcagcctgtgcagcggctgccagaagcccatcaccggccgctgcatcacagccatggccaagaagttccaccctgagcactttgtgtgtgccttctgcctgaagcagctgaacaagggcaccttcaaggagcagaatgacaagccctactgccagaactgcttcctgaagctgttctgctag

SEQ ID NO: 21033 - DNA, 951 bp, Artificial Sequence
  Description of Artificial Sequence: Synthetic coding sequence
atgagcagcccccagagggtgaccagcacccagcagcagacccgcatcagcgccagcagcgccacccgggagctggatgagctgatggccagcctgagtgacttcaagttcatggcccagggcaagacaggcagcagcagccccccaggcggcccccccaagccaggcagccagctggacagcatgctgggcagcctgcagagcgacctgaacaagctgggcgtggccaccgtggccaagggcgtgtgtggggcctgcaagaagcccatcgccggccaggtggtgacagccatgggcaagacctggcaccctgagcactttgtgtgcacccactgccaggaggagatcggcagcaggaacttctttgaaagagatggccagccctactgtgagaaggactaccacaacctcttcagcccccgctgctactactgcaatggccccatcctggacaaggtggtgacagccctggacaggacctggcaccctgagcacttcttctgtgcccagtgtggggccttctttggacctgagggcttccacgagaaggatggcaaggcctactgcaggaaggactactttgacatgtttgcccccaagtgtggcggctgtgcccgggccatcctggagaactacatcagcgccctgaacaccctgtggcacccagaatgttttgtgtgccgggagtgcttcaccccatttgtgaatggcagcttctttgaacatgatggccagccctactgtgaggtgcactaccatgaaagaagaggcagcctgtgcagcggctgccagaagcccatcaccggccgctgcatcacagccatggccaagaagttccaccctgagcactttgtgtgtgccttctgcctgaagcagctgaacaagggcaccttcaaggagcagaatgacaagccctactgccagaactgcttcctgaagctgttctgctag

SEQ ID NO: 21034 - DNA, 993 bp, Artificial Sequence
  Description of Artificial Sequence: Synthetic coding sequence
atgccccacagcgtgaccctgcggggccccagcccctggggcttccggctggtgggcggccgggacttcagcgcccccctgaccatcagccgggtgcacgccggcagcaaggccgccctggccgccctgtgccctggggacctgatccaggccatcaatggagagagcacagagctgatgacccacctggaggcccagaaccgcatcaagggctgccacgaccacctgaccctgtctgtgtccaggcctgagggccgctcctggcccagcgccccagatgacagcaaggcccaggcccaccgcatccacatcgaccctgagatccaggacggcagccccaccaccagcagaagacccagcggcaccggcaccggcccagaagatggccggcccagcctgggcagcccctacggccagcccccacgcttccctgtgccccacaacggcagcagcgaggccaccctgcctgcccagatgagcaccctgcacgtgagccccccaccttctgctgaccctgcccggggcctgcccaggagccgggactgccgggtggacctgggcagcgaggtgtacaggatgctgcgggagcctgctgagcctgtggccgctgagcccaagcagagcggcagcttccgctacctgcagggcatgctggaggccggggagggcggggactggccaggccctgggggccccaggaacctgaagcccacagccagcaagctgggcgcccccctgagcggcctgcagggcctgcctgagtgcacccgctgtggccacggcatcgtgggcaccatcgtgaaggcccgggacaagctgtaccaccctgagtgcttcatgtgcagcgactgtggcctgaacctgaagcagaggggctacttcttcctggatgagcggctgtactgtgagagccacgccaaggcccgggtgaagcccccagagggctatgatgtggtggccgtgtacccaaatgccaaggtggagctggtgtag

SEQ ID NO: 21035 - DNA, 741 bp, Artificial Sequence
  Description of Artificial Sequence: Synthetic coding sequence
atgccccacagcgtgaccctgcggggccccagcccctggggcttccggctggtgggcggccgggacttcagcgcccccctgaccatcagccgggtgcacgccggcagcaaggccgccctggccgccctgtgccctggggacctgatccaggccatcaatggagagagcacagagctgatgacccacctggaggcccagaaccgcatcaagggctgccacgaccacctgaccctgtctgtgtccaggcctgagggccgctcctggcccagcgccccagatgacagcaaggcccaggcccaccgcatccacatcgaccctgagatccaggacggcagccccaccaccagcagaagacccagcggcaccggcaccggcccagaagatggccggcccagcctgggcagcccctacggccagcccccacgcttccctgtgccccacaacggcagcagcgaggccaccctgcctgcccagatgagcaccctgcacgtgagccccccaccttctgctgaccctgcccggggcctgcccaggagccgggactgccgggtggacctgggcagcgaggtgtacaggatgctgcgggagcctgctgagcctgtggccgctgagcccaagcagagcggcagcttccgctacctgcagggcatgctggaggccggggagggcggggcccccagcagccgccacggcaccagcagcaccatccccagcgccagctgtgctgtgacagctgcctag

SEQ ID NO: 21036 - DNA, 1791 bp, Artificial Sequence
  Description of Artificial Sequence: Synthetic coding sequence
atgagcaactacagcgtgtccctggtgggccctgccccctggggcttccggctgcagggcggcaaggacttcaacatgcccctgaccatcagcagcctgaaggatggcggcaaggccgcccaggccaacgtgagaattggagatgtggtgctgagcattgatggcatcaatgcccagggcatgacccacctggaggcccagaacaagatcaagggctgcaccggcagcctgaacatgaccctgcagagggccagcgctgcccccaagccagagcctgtgcctgtgcagaagggggagcccaaggaggtggtgaagcctgtgcccatcaccagccctgctgtgtccaaggtgaccagcaccaacaacatggcctacaacaaggccccccggcccttcggctctgtgagcagccccaaggtgaccagcatccccagccccagcagcgccttcaccccagcccacgccaccaccagcagccacgccagccccagccctgtggccgctgtgaccccacccctgtttgctgccagcggcctgcacgccaatgccaacctgtctgctgaccagagccccagcgccctgtctgctgggaagacagctgtgaatgtgccccggcagcccaccgtgacctctgtgtgcagcgagaccagccaggagctggccgagggccagaggcggggcagccagggcgacagcaagcagcagaatggcccccccaggaagcacatcgtggagcgctacacagagttctaccacgtgcccacccacagtgatgccagcaagaagaggctgattgaggacacagaggactggaggcccaggacaggcaccacccagagccgctccttccgcatcctggcccagatcaccggcacagagcacctgaaggagagcgaggccgacaacaccaagaaggccaacaacagccaggagcccagcccccagctggccagctctgtggccagcaccaggtccatgcctgagagcctggacagccccaccagcggccggcctggggtgaccagcctgacagctgctgctgccttcaagcctgtgggcagcactggagtcatcaagagccccagctggcagaggcccaaccagggcgtgcccagcacaggccgcatcagcaacagcgccacctacagcggctctgtggccccagccaacagcgccctgggccagacccagcccagcgaccaggacaccctggtgcagagagctgagcacatcccagctgggaagaggacccccatgtgtgcccactgcaaccaggtgatccggggccccttcctggtggccctgggcaagtcctggcaccctgaggagttcaactgtgcccactgcaagaacaccatggcctacatcggctttgtggaggagaagggggccctgtactgtgagctgtgctatgagaagttctttgccccagaatgtggccgctgccagaggaagatcctgggggaggtgatcagcgccctgaagcagacctggcacgtgtcctgctttgtgtgtgtggcctgtgggaagcccatcagaaataatgtgttccacctggaggatggagagccctactgtgaaacagactactatgccctgtttggcaccatctgccacggctgtgagttccccattgaagctggggacatgttcctggaggccctgggctacacctggcatgacacctgctttgtgtgcagcgtgtgctgtgagagcctggagggccagaccttcttcagcaagaaggacaagcccctgtgcaagaagcacgcccacagcgtgaacttctag

SEQ ID NO: 21037 - DNA, 645 bp, Artificial Sequence
  Description of Artificial Sequence: Synthetic coding sequence
atgagcaactacagcgtgtccctggtgggccctgccccctggggcttccggctgcagggcggcaaggacttcaacatgcccctgaccatcagcagcctgaaggatggcggcaaggccgcccaggccaacgtgagaattggagatgtggtgctgagcattgatggcatcaatgcccagggcatgacccacctggaggcccagaacaagatcaagggctgcaccggcagcctgaacatgaccctgcagagggccagcgctgcccccaagccagagcctgtgcctgtgcagaagaagacccaggtgaccaacaaccctggcaccgtgaagatcccccccaagaggcctcccaggaagcacatcgtggagcgctacacagagttctaccacgtgcccacccacagtgatgccagcaagaagaggctgattgaggacacagaggactggaggcccaggacaggcaccacccagagccgctccttccgcatcctggcccagatcactggaacagagcacctgaaggagagcgaggccgacaacaccaagaaggccaaggagaagatccccctgcacgtgttcagccccaagtacaccaagctgcgggactggcaccacgaggtgtctgcccgggccctgaatgtgcagtag

SEQ ID NO: 21038 - DNA, 705 bp, Artificial Sequence
  Description of Artificial Sequence: Synthetic coding sequence
atgagcaactacagcgtgtccctggtgggccctgccccctggggcttccggctgcagggcggcaaggacttcaacatgcccctgaccatcagcagcctgaaggatggcggcaaggccgcccaggccaacgtgagaattggagatgtggtgctgagcattgatggcatcaatgcccagggcatgacccacctggaggcccagaacaagatcaagggctgcaccggcagcctgaacatgaccctgcagagggccagcgctgcccccaagccagagcctgtgcctgtgcagaagcccaccgtgacctctgtgtgcagcgagaccagccaggagctggccgagggccagaggcggggcagccagggcgacagcaagcagcagaatggcaagatcccccccaagaggcctcccaggaagcacatcgtggagcgctacacagagttctaccacgtgcccacccacagtgatgccagcaagaagaggctgattgaggacacagaggactggaggcccaggacaggcaccacccagagccgctccttccgcatcctggcccagatcactggaacagagcacctgaaggagagcgaggccgacaacaccaagaaggccaaggagaagatccccctgcacgtgttcagccccaagtacaccaagctgcgggactggcaccacgaggtgtctgcccgggccctgaatgtgcagtag

SEQ ID NO: 21039 - DNA, 1464 bp, Artificial Sequence
  Description of Artificial Sequence: Synthetic coding sequence
atgagcaactacagcgtgtccctggtgggccctgccccctggggcttccggctgcagggcggcaaggacttcaacatgcccctgaccatcagcagcctgaaggatggcggcaaggccgcccaggccaacgtgagaattggagatgtggtgctgagcattgatggcatcaatgcccagggcatgacccacctggaggcccagaacaagatcaagggctgcaccggcagcctgaacatgaccctgcagagggccagcgctgcccccaagccagagcctgtgcctgtgcagaagcccaccgtgacctctgtgtgcagcgagaccagccaggagctggccgagggccagaggcggggcagccagggcgacagcaagcagcagaatggaccacccaggaagcacatcgtggagcgctacacagagttctaccacgtgcccacccacagtgatgccagcaagaagaggctgattgaggacacagaggactggaggcccaggacaggcaccacccagagccgctccttccgcatcctggcccagatcactggaacagagcacctgaaggagagcgaggccgacaacaccaagaaggccaacaacagccaggagcccagcccccagctggccagctctgtggccagcaccaggtccatgcctgagagcctggacagccccaccagcggccggcctggggtgaccagcctgacagctgctgctgccttcaagcctgtgggcagcactggagtcatcaagagccccagctggcagaggcccaaccagggcgtgcccagcacaggccgcatcagcaacagcgccacctacagcggctctgtggccccagccaacagcgccctgggccagacccagcccagcgaccaggacaccctggtgcagagagctgagcacatcccagctgggaagaggacccccatgtgtgcccactgcaaccaggtgatccggggccccttcctggtggccctgggcaagtcctggcaccctgaggagttcaactgtgcccactgcaagaacaccatggcctacatcggctttgtggaggagaagggggccctgtactgtgagctgtgctatgagaagttctttgccccagaatgtggccgctgccagaggaagatcctgggggaggtgatcagcgccctgaagcagacctggcacgtgtcctgctttgtgtgtgtggcctgtgggaagcccatccggaacaacgtgttccacctggaggatggagagccctactgtgaaacagactactatgccctgtttggcaccatctgccacggctgtgagttccccatcgaggccggggacatgttcctggaggccctgggctacacctggcatgacacctgctttgtgtgcagcgtgtgctgtgagagcctggagggccagaccttcttcagcaagaaggacaagcccctgtgcaagaagcacgcccacagcgtgaacttctag

SEQ ID NO: 21040 - DNA, 705 bp, Artificial Sequence
  Description of Artificial Sequence: Synthetic coding sequence
atgagcaactacagcgtgtccctggtgggccctgccccctggggcttccggctgcagggcggcaaggacttcaacatgcccctgaccatcagcagcctgaaggatggcggcaaggccgcccaggccaacgtgagaattggagatgtggtgctgagcattgatggcatcaatgcccagggcatgacccacctggaggcccagaacaagatcaagggctgcaccggcagcctgaacatgaccctgcagagggccagcgctgcccccaagccagagcctgtgcctgtgcagaagcccaccgtgacctctgtgtgcagcgagaccagccaggagctggccgagggccagaggcggggcagccagggcgacagcaagcagcagaatggacctgtgcccaggaagatcccccccaggaagcacatcgtggagcgctacacagagttctaccacgtgcccacccacagtgatgccagcaagaagaggctgattgaggacacagaggactggaggcccaggacaggcaccacccagagccgctccttccgcatcctggcccagatcactggaacagagcacctgaaggagagcgaggccgacaacaccaagaaggccaaggagaagatccccctgcacgtgttcagccccaagtacaccaagctgcgggactggcaccacgaggtgtctgcccgggccctgaatgtgcagtag

SEQ ID NO: 21041 - DNA, 645 bp, Artificial Sequence
  Description of Artificial Sequence: Synthetic coding sequence
atgagcaactacagcgtgtccctggtgggccctgccccctggggcttccggctgcagggcggcaaggacttcaacatgcccctgaccatcagcagcctgaaggatggcggcaaggccgcccaggccaacgtgagaattggagatgtggtgctgagcattgatggcatcaatgcccagggcatgacccacctggaggcccagaacaagatcaagggctgcaccggcagcctgaacatgaccctgcagagggccagcgctgcccccaagccagagcctgtgcctgtgcagaaggtgacccagaagcgggagagccgcagcagcagaagaacagcccctggcctgccccccaggaagcacatcgtggagcgctacacagagttctaccacgtgcccacccacagtgatgccagcaagaagaggctgattgaggacacagaggactggaggcccaggacaggcaccacccagagccgctccttccgcatcctggcccagatcactggaacagagcacctgaaggagagcgaggccgacaacaccaagaaggccaaggagaagatccccctgcacgtgttcagccccaagtacaccaagctgcgggactggcaccacgaggtgtctgcccgggccctgaatgtgcagtag

SEQ ID NO: 21042 - DNA, 1425 bp, Artificial Sequence
  Description of Artificial Sequence: Synthetic coding sequence
atggcctacaacaaggccccccggcccttcggctctgtgagcagccccaaggtgaccagcatccccagccccagcagcgccttcaccccagcccacgccaccaccagcagccacgccagccccagccctgtggccgctgtgaccccacccctgtttgctgccagcggcctgcacgccaatgccaacctgtctgctgaccagagccccagcgccctgtctgctgggaagacagctgtgaatgtgccccggcagcccaccgtgacctctgtgtgcagcgagaccagccaggagctggccgagggccagaggcggggcagccagggcgacagcaagcagcagaatggcccccccaggaagcacatcgtggagcgctacacagagttctaccacgtgcccacccacagtgatgccagcaagaagaggctgattgaggacacagaggactggaggcccaggacaggcaccacccagagccgctccttccgcatcctggcccagatcaccggcacagagcacctgaaggagagcgaggccgacaacaccaagaaggccaacaacagccaggagcccagcccccagctggccagctctgtggccagcaccaggtccatgcctgagagcctggacagccccaccagcggccggcctggggtgaccagcctgacagctgctgctgccttcaagcctgtgggcagcactggagtcatcaagagccccagctggcagaggcccaaccagggcgtgcccagcacaggccgcatcagcaacagcgccacctacagcggctctgtggccccagccaacagcgccctgggccagacccagcccagcgaccaggacaccctggtgcagagagctgagcacatcccagctgggaagaggacccccatgtgtgcccactgcaaccaggtgatccggggccccttcctggtggccctgggcaagtcctggcaccctgaggagttcaactgtgcccactgcaagaacaccatggcctacatcggctttgtggaggagaagggggccctgtactgtgagctgtgctatgagaagttctttgccccagaatgtggccgctgccagaggaagatcctgggggaggtgatcagcgccctgaagcagacctggcacgtgtcctgctttgtgtgtgtggcctgtgggaagcccatcagaaataatgtgttccacctggaggatggagagccctactgtgaaacagactactatgccctgtttggcaccatctgccacggctgtgagttccccattgaagctggggacatgttcctggaggccctgggctacacctggcatgacacctgctttgtgtgcagcgtgtgctgtgagagcctggagggccagaccttcttcagcaagaaggacaagcccctgtgcaagaagcacgcccacagcgtgaacttctag

SEQ ID NO: 21043 - DNA, 411 bp, Artificial Sequence
  Description of Artificial Sequence: Synthetic coding sequence
atgagcaactacagcgtgtccctggtgggccctgccccctggggcttccggctgcagggcggcaaggacttcaacatgcccctgaccatcagcagcgctggggtgcagtggaggaacctgggcagcccccagccccccagccctgagttcaagcgcttcagctgcctgagcctgcccagctcctgggactaccgccacgtgcccccccggctggccaactttgtgttcctggtggagaccaagttcccctacgtgggccaggccggcctggagctgcccaccagcggggacctgcccaccagcgccagccagagcgccaagatcactggagtgagccaccgggcctggcccaccctcttctacaccctgctcttctttgccaccatctacccagagatcatcctgtactag

SEQ ID NO: 21044 - DNA, 669 bp, Artificial Sequence
  Description of Artificial Sequence: Synthetic coding sequence
atggacagcttcaaggtggtgctggagggccctgccccctggggcttccggctgcagggcggcaaggacttcaacgtgcccctgagcatcagccggctgaccccaggcggcaaggccgcccaggccggcgtggccgtgggggactgggtgctgagcattgatggagaaaatgccggcagcctgacccacatcgaggcccagaacaagatccgggcctgtggggagcggctgagcctgggcctgagccgggcccagcctgtgcagagcaagccccagaaggccagcgccccagctgctgaccccccacgctacacctttgcccccagcgtgtccctgaacaagacagcccggccctttggagcccctcctcctgctgacagcgccccccagcagaatggccagcccctgcggcccctggtgcctgatgccagcaagcagaggctgatggagaacacagaggactggaggcccaggcctggcaccggccagagccgctccttccgcatcctggcccacctgaccggcacagagttcatgcaggaccctgatgaggagcacctgaagaagagccgggagaagtatgtgctggagctgcagagcccccgctacacccggctgcgggactggcaccaccagaggtctgcccacgtgctgaatgtgcagagctag

SEQ ID NO: 21045 - DNA, 1374 bp, Artificial Sequence
  Description of Artificial Sequence: Synthetic coding sequence
atggacagcttcaaggtggtgctggagggccctgccccctggggcttccggctgcagggcggcaaggacttcaacgtgcccctgagcatcagccggctgaccccaggcggcaaggccgcccaggccggcgtggccgtgggggactgggtgctgagcattgatggagaaaatgccggcagcctgacccacatcgaggcccagaacaagatccgggcctgtggggagcggctgagcctgggcctgagccgggcccagcctgtgcagagcaagccccagaaggccagcgccccagctgctgaccccccacgctacacctttgcccccagcgtgtccctgaacaagacagcccggccctttggagcccctcctcctgctgacagcgccccccagcagaatggccagcccctgcggcccctggtgcctgatgccagcaagcagaggctgatggagaacacagaggactggaggcccaggcctggcaccggccagagccgctccttccgcatcctggcccacctgaccggcacagagttcatgcaggaccctgatgaggagcacctgaagaagagcagccaggtgcccaggacagaggccccagccccagccagcagcaccccccaggagccctggccaggccccacagcccccagccccaccagccggcccccctgggccgtggaccctgcctttgctgagagatatgccccagacaagaccagcacagtgctgaccaggcacagccagcctgccacccccacccccctgcagagcaggaccagcatcgtgcaggccgccgccggcggcgtgcctgggggcggcagcaacaacgggaagacccctgtgtgccaccagtgccacaaggtgatccggggccgctacctggtggccctgggccacgcctaccaccctgaggagtttgtgtgcagccagtgtgggaaggtgctggaggagggcggcttctttgaggagaagggggccatcttctgccccccctgctatgatgtgcgctatgcccccagctgtgccaagtgcaagaagaagatcactggagagatcatgcacgccctgaagatgacctggcacgtgcactgcttcacctgtgccgcctgcaagacccccatccggaacagagccttctacatggaggagggcgtgccctactgtgagcgggactatgagaagatgtttggcaccaagtgccacggctgtgacttcaagattgatgctggggaccgcttcctggaggccctgggcttctcctggcatgacacctgctttgtgtgtgccatctgccagatcaacctggagggcaagaccttctacagcaagaaggaccggcccctgtgcaagagccacgccttcagccacgtgtag

SEQ ID NO: 21046 - DNA, 864 bp, Artificial Sequence
  Description of Artificial Sequence: Synthetic coding sequence
atggacagcttcaaggtggtgctggagggccctgccccctggggcttccggctgcagggcggcaaggacttcaacgtgcccctgagcatcagccggctgaccccaggcggcaaggccgcccaggccggcgtggccgtgggggactgggtgctgagcattgatggagaaaatgccggcagcctgacccacatcgaggcccagaacaagatccgggcctgtggggagcggctgagcctgggcctgagccgggcccagcctgtgcagagcaagccccagaaggccagcgccccagctgctgaccccccacgctacacctttgcccccagcgtgtccctgaacaagacagcccggccctttggagcccctcctcctgctgacagcgccccccagcagaatggccagcccctgcggcccctggtgcctgatgccagcaagcagaggctgatggagaacacagaggactggaggcccaggcctggcaccggccagagccgctccttccgcatcctggcccacctgaccggcacagagttcatgcaggaccctgatgaggagcacctgaagaagagccggccctaccggccccagccctaccagcccccagccctgggctgcggcccctgtgtgtgccgggccctgtgccccggccagaatgagcacagcgctgaccctgcccagcctgctggccacgcccatgctgctgctgagccccacctgcactgtgccggcagctgccggcggggggcccggcggggccagcagcagaggcaggacagccgggtgtcccctgtgccccagggccaccctggccccctgcctggaggagctggcccccgggtgcccccaggcggcgtgtgtgtgtag

SEQ ID NO: 21047 - DNA, 1272 bp, Artificial Sequence
  Description of Artificial Sequence: Synthetic coding sequence
atggacagcttcaaggtggtgctggagggccctgccccctggggcttccggctgcagggcggcaaggacttcaacgtgcccctgagcatcagccggctgaccccaggcggcaaggccgcccaggccggcgtggccgtgggggactgggtgctgagcattgatggagaaaatgccggcagcctgacccacatcgaggcccagaacaagatccgggcctgtggggagcggctgagcctgggcctgagccgggcccagcctgtgcagagcaagccccagaaggtgcagaccccagacaagcagcccctgcggcccctggtgcctgatgccagcaagcagaggctgatggagaacacagaggactggaggcccaggcctggcaccggccagagccgctccttccgcatcctggcccacctgaccggcacagagttcatgcaggaccctgatgaggagcacctgaagaagagcagccaggtgcccaggacagaggccccagccccagccagcagcaccccccaggagccctggccaggccccacagcccccagccccaccagccggcccccctgggccgtggaccctgcctttgctgagagatatgccccagacaagaccagcacagtgctgaccaggcacagccagcctgccacccccacccccctgcagagcaggaccagcatcgtgcaggccgccgccggcggcgtgcctgggggcggcagcaacaacgggaagacccctgtgtgccaccagtgccacaaggtgatccggggccgctacctggtggccctgggccacgcctaccaccctgaggagtttgtgtgcagccagtgtgggaaggtgctggaggagggcggcttctttgaggagaagggggccatcttctgccccccctgctatgatgtgcgctatgcccccagctgtgccaagtgcaagaagaagatcactggagagatcatgcacgccctgaagatgacctggcacgtgcactgcttcacctgtgccgcctgcaagacccccatccggaacagagccttctacatggaggagggcgtgccctactgtgagcgggactatgagaagatgtttggcaccaagtgccacggctgtgacttcaagattgatgctggggaccgcttcctggaggccctgggcttctcctggcatgacacctgctttgtgtgtgccatctgccagatcaacctggagggcaagaccttctacagcaagaaggaccggcccctgtgcaagagccacgccttcagccacgtgtag

SEQ ID NO: 21048 - DNA, 522 bp, Artificial Sequence
  Description of Artificial Sequence: Synthetic coding sequence
atggacagcttcaaggtggtgctggagggccctgccccctggggcttccggctgcagggcggcaaggacttcaacgtgcccctgagcatcagccggctgaccccaggcggcaaggccgcccaggccggcgtggccgtgggggactgggtgctgagcattgatggagaaaatgccggcagcctgacccacatcgaggcccagaacaagatccgggcctgtggggagcggctgagcctgggcctgagccgggcccagcctgtgcagagcaagccccagaaggccagcgccccagctgctgaccccccacgctacacctttgcccccagcgtgtccctgaacaagacagcccggccctttggagcccctcctcctgctgacagcgccccccagcagaatggccagcccctgcggcccctggtgcctgatgccagcaagcagaggctgatggagaacacagaggactggaggcccaggcctggcaccggccagagccgctccttccgcatcctggcccacctgtag

SEQ ID NO: 21049 - DNA, 273 bp, Artificial Sequence
  Description of Artificial Sequence: Synthetic coding sequence
atggacagcttcaaggtggtgctggagggccctgccccctggggcttccggctgcagggcggcaaggacttcaacgtgcccctgagcatcagccggctgaccccaggcggcaaggccgcccaggccggcgtggccgtgggggactgggtgctgagcattgatggagaaaatgccggcagcctgacccacatcgaggcccagaacaagatccgggcctgtggggagcggctgagcctgggcctgagccgggcccagcctgtgcagagcaagtag

SEQ ID NO: 21050 - DNA, 492 bp, Artificial Sequence
  Description of Artificial Sequence: Synthetic coding sequence
atggctgatgaggagaagctgcccccaggctgggagaagaggatgagccgcagcagcggccgggtgtactacttcaaccacatcaccaatgccagccagtgggagcggcccagcggcaacagcagcagcggcggcaagaatggccagggcgagcccgcccgggtgcgctgcagccacctgctggtgaagcacagccagagccggcggcccagctcctggaggcaggagaagatcaccaggaccaaggaggaggccctggagctgatcaatggctacatccagaagatcaagagcggggaggaggactttgagagcctggccagccagttcagtgactgcagcagcgccaaggcccggggggacctgggcgccttcagccggggccagatgcagaagccctttgaagatgccagctttgccctgaggactggagagatgagcggccctgtgttcacagacagcggcatccacatcatcctgaggacagaatag

SEQ ID NO: 21051 - DNA, 138 bp, Artificial Sequence
  Description of Artificial Sequence: Synthetic coding sequence
atgcagaagccctttgaagatgccagctttgccctgaggactggagagatgagcggccctgtgttcacagattctggcatccacatcatcctgaggacagagtgctggaggcagacccggggccccaactgcttctag

SEQ ID NO: 21052 - DNA, 438 bp, Artificial Sequence
  Description of Artificial Sequence: Synthetic coding sequence
atggctgatgaggagaagctgcccccaggctgggagaagaggatgagccgcagcagcggccgggtgtactacttcaaccacatcaccaatgccagccagtgggagcggcccagcggcaacagcagcagcggcggcaagaatggccagggcgagcccgcccgggtgcgctgcagccacctgctggtgaagcacagccagagccggcggcccagctcctggaggcaggagaagatcaccaggaccaaggaggaggccctggagctgatcaatggctacatccagaagatcaagagcggggaggaggactttgagagcctggccagccagttcagtgactgcagcagcgccaaggcccggggggacctgggcgccttcagcagaggagcccagggcatgggcctgacccggctgggggacccctaccaccctgagggctag

SEQ ID NO: 21053 - DNA, 561 bp, Artificial Sequence
  Description of Artificial Sequence: Synthetic coding sequence
atgaccatggtggacacagagatgcccttctggcccaccaactttggcatcagctctgtggacctgtctgtgatggaggaccacagccacagctttgacatcaagcccttcaccaccgtggacttcagcagcatcagcaccccccactatgaggacatccccttcaccaggacagatcctgtggtggccgactacaagtatgacctgaagctgcaggagtaccagagcgccatcaaggtggagcccgccagccccccctactacagcgagaagacccagctgtacaacaagccccatgaggagcccagcaacagcctgatggccatcgagtgccgggtgtgtggggacaaggccagcggcttccactatggagtgcacgcctgtgagggctgcaagggcttcttccggaggaccatccggctgaagctgatctatgacagatgtgacctgaactgccgcatccacaagaagagcaggaacaagtgccagtactgccgcttccagaagtgcctggccgtgggcatgagccacaatgaggagctgcagaaggacagctactag

SEQ ID NO: 21054 - DNA, 1752 bp, Artificial Sequence
  Description of Artificial Sequence: Synthetic coding sequence
atgggcggcctggagaagaagaagtatgagcggggcagcgccaccaactacatcaccaggaacaaggccaggaagaagctgcagctgagcctggccgacttccggcggctgtgcatcctgaagggcatctacccccatgagcccaagcacaagaagaaggtgaacaagggcagcacagctgcccggaccttctacctgatcaaggacatccgcttcctgctgcacgagcccatcgtgaacaagttccgggagtacaaggtgtttgtgaggaagctgaggaaggcctacggcaagtctgagtggaacacagtggagcggctgaaggacaacaagcccaactacaagctggaccacatcatcaaggagcgctaccccaccttcattgatgccctgcgggacctggatgatgccctgtccatgtgcttcctgttcagcaccttccccaggacaggcaagtgccacgtgcagaccatccagctgtgccggcggctgactgtggagttcatgcactacatcatcgccgcccgggccctgaggaaggtgttcctgagcatcaagggcatctactaccaggccgaggtgctgggccagcccatcgtgtggatcaccccctatgccttcagccatgaccaccccacagatgtggactacagagtgatggccaccttcacagagttctacaccaccctgctgggctttgtgaacttccggctgtaccagctgctgaacctgcactacccacccaagctggagggccaggcccaggccgaggccaaggccggggagggcacctacgccctggacagcgagagctgcatggagaagctggccgccctgagcgccagcctggcccgggtggtggtgcctgccacagaggaggaggccgaggtggatgagttccccacagatggagaggaggacaggaggaaggagctggaggcccaggagaagcacaagaagctgtttgagggcctgaagttcttcctgaaccgggaggtgccccgggaggccctggccttcatcatccgcagctttggaggagaggtgtcctgggacaagagcctgtgcattggagccacctatgatgtgacagacagccgcatcacccaccagatcgtggaccggcccggccagcagacctctgtgattggccgctgctacgtgcagccccagtgggtgtttgacagcgtgaatgcccggctgctgctgcctgtggccgagtacttcagcggcgtgcagctgcccccccacctgagcccctttgtgacagagaaggagggggactatgtgcccccagagaagctgaagctgctggccctgcagagaggagaggaccccggcaacctgaatgaaagtgaggaggaggaggaggaggatgacaacaatgaaggagatggagatgaggagggagaaaatgaggaggaggaggaggatgctgaggccggcagcgagaaggaggaggaggcccggctggccgccctggaggagcagaggatggagggcaagaagccccgggtgatggccggcaccctgaagctggaggacaagcagaggctggcccaggaggaggagagcgaggccaagaggctggccatcatgatgatgaagaagcgggagaagtacctgtaccagaagatcatgtttgggaagaggaggaagatccgggaggccaacaagctggccgagaagaggaaggcccatgatgaggccgtgcgctctgagaagaaggccaagaaggcccggcctgagtag

SEQ ID NO: 21055 - DNA, 1767 bp, Artificial Sequence
  Description of Artificial Sequence: Synthetic coding sequence
atgggcggcctggagaagaagaagtatgagcggggcagcgccaccaactacatcaccaggaacaaggccaggaagaagctgcagctgagcctggccgacttccggcggctgtgcatcctgaagggcatctacccccatgagcccaagcacaagaagaaggtgaacaagggcagcacagctgcccggaccttctacctgatcaaggacatccgcttcctgctgcacgagcccatcgtgaacaagttccgggagtacaaggtgtttgtgaggaagctgaggaaggcctacggcaagtctgagtggaacacagtggagcggctgaaggacaacaagcccaactacaagctggaccacatcatcaaggagcgctaccccaccttcattgatgccctgcgggacctggatgatgccctgtccatgtgcttcctgttcagcaccttccccaggacaggcaagtgccacgtgcagaccatccagctgtgccggcggctgactgtggagttcatgcactacatcatcgccgcccgggccctgaggaaggtgttcctgagcatcaagggcatctactaccaggccgaggtgctgggccagcccatcgtgtggatcaccccctatgccttcagccatgaccaccccacagatgtggactacagagtgatggccaccttcacagagttctacaccaccctgctgggctttgtgaacttccggctgtaccagctgctgaacctgcactacccacccaagctggagggccaggcccaggccgaggccaaggccggggagggcacctacgccctggacagcgagagctgcatggagaagctggccgccctgagcgccagcctggcccgggtggtggtgcctgccacagaggaggaggccgaggtggatgagttccccacagatggagagatgtctgcccaggaggaggacaggaggaaggagctggaggcccaggagaagcacaagaagctgtttgagggcctgaagttcttcctgaaccgggaggtgccccgggaggccctggccttcatcatccgcagctttggaggagaggtgtcctgggacaagagcctgtgcatcggggccacctatgatgtgacagacagccgcatcacccaccagatcgtggacaggcctggccagcagaccagcgtcatcggccgctgctacgtgcagccccagtgggtgtttgattctgtgaatgcccggctgctgctgcctgtggccgagtacttctctggagtgcagctgcccccccacctgagcccctttgtgacagagaaggagggggactatgtgcccccagagaagctgaagctgctggccctgcagagaggagaagatcctggcaacctgaatgaaagtgaggaggaggaggaggaggatgacaacaatgaaggagatggagatgaggagggggagaatgaggaggaggaggaggatgctgaggccggcagcgagaaggaggaggaggcccggctggccgccctggaggagcagaggatggagggcaagaagccccgggtgatggccggcaccctgaagctggaggacaagcagaggctggcccaggaggaggagagcgaggccaagaggctggccatcatgatgatgaagaagcgggagaagtacctgtaccagaagatcatgtttgggaagaggaggaagatccgggaggccaacaagctggccgagaagaggaaggcccatgatgaagctgtgcgctctgagaagaaggccaagaaggcccggcctgagtag

SEQ ID NO: 21056 - DNA, 1350 bp, Artificial Sequence
  Description of Artificial Sequence: Synthetic coding sequence
atgtgcttcctgttcagcaccttccccaggactggaaaatgtcatgtgcagaccatccagctgtgccggcggctgactgtggagttcatgcactacatcatcgccgcccgggccctgaggaaggtgttcctgagcatcaagggcatctactaccaggccgaggtgctgggccagcccatcgtgtggatcaccccctatgccttcagccatgaccaccccacagatgtggactacagagtgatggccaccttcacagagttctacaccaccctgctgggctttgtgaacttccggctgtaccagctgctgaacctgcactacccacccaagctggagggccaggcccaggccgaggccaaggccggggagggcacctacgccctggacagcgagagctgcatggagaagctggccgccctgagcgccagcctggcccgggtggtggtgcctgccacagaggaggaggccgaggtggatgagttccccacagatggagagatgtctgcccaggaggaggacaggaggaaggagctggaggcccaggagaagcacaagaagctgtttgagggcctgaagttcttcctgaaccgggaggtgccccgggaggccctggccttcatcatccgcagctttggaggagaggtgtcctgggacaagagcctgtgcattggagccacctatgatgtgacagacagccgcatcacccaccagatcgtggaccggcccggccagcagacctctgtgattggccgctgctacgtgcagccccagtgggtgtttgacagcgtgaatgcccggctgctgctgcctgtggccgagtacttcagcggcgtgcagctgcccccccacctgagcccctttgtgacagagaaggagggggactatgtgcccccagagaagctgaagctgctggccctgcagagaggagaggaccccggcaacctgaatgaaagtgaggaggaggaggaggaggatgacaacaatgaaggagatggagatgaggagggagaaaatgaggaggaggaggaggatgctgaggccggcagcgagaaggaggaggaggcccggctggccgccctggaggagcagaggatggagggcaagaagccccgggtgatggccggcaccctgaagctggaggacaagcagaggctggcccaggaggaggagagcgaggccaagaggctggccatcatgatgatgaagaagcgggagaagtacctgtaccagaagatcatgtttgggaagaggaggaagatccgggaggccaacaagctggccgagaagaggaaggcccatgatgaggccgtgcgctctgagaagaaggccaagaaggcccggcctgagtag

SEQ ID NO: 21057 - DNA, 1350 bp, Artificial Sequence; identical to SEQ ID NO: 21056
  Description of Artificial Sequence: Synthetic coding sequence

SEQ ID NO: 21058 - DNA, 5154 bp, Artificial Sequence
  Description of Artificial Sequence: Synthetic coding sequence
atggagcctgctgctgctgccaccgtgcagaggctgcctgagctgggccgggaggaccgggccagcgccccagctgctgctgctgctgctgctgctgctgctgctgctgctgctgctgccctggccgctgctgctgggggcggccgcagccctgagcccgccctgaccccagctgcccccagcggcggcaatggcagcggcagcggggcccgggaggaggcccctggagaggcccctcctggccccctgcccggccgggccggcggggccggcagaagaagaagaagaggagccccccagcccatcgccggcggggccgcccctgtgcctggggccggcggcggggccaacagcctgctgctgcggcggggccgcctgaagaggaacctgtctgctgctgctgctgctgccagcagcagcagcagcagcagcgctgctgctgccagccacagccctggagctgctggcctgcctgccagctgcagcgccagcgccagcctgtgcaccaggagcctggacaggaagaccctgctgctgaagcaccggcagaccctgcagctgcagcccagcgaccgggactgggtgcgccaccagctgcagaggggctgtgtgcacgtgtttgacagacacatggccagcacctacctgcggcctgtgctgtgcaccctggacaccacagctggggaggtggccgcccggctgctgcagctgggccacaagggcggcggcgtggtgaaggtgctgggccagggccctggagctgctgctgcccgggagcctgctgagcccccacctgaggccggcccccggctggcccctcctgagccccgggacagcgaggtgcccccagcccggagcgcccctggggcctttggaggccccccccgggcccccccagctgacctgcccctgcctgtgggcggccctgggggctggagccggcgggccagccctgcccccagcgacagcagccctggagagccctttgtgggcggccctgtgagcagcccccgggcccccaggcctgtggtgtctgacacagagagcttcagcctgagccccagcgctgagagcgtgtctgaccggctggacccctacagcagcggcggcggcagcagcagcagcagcgaggagctggaggctgatgctgccagcgcccccaccggggtgcccggccagcccaggaggcctggccacccagcccagcccctgcccctgccccagacagccagcagcccccagccccagcagaaggccccccgggccatcgacagccctgggggcgctgtgcgggagggcagctgtgaggagaaggctgctgctgctgtggcccctgggggcctgcagagcaccccaggccgctctggagtgacagctgagaaggcccctcctcctcctcctccacccaccctgtatgtgcagctgcacggggagaccacccggcggctggaggccgaggagaagcccctgcagatccagaatgactacctgttccagctgggctttggagagctgtggagggtgcaggaggagggcatggattctgaaattggctgcctgatccgcttctacgccggcaagccccacagcacaggcagcagcgagcgcatccagctgagcggcatgtacaacgtgaggaagggcaagatgcagctgcctgtgaaccgctggacccggcggcaggtgatcctgtgtggcacctgcctgattgtgtcctctgtgaaggacagcctgaccgggaagatgcacgtgctgcccctcatcggcggcaaggtggaggaggtgaagaagcaccagcactgcctggccttcagcagcagcggcccccagagccagacctactacatctgctttgacaccttcacagagtacctgcgctggctgcggcaggtgtccaaggtggccagccagaggatcagctctgtggacctgagctgctgcagcctggagcacctgcctgccaacctcttctacagccaggacctgacccacctgaacctgaagcagaacttcctgcggcagaaccccagcctgcctgctgcccggggcctgaatgagctgcagcgcttcaccaagctgaagagcctgaacctgagcaacaaccacctgggggacttccccctggccgtgtgcagcatccccaccctggccgagctgaatgtgtcctgcaatgccctgcggtctgtgcctgctgctgtgggcgtgatgcacaacctgcagaccttcctgctggatggcaacttcctgcagagcctgcctgctgagctggagaacatgaagcagctgagctacctgggcctgtccttcaatgagttcacagacatccctgaggtgctggagaagctgacagctgtggacaagctgtgcatgagcggcaactgtgtggagaccctgcggctgcaggccctgaggaagatgccccacatcaagcacgtggacctgcggctgaatgtcatcaggaagctgattgctgatgaggtggacttcctgcagcacgtgacccagctggacctgcgggacaacaagctgggggacctggatgccatgatcttcaacaacatcgaggtgctgcactgtgaaagaaaccagctggtgaccctggacatctgtggctacttcctgaaggccctgtatgccagcagcaatgagctggtgcagctggatgtgtaccctgtgcccaactacctgagctacatggatgtgtccaggaaccggctggagaatgtgcctgagtgggtgtgtgagagcaggaagctggaggtgctggacatcggccacaaccagatctgtgagctgcctgcccggctcttctgcaacagcagcctgaggaagctgctggccggccacaaccagctggcccggctgcctgagcggctggagaggacctctgtggaggtgctggatgtgcagcacaaccagctgctggagctgccccccaacctgctgatgaaggctgacagcctgcgcttcctgaatgccagcgccaacaagctggagagcctgcccccagccaccctgtctgaggagaccaacagcatcctgcaggagctgtacctgaccaacaacagcctgacagacaagtgtgtgcccctgctgaccggccacccccacctgaagatcctgcacatggcctacaaccggctgcagagcttccctgccagcaagatggccaagctggaggagctggaggagattgacctgagcggcaacaagctgaaggccatccccaccaccatcatgaactgcaggaggatgcacacagtgattgcccacagcaactgcatcgaggtgtttcctgaggtgatgcagctgcctgagatcaagtgtgtggacctgagctgcaatgagctgtctgaggtgaccctgcctgagaacctgccccccaagctgcaggagctggacctgaccggcaacccccggctggtgctggaccacaagaccctggagctgctgaacaacatccgctgcttcaagattgaccagcccagcactggagatgccagcggggccccagctgtgtggagccacggctacacagaggccagcggcgtgaagaacaagctgtgtgtggccgccctgtctgtgaacaacttctgtgacaaccgggaggccctgtatggagtgtttgatggagacagaaatgtggaggtgccctacctgctgcagtgcaccatgtctgacatcctggccgaggagctgcagaagaccaagaatgaggaggagtacatggtgaacaccttcatcgtgatgcagaggaagctgggcacagctggccagaagctgggcggcgctgctgtgctgtgccacatcaagcatgaccctgtggaccccggcggcagcttcaccctgaccagcgccaacgtgggcaagtgccagacagtgctgtgcagaaatggcaagcccctgcccctgagccgcagctacatcatgagctgtgaggaggagctgaagaggatcaagcagcacaaggccatcatcacagaagatggcaaggtgaatggagtgacagagagcacccgcatcctgggctacaccttcctgcaccccagcgtggtgccccggccccacgtgcagagcgtgctgctgaccccccaggatgagttcttcatcctgggcagcaagggcctgtgggacagcctgtctgtggaggaggccgtggaggccgtgagaaatgtgcctgatgccctggccgccgccaagaagctgtgcaccctggcccagagctatggctgccacgacagcatctctgctgtggtggtgcagctgtctgtgacagaggacagcttctgctgctgtgagctgtctgctgggggcgctgtgcccccacccagccctggcatcttccccccatctgtgaacatggtgatcaaggaccggcccagtgatggcctgggcgtgcccagcagcagcagcggcatggccagcgagatcagcagcgagctgagcaccagcgagatgagcagcgaggtgggcagcacagccagtgatgagcccccacctggggccctgtctgagaacagccctgcctaccccagcgagcagcgctgcatgctgcaccccatctgcctgagcaacagcttccagaggcagctgagcagcgccaccttcagcagcgccttcagtgacaatggcctggacagtgatgatgaggagcccattgaaggagtcttcaccaacggcagccgggtggaggtggaggtggacatccactgcagccgggccaaggagaaggagaagcagcagcacctgctgcaggtgcctgctgaggccagtgatgagggcatcgtcatcagcgccaatgaagatgagcccggcctgcccaggaaggctgacttctctgctgtgggcaccatcggcagaagaagagccaacggctctgtggccccccaggagaggagccacaacgtgattgaggtggccacagatgcccccctgaggaagccaggcggctactttgctgccccagcccagcctgaccctgatgaccagttcatcatccccccagagctggaggaggaggtgaaggagatcatgaagcaccaccaggagcagcagcagcagcagcagcccccacctccaccccagctgcagccccagctgcccaggcactaccagctggaccagctgcctgactactatgacacccccctgtag

SEQ ID NO: 21059 - DNA, 3618 bp, Artificial Sequence
  Description of Artificial Sequence: Synthetic coding sequence
atggattctgaaattggctgcctgatccgcttctacgccggcaagccccacagcacaggcagcagcgagcgcatccagctgagcggcatgtacaacgtgaggaagggcaagatgcagctgcctgtgaaccgctggacccggcggcaggtgatcctgtgtggcacctgcctgattgtgtcctctgtgaaggacagcctgaccgggaagatgcacgtgctgcccctcatcggcggcaaggtggaggaggtgaagaagcaccagcactgcctggccttcagcagcagcggcccccagagccagacctactacatctgctttgacaccttcacagagtacctgcgctggctgcggcaggtgtccaaggtggccagccagaggatcagctctgtggacctgagctgctgcagcctggagcacctgcctgccaacctcttctacagccaggacctgacccacctgaacctgaagcagaacttcctgcggcagaaccccagcctgcctgctgcccggggcctgaatgagctgcagcgcttcaccaagctgaagagcctgaacctgagcaacaaccacctgggggacttccccctggccgtgtgcagcatccccaccctggccgagctgaatgtgtcctgcaatgccctgcggtctgtgcctgctgctgtgggcgtgatgcacaacctgcagaccttcctgctggatggcaacttcctgcagagcctgcctgctgagctggagaacatgaagcagctgagctacctgggcctgtccttcaatgagttcacagacatccctgaggtgctggagaagctgacagctgtggacaagctgtgcatgagcggcaactgtgtggagaccctgcggctgcaggccctgaggaagatgccccacatcaagcacgtggacctgcggctgaatgtcatcaggaagctgattgctgatgaggtggacttcctgcagcacgtgacccagctggacctgcgggacaacaagctgggggacctggatgccatgatcttcaacaacatcgaggtgctgcactgtgaaagaaaccagctggtgaccctggacatctgtggctacttcctgaaggccctgtatgccagcagcaatgagctggtgcagctggatgtgtaccctgtgcccaactacctgagctacatggatgtgtccaggaaccggctggagaatgtgcctgagtgggtgtgtgagagcaggaagctggaggtgctggacatcggccacaaccagatctgtgagctgcctgcccggctcttctgcaacagcagcctgaggaagctgctggccggccacaaccagctggcccggctgcctgagcggctggagaggacctctgtggaggtgctggatgtgcagcacaaccagctgctggagctgccccccaacctgctgatgaaggctgacagcctgcgcttcctgaatgccagcgccaacaagctggagagcctgcccccagccaccctgtctgaggagaccaacagcatcctgcaggagctgtacctgaccaacaacagcctgacagacaagtgtgtgcccctgctgaccggccacccccacctgaagatcctgcacatggcctacaaccggctgcagagcttccctgccagcaagatggccaagctggaggagctggaggagattgacctgagcggcaacaagctgaaggccatccccaccaccatcatgaactgcaggaggatgcacacagtgattgcccacagcaactgcatcgaggtgtttcctgaggtgatgcagctgcctgagatcaagtgtgtggacctgagctgcaatgagctgtctgaggtgaccctgcctgagaacctgccccccaagctgcaggagctggacctgaccggcaacccccggctggtgctggaccacaagaccctggagctgctgaacaacatccgctgcttcaagattgaccagcccagcactggagatgccagcggggccccagctgtgtggagccacggctacacagaggccagcggcgtgaagaacaagctgtgtgtggccgccctgtctgtgaacaacttctgtgacaaccgggaggccctgtatggagtgtttgatggagacagaaatgtggaggtgccctacctgctgcagtgcaccatgtctgacatcctggccgaggagctgcagaagaccaagaatgaggaggagtacatggtgaacaccttcatcgtgatgcagaggaagctgggcacagctggccagaagctgggcggcgctgctgtgctgtgccacatcaagcatgaccctgtggaccccggcggcagcttcaccctgaccagcgccaacgtgggcaagtgccagacagtgctgtgcagaaatggcaagcccctgcccctgagccgcagctacatcatgagctgtgaggaggagctgaagaggatcaagcagcacaaggccatcatcacagaagatggcaaggtgaatggagtgacagagagcacccgcatcctgggctacaccttcctgcaccccagcgtggtgccccggccccacgtgcagagcgtgctgctgaccccccaggatgagttcttcatcctgggcagcaagggcctgtgggacagcctgtctgtggaggaggccgtggaggccgtgagaaatgtgcctgatgccctggccgccgccaagaagctgtgcaccctggcccagagctatggctgccacgacagcatctctgctgtggtggtgcagctgtctgtgacagaggacagcttctgctgctgtgagctgtctgctgggggcgctgtgcccccacccagccctggcatcttccccccatctgtgaacatggtgatcaaggaccggcccagtgatggcctgggcgtgcccagcagcagcagcggcatggccagcgagatcagcagcgagctgagcaccagcgagatgagcagcgaggtgggcagcacagccagtgatgagcccccacctggggccctgtctgagaacagccctgcctaccccagcgagcagcgctgcatgctgcaccccatctgcctgagcaacagcttccagaggcagctgagcagcgccaccttcagcagcgccttcagtgacaatggcctggacagtgatgatgaggagcccattgaaggagtcttcaccaacggcagccgggtggaggtggaggtggacatccactgcagccgggccaaggagaaggagaagcagcagcacctgctgcaggtgcctgctgaggccagtgatgagggcatcgtcatcagcgccaatgaagatgagcccggcctgcccaggaaggctgacttctctgctgtgggcaccatcggcagaagaagagccaacggctctgtggccccccaggagaggagccacaacgtgattgaggtggccacagatgcccccctgaggaagccaggcggctactttgctgccccagcccagcctgaccctgatgaccagttcatcatccccccagagctggaggaggaggtgaaggagatcatgaagcaccaccaggagcagcagcagcagcagcagcccccacctccaccccagctgcagccccagctgcccaggcactaccagctggaccagctgcctgactactatgacacccccctgtag

SEQ ID NO: 21060 - DNA, 2379 bp, Artificial Sequence
  Description of Artificial Sequence: Synthetic coding sequence
atgcacatcctgcccctggtgggcggcaagattgaggaggtgaagaggcggcagtacagcctggccttcagcagcgctggggcccaggcccagacctaccacgtgtcctttgagaccctggccgagtaccagcgctggcagaggcaggccagcaaggtggtgtcccagaggatcagcacagtggacctgagctgctacagcctggaggaggtgcctgagcacctgttctacagccaggacatcacctacctgaacctgcggcacaacttcatgcagctggagaggcctgggggcctggacaccctgtacaagttcagccagctgaagggcctgaacctgagccacaacaagctgggcctcttccccatcctgctgtgtgagatcagcaccctgacagagctgaacctgagctgcaatggcttccatgacctgcccagccagatcggcaacctgctgaacctgcagaccctgtgcctggatggcaacttcctgaccaccctgcctgaggagctgggcaacctgcagcagctgagcagcctgggcatctccttcaacaacttcagccagatccctgaggtgtatgagaagctgaccatgctggacagagtggtgatggccggcaactgcctggaggtgctgaacctgggcgtgctgaacaggatgaaccacatcaagcacgtggacctgaggatgaaccacctgaagaccatggtgattgagaacctggagggcaacaagcacatcacccacgtggacctgcgggacaaccggctgacagacctggacctgagcagcctgtgcagcctggagcagctgcactgcggcaggaaccagctgcgggagctgaccctgagcggcttcagcctgcggaccctgtatgccagcagcaaccggctgacagctgtgaatgtgtaccctgtgcccagcctgctgaccttcctggacctgagcaggaacctgctggagtgtgtgcctgactgggcctgtgaggccaagaagattgaggtgctggatgtgtcctacaacctgctgacagaggtgcctgtgcgcatcctgagcagcctgagcctgaggaagctgatgctgggccacaaccacgtgcagaacctgcccaccctggtggagcacatccccctggaggtgctggacctgcagcacaatgccctgacccggctgcctgacaccctcttcagcaaggccctgaacctgcgctacctgaatgccagcgccaacagcctggagagcctgcccagcgcctgcacaggagaggagagcctgtccatgctgcagctgctgtacctgaccaacaacctgctgacagaccagtgcatccctgtgctggtgggccacctgcacctgcgcatcctgcacctggccaacaaccagctgcagaccttccctgccagcaagctgaacaagctggagcagctggaggagctgaacctgagcggcaacaagctgaagaccatccccaccaccatcgccaactgcaagaggctgcacaccctggtggcccacagcaacaacatcagcatcttccctgagatcctgcagctgccccagatccagtttgtggacctgagctgcaatgacctgacagagatcctgatccctgaggccctgcctgccaccctgcaggacctggacctgactggaaacaccaacctggtgctggagcacaagaccctggacatcttcagccacatcaccaccctgaagattgaccagaagcccctgcccaccacagacagcacagtgaccagcaccttctggagccacggcctggccgagatggccggccagaggaacaagctgtgtgtgtctgccctggccatggacagctttgctgagggcgtgggcgctgtgtatggcatgtttgatggagacagaaatgaggagctgccccggctgctgcagtgcaccatggctgatgtgctgctggaggaggtgcagcagagcaccaatgacacagtgttcatggccaacaccttcctggtgagccacaggaagctgggcatggccggccagaagctgggcagcagcgccctgctgtgctacatccggccagacacagctgaccctgccagcagcttcagcctgactgtggccaacgtgggcacctgccaggccgtgctgtgccggggcggcaagcctgtgcccctgagcaaggtgttcagcctggagcaggaccctgaggaggcccagagggtgaaggaccagaaggccatcatcacagaggtgcctgaggacctgaaggagttccagaccacagacatccctgtgcaccactgcaacttccgggctgtgctgggctgcctgtgcagcgcctctgtgctgggcagctatgccggccctgccccccgctggaggagaacatag

SEQ ID NO: 21061 - DNA, 3972 bp, Artificial Sequence
  Description of Artificial Sequence: Synthetic coding sequence
atgaagagaaatggcagcaggaactgcctgaacagaagaagccgcttcggcagccgggagcgggactggctgcgggaggatgtgaagaggggctgtgtgtacctgtatggagctgacaccaccacagccaccaccaccaccaccaccagcagcagcagcagcagcagcagcagcagcagtgacctgcacctggtgctgtgcaccgtggagaccccagccagcgagatctgtgccggggagggccgggagagcctgtacctgcagctgcacggggacctggtgcggcggctggagcccacagagcggcccctgcagatcgtgtatgactacctgagccggctgggctttgatgatcctgtgcgcatccaggaggaggccaccaacccagacctgggctgcatgatccgcttctacggggagaagccctgccacatggaccggctggaccgcatcctgctgagcggcatctacaacgtgaggaagggcaagacccagctgcacaagtgggccgagcggctggtggtgctgtgtggcacctgcctgattgtgtcctctgtgaaggactgccagacaggcaagatgcacatcctgcccctggtgggcggcaagattgaggaggtgaagaggcggcagtacagcctggccttcagcagcgctggggcccaggcccagacctaccacgtgtcctttgagaccctggccgagtaccagcgctggcagaggcaggccagcaaggtggtgtcccagaggatcagcacagtggacctgagctgctacagcctggaggaggtgcctgagcacctgttctacagccaggacatcacctacctgaacctgcggcacaacttcatgcagctggagaggcctgggggcctggacaccctgtacaagttcagccagctgaagggcctgaacctgagccacaacaagctgggcctcttccccatcctgctgtgtgagatcagcaccctgacagagctgaacctgagctgcaatggcttccatgacctgcccagccagatcggcaacctgctgaacctgcagaccctgtgcctggatggcaacttcctgaccaccctgcctgaggagctgggcaacctgcagcagctgagcagcctgggcatctccttcaacaacttcagccagatccctgaggtgtatgagaagctgaccatgctggacagagtggtgatggccggcaactgcctggaggtgctgaacctgggcgtgctgaacaggatgaaccacatcaagcacgtggacctgaggatgaaccacctgaagaccatggtgattgagaacctggagggcaacaagcacatcacccacgtggacctgcgggacaaccggctgacagacctggacctgagcagcctgtgcagcctggagcagctgcactgcggcaggaaccagctgcgggagctgaccctgagcggcttcagcctgcggaccctgtatgccagcagcaaccggctgacagctgtgaatgtgtaccctgtgcccagcctgctgaccttcctggacctgagcaggaacctgctggagtgtgtgcctgactgggcctgtgaggccaagaagattgaggtgctggatgtgtcctacaacctgctgacagaggtgcctgtgcgcatcctgagcagcctgagcctgaggaagctgatgctgggccacaaccacgtgcagaacctgcccaccctggtggagcacatccccctggaggtgctggacctgcagcacaatgccctgacccggctgcctgacaccctcttcagcaaggccctgaacctgcgctacctgaatgccagcgccaacagcctggagagcctgcccagcgcctgcaccggggaggagagcctgtccatgctgcagctgctgtacctgaccaacaacctgctgacagaccagtgcatccctgtgctggtgggccacctgcacctgcgcatcctgcacctggccaacaaccagctgcagaccttccctgccagcaagctgaacaagctggagcagctggaggagctgaacctgagcggcaacaagctgaagaccatccccaccaccatcgccaactgcaagaggctgcacaccctggtggcccacagcaacaacatcagcatcttccctgagatcctgcagctgccccagatccagtttgtggacctgagctgcaatgacctgacagagatcctgatccctgaggccctgcctgccaccctgcaggacctggacctgaccggcaacaccaacctggtgctggagcacaagaccctggacatcttcagccacatcaccaccctgaagattgaccagaagcccctgcccaccacagacagcacagtgaccagcaccttctggagccacggcctggccgagatggccggccagaggaacaagctgtgtgtgtctgccctggccatggacagctttgctgagggcgtgggcgctgtgtatggcatgtttgatggagacagaaatgaggagctgccccggctgctgcagtgcaccatggctgatgtgctgctggaggaggtgcagcagagcaccaatgacaccgtcttcatggccaacaccttcctggtgagccacaggaagctgggcatggccggccagaagctgggcagcagcgccctgctgtgctacatccggccagacacagctgaccctgccagcagcttcagcctgactgtggccaacgtgggcacctgccaggccgtgctgtgccggggcggcaagcctgtgcccctgagcaaggtgttcagcctggagcaggaccctgaggaggcccagagggtgaaggaccagaaggccatcatcacagaggacaacaaggtgaatggagtgacctgctgcaccaggatgctgggctgcacctacctgtacccctggatcctgcccaagccccacatcagcagcacccccctgaccatccaggatgagctgctgatcctgggcaacaaggccctgtgggagcacctgagctacacagaggccgtgaatgctgtgcgccacgtgcaggaccccctggccgccgccaagaagctgtgcaccctggcccagagctatggctgccaggacaacgtgggcgccatggtggtgtacctgaacattggagaggagggctgcacctgtgagatgaatggcctgaccctgcccggccctgtgggctttgccagcaccaccaccatcaaggatgcccccaagccagccacccccagcagcagcagcggcatcgccagcgagttcagcagcgagatgagcaccagcgaggtgtcctctgaggtgggcagcacagccagtgatgagcacaatgccggcggcctggacacagccctgctgcccaggcctgagcggcgctgcagcctgcaccccacccccaccagcggcctcttccagaggcagcccagcagcgccaccttcagcagcaaccagagcgacaatggcctggacagtgatgatgaccagcctgtggagggcgtcatcaccaacggcagcaaggtggaggtggaggtggacatccactgctgccggggccgggacctggagaacagccccccactcatcgagagcagccccaccctgtgcagcgaggagcacgcccggggcagctgcttcggcatccggcggcagaacagcgtgaacagcggcatgctgctgcccatgagcaaggacaggatggagctgcagaagagccccagcaccagctgcctgtatggcaagaagctgagcaatggcagcatcgtgcccctggaggacagcctgaacctgattgaggtggccacagaggtgcccaagaggaagacaggctactttgctgcccccacccagatggagcctgaggaccagtttgtggtgccccatgacctggaggaggaggtgaaggagcagatgaagcagcaccaggacagccggctggagcctgagccccatgaggaggacagaacagagcccccagaggagtttgacacagccctgtag

SEQ ID NO: 21062 - DNA, 2871 bp, Artificial Sequence
  Description of Artificial Sequence: Synthetic coding sequence
atgaagagaaatggcagcaggaactgcctgaacagaagaagccgcttcggcagccgggagcgggactggctgcgggaggatgtgaagaggggctgtgtgtacctgtatggagctgacaccaccacagccaccaccaccaccaccaccagcagcagcagcagcagcagcagcagcagcagtgacctgcacctggtgctgtgcaccgtggagaccccagccagcgagatctgtgccggggagggccgggagagcctgtacctgcagctgcacggggacctggtgcggcggctggagcccacagagcggcccctgcagatcgtgtatgactacctgagccggctgggctttgatgatcctgtgcgcatccaggaggaggccaccaacccagacctgggctgcatgatccgcttctacggggagaagccctgccacatggaccggctggaccgcatcctgctgagcggcatctacaacgtgaggaagggcaagacccagctgcacaagtgggccgagcggctggtggtgctgtgtggcacctgcctgattgtgtcctctgtgaaggactgccagacaggcaagatgcacatcctgcccctggtgggcggcaagattgaggaggtgaagaggcggcagtacagcctggccttcagcagcgctggggcccaggcccagacctaccacgtgtcctttgagaccctggccgagtaccagcgctggcagaggcaggccagcaaggtggtgtcccagaggatcagcacagtggacctgagctgctacagcctggaggaggtgcctgagcacctgttctacagccaggacatcacctacctgaacctgcggcacaacttcatgcagctggagaggcctgggggcctggacaccctgtacaagttcagccagctgaagggcctgaacctgagccacaacaagctgggcctcttccccatcctgctgtgtgagatcagcaccctgacagagctgaacctgagctgcaatggcttccatgacctgcccagccagatcggcaacctgctgaacctgcagaccctgtgcctggatggcaacttcctgaccaccctgcctgaggagctgggcaacctgcagcagctgagcagcctgggcatctccttcaacaacttcagccagatccctgaggtgtatgagaagctgaccatgctggacagagtggtgatggccggcaactgcctggaggtgctgaacctgggcgtgctgaacaggatgaaccacatcaagcacgtggacctgaggatgaaccacctgaagaccatggtgattgagaacctggagggcaacaagcacatcacccacgtggacctgcgggacaaccggctgacagacctggacctgagcagcctgtgcagcctggagcagctgcactgcggcaggaaccagctgcgggagctgaccctgagcggcttcagcctgcggaccctgtatgccagcagcaaccggctgacagctgtgaatgtgtaccctgtgcccagcctgctgaccttcctggacctgagcaggaacctgctggagtgtgtgcctgactgggcctgtgaggccaagaagattgaggtgctggatgtgtcctacaacctgctgacagaggtgcctgtgcgcatcctgagcagcctgagcctgaggaagctgatgctgggccacaaccacgtgcagaacctgcccaccctggtggagcacatccccctggaggtgctggacctgcagcacaatgccctgacccggctgcctgacaccctcttcagcaaggccctgaacctgcgctacctgaatgccagcgccaacagcctggagagcctgcccagcgcctgcaccggggaggagagcctgtccatgctgcagctgctgtacctgaccaacaacctgctgacagaccagtgcatccctgtgctggtgggccacctgcacctgcgcatcctgcacctggccaacaaccagctgcagaccttccctgccagcaagctgaacaagctggagcagctggaggagctgaacctgagcggcaacaagctgaagaccatccccaccaccatcgccaactgcaagaggctgcacaccctggtggcccacagcaacaacatcagcatcttccctgagatcctgcagctgccccagatccagtttgtggacctgagctgcaatgacctgacagagatcctgatccctgaggccctgcctgccaccctgcaggacctggacctgaccggcaacaccaacctggtgctggagcacaagaccctggacatcttcagccacatcaccaccctgaagattgaccagaagcccctgcccaccacagacagcacagtgaccagcaccttctggagccacggcctggccgagatggccggccagaggaacaagctgtgtgtgtctgccctggccatggacagctttgctgagggcgtgggcgctgtgtatggcatgtttgatggagacagaaatgaggagctgccccggctgctgcagtgcaccatggctgatgtgctgctggaggaggtgcagcagagcaccaatgacaccgtcttcatggccaacaccttcctggtgagccacaggaagctgggcatggccggccagaagctgggcagcagcgccctgctgtgctacatccggccagacacagctgaccctgccagcagcttcagcctgactgtggccaacgtgggcacctgccaggccgtgctgtgccggggcggcaagcctgtgcccctgagcaaggtgttcagcctggagcaggaccctgaggaggcccagagggtgaaggaccagaaggccatcatcacagagaactgggtgctgaaccagaagcacctgcaggacttccctggagaggacaagtag

SEQ ID NO: 21063 - DNA, 3771 bp, Artificial Sequence
  Description of Artificial Sequence: Synthetic coding sequence
atgaagagaaatggcagcaggaactgcctgaacagaagaagccgcttcggcagccgggagcgggactggctgcgggaggatgtgaagaggggctgtgtgtacctgtatggagctgacaccaccacagccaccaccaccaccaccaccagcagcagcagcagcagcagcagcagcagcagtgacctgcacctggtgctgtgcaccgtggagaccccagccagcgagatctgtgccggggagggccgggagagcctgtacctgcagctgcacggggacctggtgcggcggctggagcccacagagcggcccctgcagatcgtgtatgactacctgagccggctgggctttgatgatcctgtgcgcatccaggaggaggccaccaacccagacctgggctgcatgatccgcttctacggggagaagccctgccacatggaccggctggaccgcatcctgctgagcggcatctacaacgtgaggaagggcaagacccagctgcacaagtgggccgagcggctggtggtgctgtgtggcacctgcctgattgtgtcctctgtgaaggactgccagacaggcaagatgcacatcctgcccctggtgggcggcaagattgaggaggtgaagaggcggcagtacagcctggccttcagcagcgctggggcccaggcccagacctaccacgtgtcctttgagaccctggccgagtaccagcgctggcagaggcaggccagcaaggtggtgtcccagaggatcagcacagtggacctgagctgctacagcctggaggaggtgcctgagcacctgttctacagccaggacatcacctacctgaacctgcggcacaacttcatgcagctggagaggcctgggggcctggacaccctgtacaagttcagccagctgaagggcctgaacctgagccacaacaagctgggcctcttccccatcctgctgtgtgagatcagcaccctgacagagctgaacctgagctgcaatggcttccatgacctgcccagccagatcggcaacctgctgaacctgcagaccctgtgcctggatggcaacttcctgaccaccctgcctgaggagctgggcaacctgcagcagctgagcagcctgggcatctccttcaacaacttcagccagatccctgaggtgtatgagaagctgaccatgctggacagagtggtgatggccggcaactgcctggaggtgctgaacctgggcgtgctgaacaggatgaaccacatcaagcacgtggacctgaggatgaaccacctgaagaccatggtgattgagaacctggagggcaacaagcacatcacccacgtggacctgcgggacaaccggctgacagacctggacctgagcagcctgtgcagcctggagcagctgcactgcggcaggaaccagctgcgggagctgaccctgagcggcttcagcctgcggaccctgtatgccagcagcaaccggctgacagctgtgaatgtgtaccctgtgcccagcctgctgaccttcctggacctgagcaggaacctgctggagtgtgtgcctgactgggcctgtgaggccaagaagattgaggtgctggatgtgtcctacaacctgctgacagaggtgcctgtgcgcatcctgagcagcctgagcctgaggaagctgatgctgggccacaaccacgtgcagaacctgcccaccctggtggagcacatccccctggaggtgctggacctgcagcacaatgccctgacccggctgcctgacaccctcttcagcaaggccctgaacaagctgaacaagctggagcagctggaggagctgaacctgagcggcaacaagctgaagaccatccccaccaccatcgccaactgcaagaggctgcacaccctggtggcccacagcaacaacatcagcatcttccctgagatcctgcagctgccccagatccagtttgtggacctgagctgcaatgacctgacagagatcctgatccctgaggccctgcctgccaccctgcaggacctggacctgactggaaacaccaacctggtgctggagcacaagaccctggacatcttcagccacatcaccaccctgaagattgaccagaagcccctgcccaccacagacagcacagtgaccagcaccttctggagccacggcctggccgagatggccggccagaggaacaagctgtgtgtgtctgccctggccatggacagctttgctgagggcgtgggcgctgtgtatggcatgtttgatggagacagaaatgaggagctgccccggctgctgcagtgcaccatggctgatgtgctgctggaggaggtgcagcagagcaccaatgacacagtgttcatggccaacaccttcctggtgagccacaggaagctgggcatggccggccagaagctgggcagcagcgccctgctgtgctacatccggccagacacagctgaccctgccagcagcttcagcctgactgtggccaacgtgggcacctgccaggccgtgctgtgccggggcggcaagcctgtgcccctgagcaaggtgttcagcctggagcaggaccctgaggaggcccagagggtgaaggaccagaaggccatcatcacagaggacaacaaggtgaatggagtgacctgctgcaccaggatgctgggctgcacctacctgtacccctggatcctgcccaagccccacatcagcagcacccccctgaccatccaggatgagctgctgatcctgggcaacaaggccctgtgggagcacctgagctacacagaagctgtgaatgctgtgagacatgtgcaggaccccctggccgccgccaagaagctgtgcaccctggcccagagctatggctgccaggacaacgtgggcgccatggtggtgtacctgaacatcggggaggagggctgcacctgtgagatgaatggcctgaccctgcccggccctgtgggctttgccagcaccaccaccatcaaggatgcccccaagccagccacccccagcagcagcagcggcatcgccagcgagttcagcagcgagatgagcaccagcgaggtgagcagcgaggtgggcagcacagccagtgatgagcacaatgctgggggcctggacacagccctgctgcccaggcctgagcggcgctgcagcctgcaccccacccccaccagcggcctcttccagaggcagcccagcagcgccaccttcagcagcaaccagagcgacaatggcctggacagtgatgatgaccagcctgtggagggcgtcatcaccaacggcagcaaggtggaggtggaggtggacatccactgctgccggggccgggacctggagaacagcccccccctgattgagagcagccccaccctgtgcagcgaggagcacgcccggggcagctgcttcggcatccggcggcagaacagcgtgaacagcggcatgctgctgcccatgagcaaggacaggatggagctgcagaagagccccagcaccagctgcctgtatggcaagaagctgagcaatggcagcatcgtgcccctggaggacagcctgaacctgattgaggtggccacagaggtgcccaagaggaagacaggctactttgctgcccccacccagatggagcctgaggaccagtttgtggtgccccatgacctggaggaggaggtgaaggagcagatgaagcagcaccaggacagccggctggagcctgagccccatgaggaggacagaacagagcccccagaggagtttgacacagccctgtag

SEQ ID NO: 21064 - DNA, 1272 bp, Artificial Sequence
  Description of Artificial Sequence: Synthetic coding sequence
atgaagagaaatggcagcaggaactgcctgaacagaagaagccgcttcggcagccgggagcgggactggctgcgggaggatgtgaagaggggctgtgtgtacctgtatggagctgacaccaccacagccaccaccaccaccaccaccagcagcagcagcagcagcagcagcagcagcagtgacctgcacctggtgctgtgcaccgtggagaccccagccagcgagatctgtgccggggagggccgggagagcctgtacctgcagctgcacggggacctggtgcggcggctggagcccacagagcggcccctgcagatcgtgtatgactacctgagccggctgggctttgatgatcctgtgcgcatccaggaggaggccaccaacccagacctgggctgcatgatccgcttctacggggagaagccctgccacatggaccggctggaccgcatcctgctgagcggcatctacaacgtgaggaagggcaagacccagctgcacaagtgggccgagcggctggtggtgctgtgtggcacctgcctgattgtgtcctctgtgaaggactgccagacaggcaagatgcacatcctgcccctggtgggcggcaagattgaggaggtgaagaggcggcagtacagcctggccttcagcagcgctggggcccaggcccagacctaccacgtgtcctttgagaccctggccgagtaccagcgctggcagaggcaggccagcaaggtggtgtcccagaggatcagcacagtggacctgagctgctacagcctggaggaggtgcctgagcacctgttctacagccaggacatcacctacctgaacctgcggcacaacttcatgcagctggagaggcctgggggcctggacaccctgtacaagttcagccagctgaagggcctgaacctgagccacaacaagctgggcctcttccccatcctgctgtgtgagatcagcaccctgacagagctgaacctgagctgcaatggcttccatgacctgcccagccagatcggcaacctgctgaacctgcagaccctgtgcctggatggcaacttcctgaccaccctgcctgaggagctgggcaacctgcagcagctgagcagcctgggcatctccttcaacaacttcagccagatccctgaggtgtatgagaagctgaccatgctggacagagtggtgatggccggcaactgcctggaggtgctgaacctgggcgtgctgaacaggatgaaccacatcaagcacgtggacctgaggtag

SEQ ID NO: 21065 - DNA, 501 bp, Artificial Sequence
  Description of Artificial Sequence: Synthetic coding sequence
atggccggccagaggaacaagctgtgtgtgtctgccctggccatggacagctttgctgagggcgtgggcgctgtgtatggcatgtttgatggagacagaaatgaggagctgccccggctgctgcagtgcaccatggctgatgtgctgctggaggaggtgcagcagagcaccaatgacaccgtcttcatggccaacaccttcctggtgagccacaggaagctgggcatggccggccagaagctgggcagcagcgccctgctgtgctacatccggccagacacagctgaccctgccagcagcttcagcctgactgtggccaacgtgggcacctgccaggccgtgctgtgccggggcggcaagcctgtgcccctgagcaaggtgttcagcctggagcaggaccctgaggaggcccagagggtgaaggaccagaaggccatcatcacagagaactgggtgctgaaccagaagcacctgcaggacttccctggagaggacaagtag

SEQ ID NO: 21066 - DNA, 3972 bp, Artificial Sequence; identical to SEQ ID NO: 21061
  Description of Artificial Sequence: Synthetic coding sequence

SEQ ID NO: 21067 - DNA, 1212 bp, Artificial Sequence
  Description of Artificial Sequence: Synthetic coding sequence
atgacagccatcatcaaggagatcgtgtccaggaacaagaggcgctaccaggaggatggctttgacctggacctgacctacatctaccccaacatcatcgccatgggcttccctgctgagcggctggagggcgtgtacagaaacaacattgatgatgtggtgcgcttcctggacagcaagcacaagaaccactacaagatctacaacctgtgtgccgagcggcactatgacacagccaagttcaactgccgggtggcccagtacccctttgaggaccacaaccccccccagctggagctgatcaagcccttctgtgaggacctggaccagtggctgtctgaagatgacaaccacgtggccgccatccactgcaaggccggcaagggccgcactggagtgatgatctgtgcctacctgctgcaccggggcaagttcctgaaggcccaggaggccctggacttctatggagaggtgaggacccgggacaagaagggcgtgaccatccccagccagaggcgctacgtgtactactacagctacctgctgaagaaccacctggactacagacctgtggccctgctcttccacaagatgatgtttgagaccatccccatgttttctgggggcacctgcaacccccagtttgtggtgtgccagctgaaggtgaagatctacagcagcaacagcggccccacccggcgggaggacaagttcatgtactttgagttcccccagcccctgcctgtgtgtggggacatcaaggtggagttcttccacaagcagaacaagatgctgaagaaggacaagatgttccacttctgggtgaacaccttcttcatccctggccctgaggagaccagcgagaaggtggagaatggcagcctgtgtgaccaggagattgacagcatctgcagcattgaaagagctgacaatgacaaggagtacctggtgctgaccctgaccaagaatgacctggacaaggccaacaaggacaaggccaaccgctacttcagccccaacttcaaggtgaagctgtacttcaccaagacagtggaggagcccagcaaccctgaggccagcagcagcacctctgtgaccccagatgtgtctgacaatgaaccagaccactaccgctacagcgacaccacagacagcgaccctgaaaatgagccctttgatgaggaccagcacacccagatcaccaaggtgtag

SEQ ID NO: 21068 - DNA, 531 bp, Artificial Sequence
  Description of Artificial Sequence: Synthetic coding sequence
atgggcaaggctgctgctgctgtggccttcggggctgaggtgggcgtgcggctggccctgtttgctgccttcctggtgacagagctgctgccccccttccagaggctcatccagcctgaggagatgtggctgtacagaaacccctacgtggaggccgagtacttccccaccaagcccatgtttgtgattgccttcctgagccccctgagcctcatcttcctggccaagttcctgaagaaggctgacacccgggacagccggcaggcctgcctggccgccagcctggccctggccctgaatggagtcttcaccaacaccatcaagctgattgtgggccggcccaggccagacttcttctaccgctgcttcccagatggcctggcccacagcgacctgatgtgcacaggagacaaggatgtggtgaatgaaggaaggaagagcttccccagcggccacagcagctgcatgaacatcatctggaccctgccctatgcctgcttccacatcatcgagttcaacctggagagctag

SEQ ID NO: 21069 - DNA, 651 bp, Artificial Sequence
  Description of Artificial Sequence: Synthetic coding sequence
atgggcaaggctgctgctgctgtggccttcggggctgaggtgggcgtgcggctggccctgtttgctgccttcctggtgacagagctgctgccccccttccagaggctcatccagcctgaggagatgtggctgtacagaaacccctacgtggaggccgagtacttccccaccaagcccatgtttgtgattgccttcctgagccccctgagcctcatcttcctggccaagttcctgaagaaggctgacacccgggacagccggcaggcctgcctggccgccagcctggccctggccctgaatggagtcttcaccaacaccatcaagctgattgtgggccggcccaggccagacttcttctaccgctgcttcccagatggcctggcccacagcgacctgatgtgcacaggagacaaggatgtggtgaatgaaggaaggaagagcttccccagcggccacagcagctttgcctttgctggcctggcctttgccagcttctacctggccggcaagctgcactgcttcaccccccagggccggggcaagtcctggaggttctgtgccttcctgagccccctgctgtttgctgctgtgattgccctgagcaggacctgtgactacaagcaccactggcagggccccttcaagtggtag

SEQ ID NO: 21070 - DNA, 795 bp, Artificial Sequence
  Description of Artificial Sequence: Synthetic coding sequence
atgggcaaggctgctgctgctgtggccttcggggctgaggtgggcgtgcggctggccctgtttgctgccttcctggtgacagagctgctgccccccttccagaggctcatccagcctgaggagatgtggctgtacagaaacccctacgtggaggccgagtacttccccaccaagcccatgtttgtgattgccttcctgagccccctgagcctcatcttcctggccaagttcctgaagaaggctgacacccgggacagccggcaggcctgcctggccgccagcctggccctggccctgaatggagtcttcaccaacaccatcaagctgattgtgggccggcccaggccagacttcttctaccgctgcttcccagatggcctggcccacagcgacctgatgtgcacaggagacaaggatgtggtgaatgaaggaaggaagagcttccccagcggccacagcagctttgcctttgctggcctggcctttgccagcttctacctggccggcaagctgcactgcttcaccccccagggccggggcaagtcctggaggttctgtgccttcctgagccccctgctgtttgctgctgtgattgccctgagcaggacctgtgactacaagcaccactggcaggatgtgctggtgggctccatgattggcatgacctttgcctacgtgtgctaccggcagtactacccacccctgacagatgctgagtgccacaagcccttccaggacaagctggtgctgagcacagcccagaagccaggggacagctactgctttgacatctag

SEQ ID NO: 21071 - DNA, 1086 bp, Artificial Sequence
  Description of Artificial Sequence: Synthetic coding sequence
atgcacggggactacaccctgaccctgaggaaaggaggcaacaacaagctgatcaagatcttccacagagatggcaagtatggcttcagtgaccccctgaccttcagctctgtggtggagctgatcaaccactacagaaatgaaagcctggcccagtacaaccccaagctggatgtgaagctgctgtaccctgtgtccaagtaccagcaggaccaggtggtgaaggaggacaacattgaagctgtgggcaagaagctgcacgagtacaacacccagttccaggagaagagccgggagtatgaccggctgtatgaggagtacaccaggaccagccaggagatccagatgaagaggacagccatcgaggccttcaatgagaccatcaagatctttgaggagcagtgccagacccaggagcgctacagcaaggagtacatcgagaagttcaagcgggagggcaatgagaaggagatccagaggatcatgcacaactatgacaagctgaagagccgcatcagcgagatcatcgacagcagaagaaggctggaggaggacctgaagaagcaggccgctgagtaccgggagattgacaagaggatgaacagcatcaagccagacctgatccagctgaggaagacccgggaccagtacctgatgtggctgacccagaagggcgtgcggcagaagaagctgaatgagtggctgggcaatgaaaatacagaggaccagtacagcctggtggaggatgatgaggacctgccccaccatgatgagaagacctggaatgtgggcagcagcaacagaaacaaggccgagaacctgctgcggggcaagagagatggcaccttcctggtgcgggagagcagcaagcagggctgctacgcctgcagcgtggtggtggatggagaggtgaagcactgtgtgatcaacaagacagccaccggctacggctttgctgagccctacaacctgtacagcagcctgaaggagctggtgctgcactaccagcacaccagcctggtgcagcacaatgacagcctgaatgtgaccctggcctaccctgtgtatgcccagcagaggaggtag

SEQ ID NO: 21072 - DNA, 3207 bp, Artificial Sequence
  Description of Artificial Sequence: Synthetic coding sequence
atgccaccccggcccagcagtggagagctgtggggcatccacctgatgccaccccgcatcctggtggagtgcctgctgcccaacggcatgattgtgaccctggagtgcctgcgggaggccaccctcatcaccatcaagcatgagctgttcaaggaggccaggaagtaccccctgcaccagctgctgcaggatgagagcagctacatctttgtgtctgtgacccaggaggccgagcgggaggagttctttgatgagacccggcggctgtgtgacctgcggctcttccagcccttcctgaaggtgattgagcctgtgggcaaccgggaggagaagatcctgaaccgggagattggatttgccatcggcatgcctgtgtgtgaatttgacatggtgaaggaccctgaggtgcaggacttcagaagaaacatcctgaatgtgtgcaaggaggccgtggacctgcgggacctgaacagcccccacagccgggccatgtatgtgtacccacccaacgtggagagcagccctgagctgcccaagcacatctacaacaagctggacaagggccagatcatcgtggtgatctgggtgattgtgagccccaacaatgacaagcagaagtacaccctgaagatcaaccacgactgtgtgcctgagcaggtgattgctgaggccatcaggaagaagaccaggtccatgctgctgagcagcgagcagctgaagctgtgtgtgctggagtaccagggcaagtacatcctgaaggtgtgtggctgtgatgagtacttcctggagaagtaccccctgagccagtacaagtacatccgcagctgcatcatgctgggccgcatgcccaacctgatgctgatggccaaggagagcctgtacagccagctgcccatggactgcttcaccatgcccagctacagccgccgcatcagcacagccaccccctacatgaatggagagaccagcaccaagagcctgtgggtgatcaacagcgccctgcgcatcaagatcctgtgtgccacctacgtgaatgtgaacatccgggacatcgacaagatctacgtgaggacaggcatctaccacggcggggagcccctgtgtgacaacgtgaacacccagagggtgccctgcagcaacccccgctggaatgagtggctgaactatgacatctacatcccagacctgcccagggctgcccggctgtgcctgagcatctgcagcgtgaagggcaggaaaggagccaaggaggagcactgccccctggcctggggcaacatcaacctgtttgactacacagacaccctggtgtctgggaagatggccctgaacctgtggcctgtgccccacggcctggaggacctgctgaaccccatcggcgtgacaggcagcaaccccaacaaggagaccccctgcctggagctggagtttgactggttcagctctgtggtgaagttcccagacatgtctgtcatcgaggagcacgccaactggagcgtgtcccgggaggccggcttctcctacagccatgctggcctgagcaaccggctggcccgggacaatgagctgagagaaaatgacaaggagcagctgaaggccatcagcacccgggaccccctgtctgagatcacagagcaggagaaggacttcctgtggagccaccgccactactgtgtgaccatccctgagatcctgcccaagctgctgctgtctgtgaagtggaacagcagagatgaggtggcccagatgtactgcctggtgaaggactggccacccatcaagccagagcaggccatggagctgctggactgcaactacccagaccccatggtgcggggctttgctgtgcgctgcctggagaagtacctgacagatgacaagctgagccagtacctgatccagctggtgcaggtgctgaagtatgagcagtacctggacaacctgctggtgcgcttcctgctgaagaaggccctgaccaaccagagaattggccacttcttcttctggcacctgaagtctgagatgcacaacaagacagtgtcccagcgcttcggcctgctgctggagagctactgccgggcctgtggcatgtacctgaagcacctgaaccggcaggtggaggccatggagaagctgatcaacctgacagacatcctgaagcaggagaagaaggatgagacccagaaggtgcagatgaagttcctggtggagcagatgaggaggccagacttcatggatgccctgcagggcttcctgagccccctgaacccagcccaccagctgggcaacctgcggctggaggagtgccgcatcatgagcagcgccaagaggcccctgtggctgaactgggagaacccagacatcatgtctgagctgctcttccagaacaatgagatcatcttcaagaatggagatgacctgcggcaggacatgctgaccctgcagatcatccgcatcatggagaacatctggcagaaccagggcctggacctgaggatgctgccctacggctgcctgagcattggagactgtgtgggcctcatcgaggtggtgaggaacagccacaccatcatgcagatccagtgcaagggcggcctgaagggggccctgcagttcaacagccacaccctgcaccagtggctgaaggacaagaacaagggggagatctatgatgctgccatcgacctcttcaccaggagctgtgccggctactgtgtggccaccttcatcctgggcattggagacagacacaacagcaacatcatggtgaaggatgatggccagctgttccacatcgactttggccacttcctggaccacaagaagaagaagtttggctacaagcgggagcgggtgccctttgtgctgacccaggacttcctgattgtcatcagcaagggggcccaggagtgcaccaagacccgggagtttgagcgcttccaggagatgtgctacaaggcctacctggccatccggcagcacgccaacctcttcatcaacctcttctccatgatgctgggcagcggcatgcctgagctgcagagctttgatgacatcgcctacatcaggaagaccctggccctggacaagacagagcaggaggccctggagtacttcatgaagcagatgaatgatgcccaccacggcggctggaccaccaagatggactggatcttccacaccatcaagcagcacgccctgaactag

SEQ ID NO: 21073 - DNA, 357 bp, Artificial Sequence
  Description of Artificial Sequence: Synthetic coding sequence
atgccaccccggcccagcagtggagagctgtggggcatccacctgatgccaccccgcatcctggtggagtgcctgctgcccaacggcatgattgtgaccctggagtgcctgcgggaggccaccctcatcaccatcaagcatgagctgttcaaggaggccaggaagtaccccctgcaccagctgctgcaggatgagagcagctacatctttgtgtctgtgacccaggaggccgagcgggaggagttctttgatgagacccggcggctgtgtgacctgcggctcttccagcccttcctgaaggtgattgagcctgtgggcaaccgggaggagaagatcctgaaccgggagattggatag

SEQ ID NO: 21074 - DNA, 66 bp, Artificial Sequence
  Description of Artificial Sequence: Synthetic coding sequence
atgccaccccggcccagcagtggagagctgtggggcatccacctgatgccaccccgcatcctgtag

SEQ ID NO: 21075 - DNA, 3213 bp, Artificial Sequence
  Description of Artificial Sequence: Synthetic coding sequence
atgtgcttctccttcatcatgcccccagccatggctgacatcctggacatctgggccgtggacagccagatcgccagtgatggcagcatccctgtggacttcctgctgcccaccggcatctacatccagctggaggtgccccgggaggccaccatctcctacatcaagcagatgctgtggaagcaggtgcacaactaccccatgttcaacctgctgatggacatcgacagctacatgtttgcctgtgtgaaccagacagctgtgtatgaggagctggaggatgagacccggcggctgtgtgatgtgcggcccttcctgcctgtgctgaagctggtgaccaggagctgtgaccccggggagaagctggacagcaagattggagtgctgattggcaagggcctgcatgaatttgacagcctgaaggaccctgaggtgaatgagttccggaggaagatgaggaagttcagcgaggagaagatcctgagcctggtgggcctgtcctggatggactggctgaagcagacctacccacctgagcacgagcccagcatccctgagaacctggaggacaagctgtatggaggcaagctgattgtggccgtgcactttgagaactgccaggatgtgttctccttccaggtgagccccaacatgaaccccatcaaggtgaatgagctggccatccagaagaggctgaccatccacggcaaggaggatgaggtgagcccctatgactatgtgctgcaggtgtctggccgggtggagtatgtgtttggagaccaccccctcatccagttccagtacatccggaactgtgtgatgaacagagccctgccccacttcatcctggtggagtgctgcaagatcaagaagatgtatgagcaggagatgattgccatcgaggccgccatcaacagaaacagcagcaacctgcccctgcccctgccccccaagaagacccgcatcatcagccacgtgtgggagaacaacaaccccttccagatcgtgctggtgaagggcaacaagctgaacacagaggagaccgtgaaggtgcacgtgcgggccggcctcttccatggaacagagctgctgtgcaagaccatcgtgtcctctgaggtgtctgggaagaatgaccacatctggaatgagcccctggagtttgacatcaacatctgtgacctgcccaggatggcccggctgtgctttgctgtgtatgctgtgctggacaaggtgaagaccaagaagagcaccaagaccatcaaccccagcaagtaccagaccatcaggaaggccggcaaggtgcactaccctgtggcctgggtgaacaccatggtgtttgacttcaagggccagctgaggactggagacatcatcctgcacagctggagcagcttcccagatgagctggaggagatgctgaaccccatgggcaccgtgcagaccaacccctacacagaaaatgccacagccctgcacgtgaagtttcctgagaacaagaagcagccctactactaccccccatttgacaagatcatcgagaaggctgctgagatcgccagcagtgacagcgccaacgtgagcagccggggcggcaagaagttcctgcctgtgctgaaggagatcctggaccgggaccccctgagccagctgtgtgaaaatgagatggacctgatctggaccctgcggcaggactgccgggagatcttcccccagagcctgcccaagctgctgctgagcatcaagtggaacaagctggaggatgtggcccagctgcaggccctgctgcagatctggcccaagctgcccccccgggaggccctggagctgctggacttcaactacccagaccagtatgtgcgggagtatgctgtgggctgcctgcggcagatgtctgatgaggagctgagccagtacctgctgcagctggtgcaggtgctgaagtatgagcccttcctggactgtgccctgagccgcttcctgctggagcgggccctgggcaacagacgcatcggccagttcctgttctggcacctgcggtctgaggtgcacatcccagctgtgtctgtgcagtttggagtcatcctggaggcctactgccggggctctgtgggccacatgaaggtgctgagcaagcaggtggaggccctgaacaagctgaagaccctgaacagcctcatcaagctgaatgctgtgaagctgaacagagccaagggcaaggaggccatgcacacctgcctgaagcagagcgcctaccgggaggccctgagtgacctgcagagccccctgaacccctgtgtgatcctgtctgagctgtatgtggagaagtgcaagtacatggacagcaagatgaagcccctgtggctggtgtacaacaacaaggtgtttggagaagattctgtgggcgtcatcttcaagaatggagatgacctgcggcaggacatgctgaccctgcagatgctgcggctgatggacctgctgtggaaggaggccggcctggacctgaggatgctgccctacggctgcctggccaccggggacaggagcggcctgattgaggtggtgtccaccagcgagaccatcgctgacatccagctgaacagcagcaatgtggccgctgctgctgccttcaacaaggatgccctgctgaactggctgaaggagtacaacagcggagatgacctggaccgggccatcgaggagttcaccctgagctgtgccggctactgtgtggccagctatgtgctgggcattggagacagacacagcgacaacatcatggtgaagaagacaggccagctgttccacatcgactttggccacatcctgggcaacttcaagagcaagtttggcatcaagcgggagcgggtgcccttcatcctgacctatgacttcatccacgtgatccagcagggcaagacaggcaacacagagaagtttggccgcttccggcagtgctgtgaagatgcctacctgatcctgcggcggcacggcaacctcttcatcaccctgtttgccctgatgctgacagctggcctgcctgagctgacctctgtgaaggacatccagtacctgaaggacagcctggccctgggcaagtctgaggaggaggccctgaagcagttcaagcagaagtttgatgaggccctgcgggagagctggaccaccaaggtgaactggatggcccacacagtgaggaaggactaccgctcctag

SEQ ID NO: 21076 - DNA, 303 bp, Artificial Sequence
  Description of Artificial Sequence: Synthetic coding sequence
atgtgcttctccttcatcatgcccccagccatggctgacatcctggacatctgggccgtggacagccagatcgccagtgatggcagcatccctgtggacttcctgctgcccaccggcatctacatccagctggaggtgccccgggaggccaccatctcctacatcaagcagatgctgtggaagcaggtgcacaactaccccatgttcaacctgctgatggacatcgacagctacatgtttgcctgtgtgaaccagacagctgtgtatgaggagctggaggatgagacccggcggctgtgctag

SEQ ID NO: 21077 - DNA, 171 bp, Artificial Sequence
  Description of Artificial Sequence: Synthetic coding sequence
atgtgcttctccttcatcatgcccccagccatggctgacatcctggacatctgggccgtggacagccagatcgccagtgatggcagcatccctgtggacttcctgctgcccaccggcatctacatccagctggaggtgccccgggaggccaccatctcctacatcaagtag

SEQ ID NO: 21078 - DNA, 3213 bp, Artificial Sequence; identical to SEQ ID NO: 21075
  Description of Artificial Sequence: Synthetic coding sequence

SEQ ID NO: 21079 - DNA, 396 bp, Artificial Sequence
  Description of Artificial Sequence: Synthetic coding sequence
atgtgcttctccttcatcatgcccccagccatggctgacatcctggacatctgggccgtggacagccagatcgccagtgatggcagcatccctgtggacttcctgctgcccaccggcatctacatccagctggaggtgccccgggaggccaccatctcctacatcaagcagatgctgtggaagcaggtgcacaactaccccatgttcaacctgctgatggacatcgacagctacatgtttgcctgtgtgaaccagacagctgtgtatgaggagctggaggatgagacccggcggctgtgtgatgtgcggcccttcctgcctgtgctgaagctggtgaccaggagctgtgaccccggggagaagctggacagcaagattggagtgctgattggatag

SEQ ID NO: 21080 - DNA, 2109 bp, Artificial Sequence
  Description of Artificial Sequence: Synthetic coding sequence
tgagtgcgggccggcctcttccacggcacagagctgctgtgcaagaccatcgtgagcagcgaggtgtctgggaagaatgaccacatctggaatgagcccctggagtttgacatcaacatctgtgacctgcccaggatggcccggctgtgctttgctgtgtatgctgtgctggacaaggtgaagaccaagaagagcaccaagaccatcaaccccagcaagtaccagaccatcaggaaggccggcaaggtgcactaccctgtggcctgggtgaacaccatggtgtttgacttcaagggccagctgaggactggagacatcatcctgcacagctggagcagcttcccagatgagctggaggagatgctgaaccccatgggcaccgtgcagaccaacccctacacagaaaatgccacagccctgcacgtgaagtttcctgagaacaagaagcagccctactactaccccccatttgacaagagccggggcggcaagaagttcctgcctgtgctgaaggagatcctggaccgggaccccctgagccagctgtgtgaaaatgagatggacctgatctggaccctgcggcaggactgccgggagatcttcccccagagcctgcccaagctgctgctgagcatcaagtggaacaagctggaggatgtggcccagctgcaggccctgctgcagatctggcccaagctgcccccccgggaggccctggagctgctggacttcaactacccagaccagtatgtgcgggagtatgctgtgggctgcctgcggcagatgtctgatgaggagctgagccagtacctgctgcagctggtgcaggtgctgaagtatgagcccttcctggactgtgccctgagccgcttcctgctggagcgggccctgggcaacagacgcatcggccagttcctgttctggcacctgcggtctgaggtgcacatcccagctgtgtctgtgcagtttggagtcatcctggaggcctactgccggggctctgtgggccacatgaaggtgctgagcaagcaggtggaggccctgaacaagctgaagaccctgaacagcctcatcaagctgaatgctgtgaagctgaacagagccaagggcaaggaggccatgcacacctgcctgaagcagagcgcctaccgggaggccctgagtgacctgcagagccccctgaacccctgtgtgatcctgtctgagctgtatgtggagaagtgcaagtacatggacagcaagatgaagcccctgtggctggtgtacaacaacaaggtgtttggagaagattctgtgggcgtcatcttcaagaatggagatgacctgcggcaggacatgctgaccctgcagatgctgcggctgatggacctgctgtggaaggaggccggcctggacctgaggatgctgccctacggctgcctggccaccggggacaggagcggcctgattgaggtggtgtccaccagcgagaccatcgctgacatccagctgaacagcagcaatgtggccgctgctgctgccttcaacaaggatgccctgctgaactggctgaaggagtacaacagcggagatgacctggaccgggccatcgaggagttcaccctgagctgtgccggctactgtgtggccagctatgtgctgggcattggagacagacacagcgacaacatcatggtgaagaagacaggccagctgttccacatcgactttggccacatcctgggcaacttcaagagcaagtttggcatcaagcgggagcgggtgcccttcatcctgacctatgacttcatccacgtgatccagcagggcaagacaggcaacacagagaagtttggccgcttccggcagtgctgtgaagatgcctacctgatcctgcggcggcacggcaacctcttcatcaccctgtttgccctgatgctgacagctggcctgcctgagctgacctctgtgaaggacatccagtacctgaaggacagcctggccctgggcaagtctgaggaggaggccctgaagcagttcaagcagaagtttgatgaggccctgcgggagagctggaccaccaaggtgaactggatggcccacacagtgaggaaggactaccgctcctag

SEQ ID NO: 21081 - DNA, 1566 bp, Artificial Sequence
  Description of Artificial Sequence: Synthetic coding sequence
atggacctgatctggaccctgcggcaggactgccgggagatcttcccccagagcctgcccaagctgctgctgagcatcaagtggaacaagctggaggatgtggcccagctgcaggccctgctgcagatctggcccaagctgcccccccgggaggccctggagctgctggacttcaactacccagaccagtatgtgcgggagtatgctgtgggctgcctgcggcagatgtctgatgaggagctgagccagtacctgctgcagctggtgcaggtgctgaagtatgagcccttcctggactgtgccctgagccgcttcctgctggagcgggccctgggcaacagacgcatcggccagttcctgttctggcacctgcggtctgaggtgcacatcccagctgtgtctgtgcagtttggagtcatcctggaggcctactgccggggctctgtgggccacatgaaggtgctgagcaagcaggtggaggccctgaacaagctgaagaccctgaacagcctcatcaagctgaatgctgtgaagctgaacagagccaagggcaaggaggccatgcacacctgcctgaagcagagcgcctaccgggaggccctgagtgacctgcagagccccctgaacccctgtgtgatcctgtctgagctgtatgtggagaagtgcaagtacatggacagcaagatgaagcccctgtggctggtgtacaacaacaaggtgtttggagaagattctgtgggcgtcatcttcaagaatggagatgtgtgcttccccctggacctgcggcaggacatgctgaccctgcagatgctgcggctgatggacctgctgtggaaggaggccggcctggacctgaggatgctgccctacggctgcctggccactggagacagaagtggcctcatcgaggtggtgtccaccagcgagaccatcgctgacatccagctgaacagcagcaatgtggccgctgctgctgccttcaacaaggatgccctgctgaactggctgaaggagtacaacagcggagatgacctggaccgggccatcgaggagttcaccctgagctgtgccggctactgtgtggccagctatgtgctgggcatcggggacagacacagcgacaacatcatggtgaagaagacaggccagctgttccacatcgactttggccacatcctgggcaacttcaagagcaagtttggcatcaagcgggagcgggtgcccttcatcctgacctatgacttcatccacgtgatccagcagggcaagacaggcaacacagagaagtttggccgcttccggcagtgctgtgaagatgcctacctgatcctgcggagacatggcaacctcttcatcaccctgtttgccctgatgctgacagctggcctgcctgagctgacctctgtgaaggacatccagtacctgaaggacagcctggccctgggcaagtctgaggaggaggccctgaagcagttcaagcagaagtttgatgaggccctgcgggagagctggaccaccaaggtgaactggatggcccacacagtgaggaaggactaccgctcctag

SEQ ID NO: 21082 - DNA, 3207 bp, Artificial Sequence
  Description of Artificial Sequence: Synthetic coding sequence
atgcctcctggggtggactgccccatggagttctggaccaaggaggagaaccagagcgtggtggtggacttcctgctgcccaccggggtgtacctgaacttccctgtgtccagaaatgccaacctgagcaccatcaagcagctgctgtggcaccgggcccagtatgagcccctcttccacatgctgagcggccctgaggcctacgtgttcacctgcatcaaccagacagctgagcagcaggagctggaggatgagcagaggcggctgtgtgatgtgcagcccttcctgcctgtgctgcggctggtggcccgggagggggacagagtgaagaagctgatcaacagccagatcagcctgctgattggcaagggcctgcacgagtttgacagcctgtgtgaccctgaggtgaatgacttccgggccaagatgtgccagttctgtgaggaggccgccgcccggcggcagcagctgggctgggaggcctggctgcagtacagcttccccctgcagctggagcccagcgcccagacctggggccctggcaccctgcggctgcccaacagagccctgctggtgaatgtgaagtttgagggcagcgaggagagcttcaccttccaggtgtccaccaaggatgtgcccctggccctgatggcctgtgccctgaggaagaaggccaccgtcttccggcagcccctggtggagcagcctgaggactacaccctgcaggtgaatggaagacatgagtacctgtatggcagctaccccctgtgccagttccaggtgcagaagccccgggccaagcccccacccatcccagccaagaagcccagctctgtgtccctgtggagcctggagcagcccttccgcatcgagctgatccagggcagcaaggtgaatgctgatgagaggatgaagctggtggtgcaggccggcctcttccacggcaatgagatgctgtgcaagacagtgagcagcagcgaggtgtctgtgtgcagcgagcctgtgtggaagcagaggctggagtttgacatcaacatctgtgacctgcccaggatggcccggctgtgctttgccctgtatgctgtgattgagaaggccaagaaggcccggagcaccaagaagaagagcaagaaggctgactgccccatcgcctgggccaacctgatgctgtttgactacaaggaccagctgaagacaggagagcgctgcctgtacatgtggcccagcgtgcctgatgagaagggggagctgctgaaccccactggaacagtgcgcagcaaccccaacacagacagcgctgctgccctgctgatctgcctgcctgaggtggccccccaccctgtgtactacccagccctggagaagctgcccggcggcatgctgctggccagccgggagtggaggcctgagctgctgtggatgaggctgcacgcagaagattctgcccccagcaggatgattggagtggccatgcctggcctgggcgtgctgcccggcctggtgcaggcccctggagatgctgagtgcagccggctgctgcagatcctggagctgggccgccacagtgaatgtgtgcacgtgacagaggaggagcagctgcagctgcgggagatcctggagcggcggggcagcggggagctgtatgagcacgagaaggacctggtgtggaagctgcggcatgaggtgcaggagcacttccctgaggccctggcccggctgctgctggtgaccaagtggaacaagcatgaagatgtggcccaggatgccctgcctgctgtgtcctggccagagctgcctgtgctgagcgccctggagctgctggacttctccttcccagactgccacgtgggcagctttgccatcaagagcctgaggaagctgacagatgatgagctgttccagtacctgctgcagctggtgcaggtgctgaagtatgagagctacctggactgtgagctgaccaagttcctgctggaccgggccctggccaacaggaagattggccacttcctgttctggcacctgcggtctgagatgcacgtgcccagcgtggccctgcgcttcggcctcatcctggaggcctactgccggggcagcacccaccacatgaaggtgctgatgaagcagggcgaggccctgagcaagctgaaggccctgaatgactttgtgaagctgagcagccagaagacccccaagccccagaccaaggagctgatgcacctgtgcatgaggcaggaggcctacctggaggccctgagccacctgcagagccccctggaccccagcaccctgctggccgaggtgtgtgtggagcagtgcaccttcatggacagcaagatgaagcccctgtggatcatgtacagcaatgaggaggccggcagcggcggctctgtgggcatcatcttcaagaatggagatgacctgcggcaggacatgctgaccctgcagatgatccagctgatggatgtgctgtggaagcaggagggcctggacctgaggatgaccccctacggctgcctgcccaccggggacagaacaggcctgattgaggtggtgctgcggagtgacaccatcgccaacatccagctgaacaagagcaacatggccgccacagctgccttcaacaaggatgccctgctgaactggctgaagagcaagaaccctggagaggccctggaccgggccatcgaggagttcaccctgagctgtgccggctactgtgtggccacctacgtgctgggcattggagacagacacagcgacaacatcatgatccgggagagcggccagctgttccacatcgactttggccacttcctgggcaacttcaagaccaagtttggcatcaaccgggagcgggtgcccttcatcctgacctatgactttgtgcacgtgatccagcagggcaagaccaacaacagcgagaagtttgagcgcttccggggctactgtgagcgggcctacaccatcctgcggcggcacggcctgctcttcctgcacctgtttgccctgatgagagctgctggcctgcctgagctgagctgcagcaaggacatccagtacctgaaggacagcctggccctgggcaagacagaggaggaggccctgaagcacttccgggtgaagttcaatgaggccctgcgggagagctggaagaccaaggtgaactggctggcccacaacgtgtccaaggacaaccggcagtag

SEQ ID NO: 21083 - DNA, 3207 bp, Artificial Sequence
  Description of Artificial Sequence: Synthetic coding sequence
atgcctcctggggtggactgccccatggagttctggaccaaggaggagaaccagagcgtggtggtggacttcctgctgcccaccggggtgtacctgaacttccctgtgtccagaaatgccaacctgagcaccatcaagcagctgctgtggcaccgggcccagtatgagcccctcttccacatgctgagcggccctgaggcctacgtgttcacctgcatcaaccagacagctgagcagcaggagctggaggatgagcagaggcggctgtgtgatgtgcagcccttcctgcctgtgctgcggctggtggcccgggagggggacagagtgaagaagctgatcaacagccagatcagcctgctgattggcaagggcctgcacgagtttgacagcctgtgtgaccctgaggtgaatgacttccgggccaagatgtgccagttctgtgaggaggccgccgcccggcggcagcagctgggctgggaggcctggctgcagtacagcttccccctgcagctggagcccagcgcccagacctggggccctggcaccctgcggctgcccaacagagccctgctggtgaatgtgaagtttgagggcagcgaggagagcttcaccttccaggtgtccaccaaggatgtgcccctggccctgatggcctgtgccctgaggaagaaggccaccgtcttccggcagcccctggtggagcagcctgaggactacaccctgcaggtgaatggaagacatgagtacctgtatggcagctaccccctgtgccagttccaggtgcagaagccccgggccaagcccccacccatcccagccaagaagcccagctctgtgtccctgtggagcctggagcagcccttccgcatcgagctgatccagggcagcaaggtgaatgctgatgagaggatgaagctggtggtgcaggccggcctcttccacggcaatgagatgctgtgcaagacagtgagcagcagcgaggtgtctgtgtgcagcgagcctgtgtggaagcagaggctggagtttgacatcaacatctgtgacctgcccaggatggcccggctgtgctttgccctgtatgctgtgattgagaaggccaagaaggcccggagcaccaagaagaagagcaagaaggctgactgccccatcgcctgggccaacctgatgctgtttgactacaaggaccagctgaagacaggagagcgctgcctgtacatgtggcccagcgtgcctgatgagaagggggagctgctgaaccccactggaacagtgcgcagcaaccccaacacagacagcgctgctgccctgctgatctgcctgcctgaggtggccccccaccctgtgtactacccagccctggagaagctgcccggcggcatgctgctggccagccgggagtggaggcctgagctgctgtggatgaggctgcacgcagaagattctgcccccagcaggatgattggagtggccatgcctggcctgggcgtgctgcccggcctggtgcaggcccctggagatgctgagtgcagccggctgctgcagatcctggagctgggccgccacagtgaatgtgtgcacgtgacagaggaggagcagctgcagctgcgggagatcctggagcggcggggcagcggggagctgtatgagcacgagaaggacctggtgtggaagctgcggcatgaggtgcaggagcacttccctgaggccctggcccggctgctgctggtgaccaagtggaacaagcatgaagatgtggcccagatgctgtacctgctgtgctcctggccagagctgcctgtgctgagcgccctggagctgctggacttctccttcccagactgccacgtgggcagctttgccatcaagagcctgaggaagctgacagatgatgagctgttccagtacctgctgcagctggtgcaggtgctgaagtatgagagctacctggactgtgagctgaccaagttcctgctggaccgggccctggccaacaggaagattggccacttcctgttctggcacctgcggtctgagatgcacgtgcccagcgtggccctgcgcttcggcctcatcctggaggcctactgccggggcagcacccaccacatgaaggtgctgatgaagcagggcgaggccctgagcaagctgaaggccctgaatgactttgtgaagctgagcagccagaagacccccaagccccagaccaaggagctgatgcacctgtgcatgaggcaggaggcctacctggaggccctgagccacctgcagagccccctggaccccagcaccctgctggccgaggtgtgtgtggagcagtgcaccttcatggacagcaagatgaagcccctgtggatcatgtacagcaatgaggaggccggcagcggcggctctgtgggcatcatcttcaagaatggagatgacctgcggcaggacatgctgaccctgcagatgatccagctgatggatgtgctgtggaagcaggagggcctggacctgaggatgaccccctacggctgcctgcccaccggggacagaacaggcctgattgaggtggtgctgcggagtgacaccatcgccaacatccagctgaacaagagcaacatggccgccacagctgccttcaacaaggatgccctgctgaactggctgaagagcaagaaccctggagaggccctggaccgggccatcgaggagttcaccctgagctgtgccggctactgtgtggccacctacgtgctgggcattggagacagacacagcgacaacatcatgatccgggagagcggccagctgttccacatcgactttggccacttcctgggcaacttcaagaccaagtttggcatcaaccgggagcgggtgcccttcatcctgacctatgactttgtgcacgtgatccagcagggcaagaccaacaacagcgagaagtttgagcgcttccggggctactgtgagcgggcctacaccatcctgcggcggcacggcctgctcttcctgcacctgtttgccctgatgagagctgctggcctgcctgagctgagctgcagcaaggacatccagtacctgaaggacagcctggccctgggcaagacagaggaggaggccctgaagcacttccgggtgaagttcaatgaggccctgcgggagagctggaagaccaaggtgaactggctggcccacaacgtgtccaaggacaaccggcagtag

SEQ ID NO: 21084 - DNA, 3135 bp, Artificial Sequence
  Description of Artificial Sequence: Synthetic coding sequence
atgcctcctggggtggactgccccatggagttctggaccaaggaggagaaccagagcgtggtggtggacttcctgctgcccaccggggtgtacctgaacttccctgtgtccagaaatgccaacctgagcaccatcaagcagctgctgtggcaccgggcccagtatgagcccctcttccacatgctgagcggccctgaggcctacgtgttcacctgcatcaaccagacagctgagcagcaggagctggaggatgagcagaggcggctgtgtgatgtgcagcccttcctgcctgtgctgcggctggtggcccgggagggggacagagtgaagaagctgatcaacagccagatcagcctgctgattggcaagggcctgcacgagtttgacagcctgtgtgaccctgaggtgaatgacttccgggccaagatgtgccagttctgtgaggaggccgccgcccggcggcagcagctgggctgggaggcctggctgcagtacagcttccccctgcagctggagcccagcgcccagacctggggccctggcaccctgcggctgcccaacagagccctgctggtgaatgtgaagtttgagggcagcgaggagagcttcaccttccaggtgtccaccaaggatgtgcccctggccctgatggcctgtgccctgaggaagaaggccaccgtcttccggcagcccctggtggagcagcctgaggactacaccctgcaggtgaatggaagacatgagtacctgtatggcagctaccccctgtgccagttccagtacatctgcagctgcctgcacagcggcctgaccccccacctgaccatggtgcacagcagcagcatcctggccatgagagatgagcagagcaacccagccccccaggtgcagaagccccgggccaagcccccacccatcccagccaagaagcccagctctgtgtccctgtggagcctggagcagcccttcagaattgagctgatccagggcagcaaggtgaatgctgatgagaggatgaagctggtggtgcaggccggcctcttccatggaaatgagatgctgtgcaagacagtgagcagcagcgaggtgtctgtgtgcagcgagcctgtgtggaagcagaggctggagtttgacatcaacatctgtgacctgcccaggatggcccggctgtgctttgccctgtatgctgtgattgagaaggccaagaaggcccggagcaccaagaagaagagcaagaaggctgactgccccatcgcctgggccaacctgatgctgtttgactacaaggaccagctgaagacaggagagcgctgcctgtacatgtggcccagcgtgcctgatgagaagggggagctgctgaaccccaccggcaccgtgcgcagcaaccccaacacagattctgctgctgccctgctgatctgcctgcctgaggtggccccccaccctgtgtactacccagccctggagaagatcctggagctgggccgccacagtgaatgtgtgcacgtgacagaggaggagcagctgcagctgcgggagatcctggagcggcggggcagcggggagctgtatgagcacgagaaggacctggtgtggaagctgcggcatgaggtgcaggagcacttccctgaggccctggcccggctgctgctggtgaccaagtggaacaagcatgaagatgtggcccagatgctgtacctgctgtgctcctggccagagctgcctgtgctgagcgccctggagctgctggacttctccttcccagactgccacgtgggcagctttgccatcaagagcctgaggaagctgacagatgatgagctgttccagtacctgctgcagctggtgcaggtgctgaagtatgagagctacctggactgtgagctgaccaagttcctgctggaccgggccctggccaacaggaagattggccacttcctgttctggcacctgcggtctgagatgcacgtgcccagcgtggccctgcgcttcggcctcatcctggaggcctactgccggggcagcacccaccacatgaaggtgctgatgaagcagggcgaggccctgagcaagctgaaggccctgaatgactttgtgaagctgagcagccagaagacccccaagccccagaccaaggagctgatgcacctgtgcatgaggcaggaggcctacctggaggccctgagccacctgcagagccccctggaccccagcaccctgctggccgaggtgtgtgtggagcagtgcaccttcatggacagcaagatgaagcccctgtggatcatgtacagcaatgaggaggccggcagcggcggctctgtgggcatcatcttcaagaatggagatgacctgcggcaggacatgctgaccctgcagatgatccagctgatggatgtgctgtggaagcaggagggcctggacctgaggatgaccccctacggctgcctgcccaccggggacagaacaggcctgattgaggtggtgctgcggagtgacaccatcgccaacatccagctgaacaagagcaacatggccgccacagctgccttcaacaaggatgccctgctgaactggctgaagagcaagaaccctggagaggccctggaccgggccatcgaggagttcaccctgagctgtgccggctactgtgtggccacctacgtgctgggcattggagacagacacagcgacaacatcatgatccgggagagcggccagctgttccacatcgactttggccacttcctgggcaacttcaagaccaagtttggcatcaaccgggagcgggtgcccttcatcctgacctatgactttgtgcacgtgatccagcagggcaagaccaacaacagcgagaagtttgagcgcttccggggctactgtgagcgggcctacaccatcctgcggcggcacggcctgctcttcctgcacctgtttgccctgatgagagctgctggcctgcctgagctgagctgcagcaaggacatccagtacctgaaggacagcctggccctgggcaagacagaggaggaggccctgaagcacttccgggtgaagttcaatgaggccctgcgggagagctggaagaccaaggtgaactggctggcccacaacgtgtccaaggacaaccggcagtag

SEQ ID NO: 21085 - DNA, 3207 bp, Artificial Sequence; identical to SEQ ID NO: 21083
  Description of Artificial Sequence: Synthetic coding sequence

SEQ ID NO: 21086 - DNA, 960 bp, Artificial Sequence
  Description of Artificial Sequence: Synthetic coding sequence
atgatccctgagagcagcgagctggtggtgcaggccggcctcttccacggcaatgagatgctgtgcaagacagtgagcagcagcgaggtgtctgtgtgcagcgagcctgtgtggaagcagaggctggagtttgacatcaacatctgtgacctgcccaggatggcccggctgtgctttgccctgtatgctgtgattgagaaggccaagaaggcccggagcaccaagaagaagagcaagaaggctgactgccccatcgcctgggccaacctgatgctgtttgactacaaggaccagctgaagacaggagagcgctgcctgtacatgtggcccagcgtgcctgatgagaagggggagctgctgaaccccactggaacagtgcgcagcaaccccaacacagacagcgctgctgccctgctgatctgcctgcctgaggtggccccccaccctgtgtactacccagccctggagaagatcctggagctgggccgccacagtgaatgtgtgcacgtgacagaggaggagcagctgcagctgcgggagatcctggagcggcggggcagcggggagctgtatgaacatgagaaggacctggtgtggaagctgcggcatgaggtgcaggagcacttccctgaggccctggcccggctgctgctggtgaccaagtggaacaagcatgaagatgtggcccagatgctgtacctgctgtgctcctggccagagctgcctgtgctgagcgccctggagctgctggacttctccttcccagactgccacgtgggcagctttgccatcaagagcctgaggaagctgacagatgatgagctgttccagtacctgctgcagctggtgcaggtgctgaagtatgagagctacctggactgtgagctgaccaagttcctgctggaccgggccctggccaacaggaagattggccacttcctgttctggcacctgaggtag

SEQ ID NO: 21087 - DNA, 3309 bp, Artificial Sequence
  Description of Artificial Sequence: Synthetic coding sequence
atggagctggagaactacaagcagcctgtggtgctgcgggaggacaactgcagaagaagaagaaggatgaagcccaggtctgctgctgccagcctgagctccatggagctgatccccatcgagtttgtgctgcccaccagccagaggaagtgcaagagccctgagacagccctgctgcacgtggccggccacggcaatgtggagcagatgaaggcccaggtgtggctgcgggccctggagacctctgtggccgctgacttctaccaccggctgggcccccaccacttcctgctgctgtaccagaagaagggccagtggtatgagatctatgacaagtaccaggtggtgcagaccctggactgcctgcgctactggaaggccacccacaggagccctggccagatccacctggtgcagaggcacccccccagcgaggagagccaggccttccagaggcagctgacagccctgattggctatgatgtgacagatgtgtccaatgtgcatgatgatgagctggagttcacccggcggggcctggtgacccccaggatggccgaggtggccagccgggaccccaagctgtatgccatgcacccctgggtgaccagcaagcccctgcctgagtacctgtggaagaagatcgccaacaactgcatcttcatcgtcatccacaggagcaccaccagccagaccatcaaggtgtccccagatgacacccctggggccatcctgcagagcttcttcaccaagatggccaagaagaagagcctgatggacatccctgagagccagagcgagcaggactttgtgctgcgggtgtgtggcagagatgagtacctggtgggggagacccccatcaagaacttccagtgggtgcgccactgcctgaagaatggagaggagatccacgtggtgctggacaccccaccagaccctgccctggatgaggtgaggaaggaggagtggcccctggtggatgactgcaccggggtgacaggctaccacgagcagctgaccatccacggcaaggaccacgagagcgtcttcaccgtgtccctgtgggactgtgacaggaagttccgggtgaagatccggggcatcgacatccctgtgctgcccaggaacacagacctgactgtgtttgtggaggccaacatccagcacggccagcaggtgctgtgccagaggaggaccagccccaagcccttcacagaggaggtgctgtggaatgtgtggctggagttcagcatcaagatcaaggacctgcccaagggggccctgctgaacctgcagatctactgcggcaaggccccagccctgagcagcaaggccagcgctgagagccccagcagcgagagcaagggcaaggtgcagctgctgtactacgtgaacctgctgctgattgaccaccgcttcctgctgcggcggggggagtatgtgctgcacatgtggcagatcagcggcaagggggaggaccagggcagcttcaatgctgacaagctgaccagcgccaccaacccagacaaggaaaattccatgagcatcagcatcctgctggacaactactgccaccccatcgccctgcccaagcaccagcccaccccagaccctgagggggacagagtgcgggcagagatgcccaaccagctgaggaagcagctggaggccatcatcgccacagaccccctgaaccccctgacagctgaggacaaggagctgctgtggcacttccgctatgagagcctgaagcaccccaaggcctaccccaagctgttcagctctgtgaagtggggccagcaggagatcgtggccaagacctaccagctgctggcccggcgggaggtgtgggaccagagcgccctggatgtgggcctgaccatgcagctgctggactgcaacttcagtgatgaaaatgtgcgggccatcgctgtgcagaagctggagagcctggaggatgatgatgtgctgcactacctgctgcagctggtgcaggccgtgaagtttgagccctaccatgattctgccctggcccgcttcctgctgaagaggggcctgaggaacaagagaattggccacttcctgttctggttcctgcggagtgaaattgcccagagccgccactaccagcagagatttgctgtgatcctggaggcctacctgcggggctgcggcacagccatgctgcatgacttcacccagcaggtgcaggtgattgagatgctgcagaaggtgaccctggacatcaagagcctgtctgctgagaagtatgatgtgagcagccaggtgatcagccagctgaagcagaagctggagaacctgcagaacagccagctgcctgagagcttccgggtgccctatgaccccggcctgaaggccggggccctggccatcgagaagtgcaaggtgatggccagcaagaagaagcccctgtggctggagttcaagtgtgccgaccccacagccctgagcaatgagaccatcggcatcatcttcaagcatggagatgacctgcggcaggacatgctgatcctgcagatcctgcgcatcatggagagcatctgggagacagagagcctggacctgtgcctgctgccctacggctgcatcagcactggagacaagattggcatgattgaaattgtgaaggatgccaccaccatcgccaagatccagcagagcacagtgggcaacacaggagccttcaaggatgaggtgctgaaccactggctgaaggagaagagccccacagaggagaagttccaggccgctgtggagagatttgtgtacagctgtgccggctactgtgtggccacctttgtgctgggcatcggggacagacacaatgacaacatcatgatcacagaaacaggcaacctcttccacatcgactttggccacatcctgggcaactacaagagcttcctgggcatcaacaaggagcgggtgccctttgtgctgaccccagacttcctgtttgtgatgggcaccagcggcaagaagaccagcccccacttccagaagttccaggacatctgtgtgaaggcctacctggccctgcggcaccacaccaacctgctgatcatcctcttctccatgatgctgatgacaggcatgccccagctgaccagcaaggaggacatcgagtacatcagagatgccctgactgtgggcaagaatgaggaggatgccaagaagtacttcctggaccagatcgaggtgtgccgggacaagggctggacagtgcagttcaactggttcctgcacctggtgctgggcatcaagcagggcgagaagcacagcgcctag

SEQ ID NO: 21088 - DNA, 3309 bp, Artificial Sequence; identical to SEQ ID NO: 21087
  Description of Artificial Sequence: Synthetic coding sequence

SEQ ID NO: 21089 - DNA, 3309 bp, Artificial Sequence; identical to SEQ ID NO: 21087
  Description of Artificial Sequence: Synthetic coding sequence

SEQ ID NO: 21090 - DNA, 5061 bp, Artificial Sequence
  Description of Artificial Sequence: Synthetic coding sequence
atggcccagatcagcagcaacagcggcttcaaggagtgccccagcagccaccctgagcccacccgggccaaggatgtggacaaggaggaggccctgcagatggaggccgaggccctggccaagctgcagaaggaccggcaggtgacagacaaccagaggggctttgagctgagcagcagcaccaggaagaaggcccaggtgtacaacaagcaggactatgacctgatggtgtttcctgagagtgacagccagaagagggccctggacattgatgtggagaagctgacccaggccgagctggagaagctgctgctggatgacagctttgagaccaagaagacccctgtgctgcctgtgacccccatcctgagccccagcttcagcgcccagctgtacttccggcccaccatccagaggggccagtggcccccaggcctgcccggccccagcacctacgccctgcccagcatctaccccagcacctacagcaagcaggccgccttccagaatggcttcaaccccaggatgcccaccttccccagcacagagcccatctacctgagcctgcccggccagagcccctacttctcctaccccctgaccccagccacccccttccacccccagggcagcctgcccatctacagacctgtggtgtccacagacatggccaagctgtttgacaagatcgccagcaccagcgagttcctgaagaatggcaaggccaggacagacctggagatcacagacagcaaggtgagcaacctgcaggtgagccccaagtctgaggacatcagcaagtttgactggctggacctggaccccctgagcaagcccaaggtggacaacgtggaggtgctggaccacgaggaggagaagaatgtgagcagcctgctggccaaggacccctgggatgctgtgctgctggaggagaggagcacagccaactgccacctggagaggaaggtgaatggcaagagcctgtctgtggccaccgtgaccaggagccagagcctgaacatccgcaccacccagctggccaaggcccagggccacatcagccagaaggaccccaacggcaccagcagcctgcccaccggcagcagcctgctgcaggaggtggaggtgcagaatgaggagatggccgccttctgccgcagcatcaccaagctgaagaccaagttcccctacaccaaccacaggaccaaccctggctacctgctgagccctgtgacagcccagaggaacatctgtggggagaatgcctctgtgaaggtgtccattgacatcgagggcttccagctgcctgtgaccttcacctgtgatgtgagcagcacagtggagatcatcatcatgcaggccctgtgctgggtgcatgatgacctgaaccaggtggatgtgggcagctatgtgctgaaggtgtgtggccaggaggaggtgctgcagaacaaccactgcctgggcagccatgagcacatccagaactgcaggaagtgggacacagagatccggctgcagctgctgaccttcagcgccatgtgccagaacctggccaggacagcagaagatgatgagacccctgtggacctgaacaagcacctgtaccagatcgagaagccctgcaaggaggccatgaccaggcaccctgtggaggagctgctggacagctaccacaaccaggtggagctggccctgcagatcgagaaccagcacagagctgtggaccaggtgatcaaggctgtgaggaagatctgcagcgccctggatggagtggagaccctggccatcacagaatctgtgaagaagctgaagagagctgtgaacctgcccaggagcaagacagcagatgtgaccagcctgtttggaggagaggacaccagccgcagcagcacccggggcagcctgaaccctgagaaccctgtgcaggtgtccatcaaccagctgacagctgccatctatgacctgctgcggctgcacgccaacagcggccgcagccccacagactgtgcccagagcagcaagtctgtgaaggaggcctggaccaccacagagcagctgcagttcaccatctttgctgcccacggcatcagcagcaactgggtgagcaactatgagaagtactacctgatctgcagcctgagccacaacgggaaggacctcttcaagcccatccagagcaagaaggtgggcacctacaagaacttcttctacctgatcaagtgggatgagctgatcatcttccccatccagatcagccagctgcccctggagagcgtgctgcacctgaccctgtttggcatcctgaaccagagcagcggcagcagcccagacagcaacaagcagaggaaaggacctgaggccctgggcaaggtgtccctgcccctgtttgacttcaagcgcttcctgacctgtggcaccaagctgctgtacctgtggaccagcagccacaccaacagcgtgcccggcaccgtgaccaagaagggctacgtgatggagcgcatcgtgctgcaggtggacttccccagccctgcctttgacatcatctacaccaccccccaggtggacaggagcatcatccagcagcacaacctggagaccctggagaatgacatcaagggcaagctgctggacatcctgcacaaggacagcagcctgggcctgagcaaggaggacaaggccttcctgtgggagaagcgctactactgcttcaagcaccccaactgcctgcccaagatcctggccagcgcccccaactggaagtgggtgaacctggccaagacctacagcctgctgcaccagtggccagccctgtaccccctgattgccctggagctgctggacagcaagtttgctgaccaggaggtgcgcagcctggccgtgacctggattgaggccatcagtgatgatgagctgacagacctgctgccccagtttgtgcaggccctgaagtatgagatctacctgaacagcagcctggtgcagttcctgctgagccgggccctgggcaacatccagatcgcccacaacctgtactggctgctgaaggatgccctgcatgatgtgcagttcagcaccaggtatgaacatgtgctgggcgccctgctgtctgtgggcggcaagaggctgcgggaggagctgctgaagcagaccaagctggtgcagctgctgggcggcgtggccgagaaggtgcggcaggccagcggcagcgcccggcaggtggtgctgcagaggtccatggagcgggtgcagagcttcttccagaagaacaagtgccgcctgcccctgaagcccagcctggtggccaaggagctgaacatcaagagctgcagcttcttcagcagcaatgctgtgcccctgaaggtgaccatggtgaatgctgaccccatgggagaggagatcaacgtgatgttcaaggtgggggaggacctgcggcaggacatgctggccctgcagatgatcaagatcatggacaagatctggctgaaggagggcctggacctgaggatggtgatcttcaagtgcctgagcacaggccgggaccggggcatggtggagctggtgcctgccagtgacaccctgaggaagatccaggtggagtatggagtgacaggcagcttcaaggacaagcccctggccgagtggctgaggaagtacaaccccagcgaggaggagtatgagaaggccagcgagaacttcatctacagctgtgccggctgctgcgtggccacctacgtgctgggcatctgtgacagacacaatgacaacatcatgctgcggagcacaggccacatgttccacatcgactttgggaagttcctgggccacgcccagatgtttggcagcttcaagagggaccgggccccctttgtgctgaccagtgacatggcctacgtgatcaatggaggagagaagcccaccatccgcttccagctgtttgtggacctgtgctgccaggcctacaacctgatcaggaagcagaccaacctcttcctgaacctgctgagcctgatgatccccagcggcctgcctgagctgaccagcatccaggacctgaagtatgtgagagatgccctgcagccccagaccacagatgctgaggccaccatcttcttcacccggctgattgagagcagcctgggcagcatcgccaccaagttcaacttcttcatccacaacctggcccagctgcgcttcagcggcctgcccagcaatgatgagcccatcctgtccttcagccccaagacctacagcttccggcaggacggccgcatcaaggaggtgtctgtgttcacctaccacaagaagtacaacccagacaagcactacatctacgtggtgcgcatcctgcgggagggccagatcgagcccagctttgtgttccgcacctttgatgagttccaggagctgcacaacaagctgagcatcatcttccccctgtggaagctgcccggcttccccaacaggatggtgctgggccgcacccacatcaaggatgtggccgccaagaggaagattgagctgaacagctacctgcagagcctgatgaatgccagcacagatgtggctgaatgtgacctggtgtgcaccttcttccaccccctgctgagagatgagaaggccgagggcatcgcccggtctgcagatgctggcagcttcagccccaccccaggccagattggaggagctgtgaagctgagcatctcctacagaaatggcaccctcttcatcatggtgatgcacatcaaggacctggtgacagaagatggagctgaccccaacccctacgtgaagacctacctgctgcctgacaaccacaagaccagcaagaggaagaccaagatcagcaggaagaccaggaaccccaccttcaatgagatgctggtgtacagcggctacagcaaggagaccctgcggcagcgggagctgcagctgtctgtgctgtctgctgagagcctgcgggagaacttcttcctgggcggcgtgaccctgcccctgaaggacttcaacctgagcaaggagaccgtgaagtggtaccagctgacagctgccacctacctgtag

SEQ ID NO: 21091 - DNA, 393 bp, Artificial Sequence
  Description of Artificial Sequence: Synthetic coding sequence
atggcccagatcagcagcaacagcggcttcaaggagtgccccagcagccaccctgagcccacccgggccaaggatgtggacaaggaggaggccctgcagatggaggccgaggccctggccaagctgcagaaggaccggcaggtgacagacaaccagaggggctttgagctgagcagcagcaccaggaagaaggcccaggtgtacaacaagcaggactatgacctgatggtgtttcctgagagtgacagccagaagagggccctggacattgatgtggagaagctgacccaggccgagctggagaagctgctgctggatgacagctttgagaccaagaagacccctgtgctgcctgtgacccccatcctgagccccagcttcagcgcccagtag

SEQ ID NO: 21092 - DNA, 1452 bp, Artificial Sequence
  Description of Artificial Sequence: Synthetic coding sequence
atggcccagatcagcagcaacagcggcttcaaggagtgccccagcagccaccctgagcccacccgggccaaggatgtggacaaggaggaggccctgcagatggaggccgaggccctggccaagctgcagaaggaccggcaggtgacagacaaccagaggggctttgagctgagcagcagcaccaggaagaaggcccaggtgtacaacaagcaggactatgacctgatggtgtttcctgagagtgacagccagaagagggccctggacattgatgtggagaagctgacccaggccgagctggagaagctgctgctggatgacagctttgagaccaagaagacccctgtgctgcctgtgacccccatcctgagccccagcttcagcgcccagctgtacttccggcccaccatccagaggggccagtggcccccaggcctgcccggccccagcacctacgccctgcccagcatctaccccagcacctacagcaagcaggccgccttccagaatggcttcaaccccaggatgcccaccttccccagcacagagcccatctacctgagcctgcccggccagagcccctacttctcctaccccctgaccccagccacccccttccacccccagggcagcctgcccatctacagacctgtggtgtccacagacatggccaagctgtttgacaagatcgccagcaccagcgagttcctgaagaatggcaaggccaggacagacctggagatcacagacagcaaggtgagcaacctgcaggtgagccccaagtctgaggacatcagcaagtttgactggctggacctggaccccctgagcaagcccaaggtggacaacgtggaggtgctggaccacgaggaggagaagaatgtgagcagcctgctggccaaggacccctgggatgctgtgctgctggaggagaggagcacagccaactgccacctggagaggaaggtgaatggcaagagcctgtctgtggccaccgtgaccaggagccagagcctgaacatccgcaccacccagctggccaaggcccagggccacatcagccagaaggaccccaacggcaccagcagcctgcccaccggcagcagcctgctgcaggaggtggaggtgcagaatgaggagatggccgccttctgccgcagcatcaccaagctgaagaccaagttcccctacaccaaccacaggaccaaccctggctacctgctgagccctgtgacagcccagaggaacatctgtggggagaatgcctctgtgaaggtgtccattgacatcgagggcttccagctgcctgtgaccttcacctgtgatgtgagcagcacagtggagatcatcatcatgcaggccctgtgctgggtgcatgatgacctgaaccaggtggatgtgggcagctatgtgctgaaggtgtgtggccaggaggaggtgctgcagaagtag

SEQ ID NO: 21093 - DNA, 3921 bp, Artificial Sequence
  Description of Artificial Sequence: Synthetic coding sequence
atggccgccttctgccgcagcatcaccaagctgaagaccaagttcccctacaccaaccacaggaccaaccctggctacctgctgagccctgtgacagcccagaggaacatctgtggggagaatgcctctgtgaaggtgtccattgacatcgagggcttccagctgcctgtgaccttcacctgtgatgtgagcagcacagtggagatcatcatcatgcaggccctgtgctgggtgcatgatgacctgaaccaggtggatgtgggcagctatgtgctgaaggtgtgtggccaggaggaggtgctgcagaacaaccactgcctgggcagccatgagcacatccagaactgcaggaagtgggacacagagatccggctgcagctgctgaccttcagcgccatgtgccagaacctggccaggacagcagaagatgatgagacccctgtggacctgaacaagcacctgtaccagatcgagaagccctgcaaggaggccatgaccaggcaccctgtggaggagctgctggacagctaccacaaccaggtggagctggccctgcagatcgagaaccagcacagagctgtggaccaggtgatcaaggctgtgaggaagatctgcagcgccctggatggagtggagaccctggccatcacagaatctgtgaagaagctgaagagagctgtgaacctgcccaggagcaagacagcagatgtgaccagcctgtttggaggagaggacaccagccgcagcagcacccggggcagcctgaaccctgagaaccctgtgcaggtgtccatcaaccagctgacagctgccatctatgacctgctgcggctgcacgccaacagcggccgcagccccacagactgtgcccagagcagcaagtctgtgaaggaggcctggaccaccacagagcagctgcagttcaccatctttgctgcccacggcatcagcagcaactgggtgagcaactatgagaagtactacctgatctgcagcctgagccacaacgggaaggacctcttcaagcccatccagagcaagaaggtgggcacctacaagaacttcttctacctgatcaagtgggatgagctgatcatcttccccatccagatcagccagctgcccctggagagcgtgctgcacctgaccctgtttggcatcctgaaccagagcagcggcagcagcccagacagcaacaagcagaggaaaggacctgaggccctgggcaaggtgtccctgcccctgtttgacttcaagcgcttcctgacctgtggcaccaagctgctgtacctgtggaccagcagccacaccaacagcgtgcccggcaccgtgaccaagaagggctacgtgatggagcgcatcgtgctgcaggtggacttccccagccctgcctttgacatcatctacaccaccccccaggtggacaggagcatcatccagcagcacaacctggagaccctggagaatgacatcaagggcaagctgctggacatcctgcacaaggacagcagcctgggcctgagcaaggaggacaaggccttcctgtgggagaagcgctactactgcttcaagcaccccaactgcctgcccaagatcctggccagcgcccccaactggaagtgggtgaacctggccaagacctacagcctgctgcaccagtggccagccctgtaccccctgattgccctggagctgctggacagcaagtttgctgaccaggaggtgcgcagcctggccgtgacctggattgaggccatcagtgatgatgagctgacagacctgctgccccagtttgtgcaggccctgaagtatgagatctacctgaacagcagcctggtgcagttcctgctgagccgggccctgggcaacatccagatcgcccacaacctgtactggctgctgaaggatgccctgcatgatgtgcagttcagcaccaggtatgaacatgtgctgggcgccctgctgtctgtgggcggcaagaggctgcgggaggagctgctgaagcagaccaagctggtgcagctgctgggcggcgtggccgagaaggtgcggcaggccagcggcagcgcccggcaggtggtgctgcagaggtccatggagcgggtgcagagcttcttccagaagaacaagtgccgcctgcccctgaagcccagcctggtggccaaggagctgaacatcaagagctgcagcttcttcagcagcaatgctgtgcccctgaaggtgaccatggtgaatgctgaccccatgggagaggagatcaacgtgatgttcaaggtgggggaggacctgcggcaggacatgctggccctgcagatgatcaagatcatggacaagatctggctgaaggagggcctggacctgaggatggtgatcttcaagtgcctgagcacaggccgggaccggggcatggtggagctggtgcctgccagtgacaccctgaggaagatccaggtggagtatggagtgacaggcagcttcaaggacaagcccctggccgagtggctgaggaagtacaaccccagcgaggaggagtatgagaaggccagcgagaacttcatctacagctgtgccggctgctgcgtggccacctacgtgctgggcatctgtgacagacacaatgacaacatcatgctgcggagcacaggccacatgttccacatcgactttgggaagttcctgggccacgcccagatgtttggcagcttcaagagggaccgggccccctttgtgctgaccagtgacatggcctacgtgatcaatggaggagagaagcccaccatccgcttccagctgtttgtggacctgtgctgccaggcctacaacctgatcaggaagcagaccaacctcttcctgaacctgctgagcctgatgatccccagcggcctgcctgagctgaccagcatccaggacctgaagtatgtgagagatgccctgcagccccagaccacagatgctgaggccaccatcttcttcacccggctgattgagagcagcctgggcagcatcgccaccaagttcaacttcttcatccacaacctggcccagctgcgcttcagcggcctgcccagcaatgatgagcccatcctgtccttcagccccaagacctacagcttccggcaggacggccgcatcaaggaggtgtctgtgttcacctaccacaagaagtacaacccagacaagcactacatctacgtggtgcgcatcctgcgggagggccagatcgagcccagctttgtgttccgcacctttgatgagttccaggagctgcacaacaagctgagcatcatcttccccctgtggaagctgcccggcttccccaacaggatggtgctgggccgcacccacatcaaggatgtggccgccaagaggaagattgagctgaacagctacctgcagagcctgatgaatgccagcacagatgtggctgaatgtgacctggtgtgcaccttcttccaccccctgctgagagatgagaaggccgagggcatcgcccggtctgcagatgctggcagcttcagccccaccccaggccagattggaggagctgtgaagctgagcatctcctacagaaatggcaccctcttcatcatggtgatgcacatcaaggacctggtgacagaagatggagctgaccccaacccctacgtgaagacctacctgctgcctgacaaccacaagaccagcaagaggaagaccaagatcagcaggaagaccaggaaccccaccttcaatgagatgctggtgtacagcggctacagcaaggagaccctgcggcagcgggagctgcagctgtctgtgctgtctgctgagagcctgcgggagaacttcttcctgggcggcgtgaccctgcccctgaaggacttcaacctgagcaaggagaccgtgaagtggtaccagctgacagctgccacctacctgtag

SEQ ID NO: 21094 - DNA, 1947 bp, Artificial Sequence
  Description of Artificial Sequence: Synthetic coding sequence
atggcccagatcagcagcaacagcggcttcaaggagtgccccagcagccaccctgagcccacccgggccaaggatgtggacaaggaggaggccctgcagatggaggccgaggccctggccaagctgcagaaggaccggcaggtgacagacaaccagaggggctttgagctgagcagcagcaccaggaagaaggcccaggtgtacaacaagcaggactatgacctgatggtgtttcctgagagtgacagccagaagagggccctggacattgatgtggagaagctgacccaggccgagctggagaagctgctgctggatgacagctttgagaccaagaagacccctgtgctgcctgtgacccccatcctgagccccagcttcagcgcccagctgtacttccggcccaccatccagaggggccagtggcccccaggcctgcccggccccagcacctacgccctgcccagcatctaccccagcacctacagcaagcaggccgccttccagaatggcttcaaccccaggatgcccaccttccccagcacagagcccatctacctgagcctgcccggccagagcccctacttctcctaccccctgaccccagccacccccttccacccccagggcagcctgcccatctacagacctgtggtgtccacagacatggccaagctgtttgacaagatcgccagcaccagcgagttcctgaagaatggcaaggccaggacagacctggagatcacagacagcaaggtgagcaacctgcaggtgagccccaagtctgaggacatcagcaagtttgactggctggacctggaccccctgagcaagcccaaggtggacaacgtggaggtgctggaccacgaggaggagaagaatgtgagcagcctgctggccaaggacccctgggatgctgtgctgctggaggagaggagcacagccaactgccacctggagaggaaggtgaatggcaagagcctgtctgtggccaccgtgaccaggagccagagcctgaacatccgcaccacccagctggccaaggcccagggccacatcagccagaaggaccccaacggcaccagcagcctgcccaccggcagcagcctgctgcaggaggtggaggtgcagaatgaggagatggccgccttctgccgcagcatcaccaagctgaagaccaagttcccctacaccaaccacaggaccaaccctggctacctgctgagccctgtgacagcccagaggaacatctgtggggagaatgcctctgtgaaggtgtccattgacatcgagggcttccagctgcctgtgaccttcacctgtgatgtgagcagcacagtggagatcatcatcatgcaggccctgtgctgggtgcatgatgacctgaaccaggtggatgtgggcagctatgtgctgaaggtgtgtggccaggaggaggtgctgcagaacaaccactgcctgggcagccatgagcacatccagaactgcaggaagtgggacacagagatccggctgcagctgctgaccttcagcgccatgtgccagaacctggccaggacagcagaagatgatgagacccctgtggacctgaacaagcacctgtaccagatcgagaagccctgcaaggaggccatgaccaggcaccctgtggaggagctgctggacagctaccacaaccaggtggagctggccctgcagatcgagaaccagcacagagctgtggaccaggtgatcaaggctgtgaggaagatctgcagcgccctggatggagtggagaccctggccatcacagaatctgtgaagaagctgaagagagctgtgaacctgcccaggagcaagacagcagatgtgaccagcctgtttggaggagaggacaccagccgcagcagcacccggggcagcctgaaccctgagaaccctgtgcaggtgtccatcaaccagctgtag

SEQ ID NO: 21095 - DNA, 2664 bp, Artificial Sequence
  Description of Artificial Sequence: Synthetic coding sequence
atgggagaggccgagaagttccactacatctacagctgtgacctggacatcaacgtgcagctgaagattggcagcctggagggcaagcgggagcagaagagctacaaggctgtgctggaggaccccatgctgaagttcagcggcctgtaccaggagacctgcagcgacctgtatgtgacctgccaggtgtttgctgagggcaagcccctggccctgcctgtgaggaccagctacaaggccttcagcacccgctggaactggaatgagtggctgaagctgcctgtgaagtacccagacctgcccagaaatgcccaggtggccctgaccatctgggatgtgtatggccctgggaaggctgtgcctgtgggcggcaccaccgtgtccctgtttgggaagtatggcatgttccggcagggcatgcatgacctgaaggtgtggcccaacgtggaggctgatggcagcgagcccaccaagaccccaggccgcaccagcagcaccctgtctgaggaccagatgagccggctggccaagctgaccaaggcccaccggcagggccacatggtgaaggtggactggctggaccggctgaccttccgggagattgagatgatcaatgaaagtgagaagaggagcagcaacttcatgtacctgatggtggagttccgctgtgtgaagtgtgatgacaaggagtatggaattgtgtactatgagaaggatggagatgagagcagccccatcctgaccagctttgagctggtgaaggtgcctgacccccagatgtccatggagaacctggtggagagcaagcaccacaagctggcccggagcctgcggagcggccccagcgaccatgacctgaagcccaatgctgccacccgggaccagctgaacatcatcgtgtcctacccacccaccaagcagctgacctatgaggagcaggacctggtgtggaagttccgctactacctgaccaaccaggagaaggccctgaccaagttcctgaagtgtgtgaactgggacctgccccaggaggccaagcaggccctggagctgctgggcaagtggaagcccatggatgtggaggacagcctggagctgctgagcagccactacaccaaccccaccgtgagaagatatgctgtggcccggctgcggcaggctgatgatgaggacctgctgatgtacctgctgcagctggtgcaggccctgaagtatgagaactttgatgacatcaagaatggcctggagcccaccaagaaggacagccagagctctgtgtctgaaaatgtgagcaacagcggcatcaacagcgctgagattgacagcagccagatcatcaccagccccctgcccagcgtgagcagccccccaccagccagcaagaccaaggaggtgcctgatggagagaacctggagcaggacctgtgcaccttcctgatcagccgggcctgcaagaacagcaccctggccaactacctgtactggtacgtgattgtggagtgtgaggaccaggacacccagcagagggaccccaagacccatgagatgtacctgaatgtgatgaggcgcttcagccaggccctgctgaagggggacaagtctgtgcgggtgatgaggagcctgctggccgcccagcagacctttgtggaccggctggtgcacctgatgaaggctgtgcagcgggagagcggcaacaggaagaagaagaatgaaaggctgcaggccctgctgggggacaatgagaagatgaacctgagtgatgtggagctgatccccctgcccctggagccccaggtgaagatccggggcatcatccctgagacagccaccctcttcaagagcgccctgatgcctgcccagctgttcttcaagacagaagatggcggcaagtaccctgtgatcttcaagcatggagatgacctgcggcaggaccagctgatcctgcagatcatcagcctgatggacaagctgctgaggaaagaaaacctggacctgaagctgaccccctacaaggtgctggccaccagcaccaagcacggcttcatgcagttcatccagagcgtgcctgtggccgaggtgctggacacagagggcagcatccagaacttcttcagaaaatatgcccccagtgaaaatggccccaacggcatctctgctgaggtgatggacacctacgtgaagagctgtgccggctactgtgtgatcacctacatcctgggcgtgggggacagacacctggacaacctgctgctgaccaagacaggcaagctgttccacatcgactttggctacatcctgggccgggaccccaagcccctgcccccacccatgaagctgaacaaggagatggtggagggcatgggcggcacccagagcgagcagtaccaggagttcaggaagcagtgctacacagccttcctgcacctgcggcgctacagcaacctgatcctgaacctcttcagcctgatggtggatgccaacatcccagacatcgccctggagccagacaagacagtgaagaaggtgcaggacaagttccggctggacctgagtgatgaggaggccgtgcactacatgcagagcctgattgatgagagcgtgcacgccctgtttgctgctgtggtggagcagatccacaagtttgcccagtactggaggaagtag

SEQ ID NO: 21096 - DNA, 2475 bp, Artificial Sequence
  Description of Artificial Sequence: Synthetic coding sequence
atgggagaggccgagaagttccactacatctacagctgtgacctggacatcaacgtgcagctgaagatctggaatgagtggctgaagctgcctgtgaagtacccagacctgcccagaaatgcccaggtggccctgaccatctgggatgtgtatggccctgggaaggctgtgcctgtgggcggcaccaccgtgtccctgtttgggaagtatggcatgttccggcagggcatgcatgacctgaaggtgtggcccaacgtggaggctgatggcagcgagcccaccaagaccccaggccgcaccagcagcaccctgtctgaggaccagatgagccggctggccaagctgaccaaggcccaccggcagggccacatggtgaaggtggactggctggaccggctgaccttccgggagattgagatgatcaatgaaagtgagaagaggagcagcaacttcatgtacctgatggtggagttccgctgtgtgaagtgtgatgacaaggagtatggcatcgtgtactatgagaaggatggagatgagagcagccccatcctgaccagctttgagctggtgaaggtgcctgacccccagatgtccatggagaacctggtggagagcaagcaccacaagctggcccggagcctgcggagcggccccagcgaccatgacctgaagcccaatgctgccacccgggaccagctgaacatcatcgtgtcctacccacccaccaagcagctgacctatgaggagcaggacctggtgtggaagttccgctactacctgaccaaccaggagaaggccctgaccaagttcctgaagtgtgtgaactgggacctgccccaggaggccaagcaggccctggagctgctgggcaagtggaagcccatggatgtggaggacagcctggagctgctgagcagccactacaccaaccccaccgtgcggcgctatgctgtggcccggctgcggcaggctgatgatgaggacctgctgatgtacctgctgcagctggtgcaggccctgaagtatgaaaattttgatgacatcaagaatggcctggagcccaccaagaaggacagccagagctctgtgtctgaaaatgtgagcaacagcggcatcaacagcgctgagattgacagcagccagatcatcaccagccccctgcccagcgtgagcagccccccaccagccagcaagaccaaggaggtgcctgatggagagaacctggagcaggacctgtgcaccttcctgatcagccgggcctgcaagaacagcaccctggccaactacctgtactggtacgtgattgtggagtgtgaggaccaggacacccagcagagggaccccaagacccatgagatgtacctgaatgtgatgaggcgcttcagccaggccctgctgaagggggacaagtctgtgcgggtgatgaggagcctgctggccgcccagcagacctttgtggaccggctggtgcacctgatgaaggctgtgcagcgggagagcggcaacaggaagaagaagaatgaaaggctgcaggccctgctgggggacaatgagaagatgaacctgagtgatgtggagctgatccccctgcccctggagccccaggtgaagatccggggcatcatccctgagacagccaccctcttcaagagcgccctgatgcctgcccagctgttcttcaagacagaagatggcggcaagtaccctgtgatcttcaagcatggagatgacctgcggcaggaccagctgatcctgcagatcatcagcctgatggacaagctgctgaggaaggagaacctggacctgaagctgaccccctacaaggtgctggccaccagcaccaagcacggcttcatgcagttcatccagagcgtgcctgtggccgaggtgctggacacagagggcagcatccagaacttcttcagaaaatatgcccccagtgaaaatggccccaacggcatctctgctgaggtgatggacacctacgtgaagagctgtgccggctactgcgtcatcacctacatcctgggcgtgggggacagacacctggacaacctgctgctgaccaagacaggcaagctgttccacatcgactttggctacatcctgggccgggaccccaagcccctgcccccacccatgaagctgaacaaggagatggtggagggcatgggcggcacccagagcgagcagtaccaggagttcaggaagcagtgctacacagccttcctgcacctgcggcgctacagcaacctgatcctgaacctcttcagcctgatggtggatgccaacatcccagacatcgccctggagccagacaagacagtgaagaaggtgcaggacaagttccggctggacctgagtgatgaggaggccgtgcactacatgcagagcctgattgatgaatctgtgcacgccctgtttgctgctgtggtggagcagatccacaagtttgcccagtactggaggaagtag

SEQ ID NO: 21097 - DNA, 2175 bp, Artificial Sequence
  Description of Artificial Sequence: Synthetic coding sequence
atgtctgctgagggctaccagtaccgggccctgtatgactacaagaaggagcgggaggaggacatcgacctgcacctgggggacatcctgactgtgaacaagggcagcctggtggccctgggcttcagtgatggccaggaggcccggcctgaggagatcggctggctgaatggctacaatgagaccactggagagcggggggacttccctggcacctacgtggagtacatcggcaggaagaagatcagcccccccacccccaagcccaggcctccccggcccctgcctgtggcccctggcagcagcaagacagaagcagatgtggagcagcaggccctgaccctgcctgacctggccgagcagtttgcccccccagacatcgccccacccctgctgatcaagctggtggaggccatcgagaagaagggcctggagtgcagcaccctgtaccgcacccagagcagcagcaacctggccgagctgcggcagctgctggactgtgacaccccatctgtggacctggagatgattgatgtgcacgtgctggctgatgccttcaagcgctacctgctggacctgcccaaccctgtgatcccagctgctgtgtacagcgagatgatcagcctggcccctgaggtgcagagcagcgaggagtacatccagctgctgaagaagctgatccgcagccccagcatcccccaccagtactggctgaccctgcagtacctgctgaagcacttcttcaagctgagccagaccagcagcaagaacctgctgaatgcccgggtgctgtctgagatcttcagccccatgctgttccgcttctctgctgccagcagtgacaacacagagaacctgatcaaggtgattgagatcctgatcagcacagagtggaatgaaaggcagcctgccccagccctgccccccaagccacccaagcccaccaccgtggccaacaacggcatgaacaacaacatgagcctgcaggatgctgagtggtactggggagacatcagccgggaggaggtgaatgagaagctgcgggacacagcagatggcaccttcctggtgagagatgccagcaccaagatgcatggagactacaccctgaccctgaggaagggcggcaacaacaagctgatcaagatcttccacagagatggcaagtatggcttcagtgaccccctgaccttcagctctgtggtggagctgatcaaccactacagaaatgaaagcctggcccagtacaaccccaagctggatgtgaagctgctgtaccctgtgtccaagtaccagcaggaccaggtggtgaaggaggacaacatcgaggccgtgggcaagaagctgcacgagtacaacacccagttccaggagaagagccgggagtatgaccggctgtatgaggagtacaccaggaccagccaggagatccagatgaagaggacagccatcgaggccttcaatgagaccatcaagatctttgaggagcagtgccagacccaggagcgctacagcaaggagtacatcgagaagttcaagcgggagggcaatgagaaggagatccagaggatcatgcacaactatgacaagctgaagagccgcatcagcgagatcatcgacagcagaagaaggctggaggaggacctgaagaagcaggccgctgagtaccgggagattgacaagaggatgaacagcatcaagccagacctgatccagctgaggaagacccgggaccagtacctgatgtggctgacccagaagggcgtgcggcagaagaagctgaatgagtggctgggcaatgaaaatacagaggaccagtacagcctggtggaggatgatgaggacctgccccaccatgatgagaagacctggaatgtgggcagcagcaacagaaacaaggccgagaacctgctgcggggcaagagagatggcaccttcctggtgcgggagagcagcaagcagggctgctacgcctgcagcgtggtggtggatggagaggtgaagcactgcgtcatcaacaagacagccaccggctacggctttgctgagccctacaacctgtacagcagcctgaaggagctggtgctgcactaccagcacaccagcctggtgcagcacaatgacagcctgaatgtgaccctggcctaccctgtgtatgcccagcagaggaggtag

SEQ ID NO: 21098 - DNA, 1275 bp, Artificial Sequence
  Description of Artificial Sequence: Synthetic coding sequence
atgcacaacctgcagaccctgccccccaagccacccaagcccaccaccgtggccaacaacggcatgaacaacaacatgagcctgcaggatgctgagtggtactggggagacatcagccgggaggaggtgaatgagaagctgcgggacacagcagatggcaccttcctggtgagagatgccagcaccaagatgcatggagactacaccctgaccctgaggaagggcggcaacaacaagctgatcaagatcttccacagagatggcaagtatggcttcagtgaccccctgaccttcagctctgtggtggagctgatcaaccactacagaaatgaaagcctggcccagtacaaccccaagctggatgtgaagctgctgtaccctgtgtccaagtaccagcaggaccaggtggtgaaggaggacaacatcgaggccgtgggcaagaagctgcacgagtacaacacccagttccaggagaagagccgggagtatgaccggctgtatgaggagtacaccaggaccagccaggagatccagatgaagaggacagccatcgaggccttcaatgagaccatcaagatctttgaggagcagtgccagacccaggagcgctacagcaaggagtacatcgagaagttcaagcgggagggcaatgagaaggagatccagaggatcatgcacaactatgacaagctgaagagccgcatcagcgagatcatcgacagcagaagaaggctggaggaggacctgaagaagcaggccgctgagtaccgggagattgacaagaggatgaacagcatcaagccagacctgatccagctgaggaagacccgggaccagtacctgatgtggctgacccagaagggcgtgcggcagaagaagctgaatgagtggctgggcaatgaaaatacagaggaccagtacagcctggtggaggatgatgaggacctgccccaccatgatgagaagacctggaatgtgggcagcagcaacagaaacaaggccgagaacctgctgcggggcaagagagatggcaccttcctggtgcgggagagcagcaagcagggctgctacgcctgcagcgtggtggtggatggagaggtgaagcactgcgtcatcaacaagacagccaccggctacggctttgctgagccctacaacctgtacagcagcctgaaggagctggtgctgcactaccagcacaccagcctggtgcagcacaatgacagcctgaatgtgaccctggcctaccctgtgtatgcccagcagaggaggtag

SEQ ID NO: 21099 - DNA, 1365 bp, Artificial Sequence
  Description of Artificial Sequence: Synthetic coding sequence
atgtacaacacagtgtggaacatggaggacctggacctggagtatgccaagacagacatcaactgtggcacagacctgatgttctacatcgagatggaccccccagccctgccccccaagccacccaagcccaccaccgtggccaacaacggcatgaacaacaacatgagcctgcaggatgctgagtggtactggggagacatcagccgggaggaggtgaatgagaagctgcgggacacagcagatggcaccttcctggtgagagatgccagcaccaagatgcatggagactacaccctgaccctgaggaagggcggcaacaacaagctgatcaagatcttccacagagatggcaagtatggcttcagtgaccccctgaccttcagctctgtggtggagctgatcaaccactacagaaatgaaagcctggcccagtacaaccccaagctggatgtgaagctgctgtaccctgtgtccaagtaccagcaggaccaggtggtgaaggaggacaacatcgaggccgtgggcaagaagctgcacgagtacaacacccagttccaggagaagagccgggagtatgaccggctgtatgaggagtacaccaggaccagccaggagatccagatgaagaggacagccatcgaggccttcaatgagaccatcaagatctttgaggagcagtgccagacccaggagcgctacagcaaggagtacatcgagaagttcaagcgggagggcaatgagaaggagatccagaggatcatgcacaactatgacaagctgaagagccgcatcagcgagatcatcgacagcagaagaaggctggaggaggacctgaagaagcaggccgctgagtaccgggagattgacaagaggatgaacagcatcaagccagacctgatccagctgaggaagacccgggaccagtacctgatgtggctgacccagaagggcgtgcggcagaagaagctgaatgagtggctgggcaatgaaaatacagaggaccagtacagcctggtggaggatgatgaggacctgccccaccatgatgagaagacctggaatgtgggcagcagcaacagaaacaaggccgagaacctgctgcggggcaagagagatggcaccttcctggtgcgggagagcagcaagcagggctgctacgcctgcagcgtggtggtggatggagaggtgaagcactgcgtcatcaacaagacagccaccggctacggctttgctgagccctacaacctgtacagcagcctgaaggagctggtgctgcactaccagcacaccagcctggtgcagcacaatgacagcctgaatgtgaccctggcctaccctgtgtatgcccagcagaggaggtag

SEQ ID NO: 21100 - DNA, 2199 bp, Artificial Sequence
  Description of Artificial Sequence: Synthetic coding sequence
atgtctgctgagggctaccagtaccgggccctgtatgactacaagaaggagcgggaggaggacatcgacctgcacctgggggacatcctgactgtgaacaagggcagcctggtggccctgggcttcagtgatggccaggaggcccggcctgaggagatcggctggctgaatggctacaatgagaccactggagagcggggggacttccctggcacctacgtggagtacatcggcaggaagaagatcagcccccccacccccaagcccaggcctccccggcccctgcctgtggcccctggcagcagcaagacagaagcagatgtggagcagcaggccctgaccctgcctgacctggccgagcagtttgcccccccagacatcgccccacccctgctgatcaagctggtggaggccatcgagaagaagggcctggagtgcagcaccctgtaccgcacccagagcagcagcaacctggccgagctgcggcagctgctggactgtgacaccccatctgtggacctggagatgattgatgtgcacgtgctggctgatgccttcaagcgctacctgctggacctgcccaaccctgtgatcccagctgctgtgtacagcgagatgatcagcctggcccctgaggtgcagagcagcgaggagtacatccagctgctgaagaagctgatccgcagccccagcatcccccaccagtactggctgaccctgcagtacctgctgaagcacttcttcaagctgagccagaccagcagcaagaacctgctgaatgcccgggtgctgtctgagatcttcagccccatgctgttccgcttctctgctgccagcagtgacaacacagagaacctgatcaaggtgattgagatcctgatcagcacagagtggaatgaaaggcagcctgccccagccctgccccccaagccacccaagcccaccaccgtggccaacaacggcatgaacaacaacatgagcctgcaggatgctgagtggtactggggagacatcagccgggaggaggtgaatgagaagctgcgggacacagcagatggcaccttcctggtgagagatgccagcaccaagatgcatggagactacaccctgaccctgaggaagggcggcaacaacaagctgatcaagatcttccacagagatggcaagtatggcttcagtgaccccctgaccttcagctctgtggtggagctgatcaaccactacagaaatgaaagcctggcccagtacaaccccaagctggatgtgaagctgctgtaccctgtgtccaagtaccagcaggaccaggtggtgaaggaggacaacatcgaggccgtgggcaagaagctgcacgagtacaacacccagttccaggagaagagccgggagtatgaccggctgtatgaggagtacaccaggaccagccaggagatccagatgaagaggacagccatcgaggccttcaatgagaccatcaagatctttgaggagcagtgccagacccaggagcgctacagcaaggagtacatcgagaagttcaagcgggagggcaatgagaaggagatccagaggatcatgcacaactatgacaagctgaagagccgcatcagcgagatcatcgacagcagaagaaggctggaggaggacctgaagaagcaggccgctgagtaccgggagattgacaagaggatgaacagcatcaagccagacctgatccagctgaggaagacccgggaccagtacctgatgtggctgacccagaagggcgtgcggcagaagaagctgaatgagtggctgggcaatgaaaatacagaggagaacttcctgagctgcctgcccagccagtacagcctggtggaggatgatgaggacctgccccaccatgatgagaagacctggaatgtgggcagcagcaacagaaacaaggccgagaacctgctgcggggcaagagagatggcaccttcctggtgcgggagagcagcaagcagggctgctacgcctgcagcgtggtggtggatggagaggtgaagcactgcgtcatcaacaagacagccaccggctacggctttgctgagccctacaacctgtacagcagcctgaaggagctggtgctgcactaccagcacaccagcctggtgcagcacaatgacagcctgaatgtgaccctggcctaccctgtgtatgcccagcagaggaggtag

SEQ ID NO: 21101 - DNA, 2175 bp, Artificial Sequence; identical to SEQ ID NO: 21097
  Description of Artificial Sequence: Synthetic coding sequence

SEQ ID NO: 21102 - DNA, 414 bp, Artificial Sequence
  Description of Artificial Sequence: Synthetic coding sequence
atgcacggggactacaccctgaccctgaggaaaggaggcaacaacaagctgatcaagatcttccacagagatggcaagtatggcttcagtgaccccctgaccttcagctctgtggtggagctgatcaaccactacagaaatgaaagcctggcccagtacaaccccaagctggatgtgaagctgctgtaccctgtgtccaagtaccagcaggaccaggtggtgaaggaggacaacattgaagctgtgggcaagaagctgcacgagtacaacacccagttccaggagaagagccgggagtatgaccggctgtatgaggagtacaccaggaccagccaggagatccagatgaagaggacagccatcgaggccttcaatgagaccatcaagatctttgaggagcagtgccagacctag

SEQ ID NO: 21103 - DNA, 2175 bp, Artificial Sequence; identical to SEQ ID NO: 21097
  Description of Artificial Sequence: Synthetic coding sequence

SEQ ID NO: 21104 - DNA, 1224 bp, Artificial Sequence
  Description of Artificial Sequence: Synthetic coding sequence
atgctgtttgacaaggtgaaggccttctctgtgcagctggatggagccacagctggggtggagcccgtcttcagcggcggccaggccgtggccggccgggtgctgctggagctgagcagcgctgcccgggtgggcgccctgcggctgcgggcccggggccgggcccacgtgcactggacagagagccgctctgctggcagcagcacagcctacacccagagctacagcgagcgggtggaggtggtgagccaccgggccaccctgctggccccagacacaggagagaccaccaccctgcccccaggaagacatgagttcctgttctccttccagctgccccccaccctggtgaccagctttgagggcaagcacggctctgtgcgctactgcatcaaggccaccctgcaccggccctgggtgcctgcccggcgggccaggaaggtgttcaccgtcatcgagcctgtggacatcaacaccccagccctgctggccccccaggccggggcccgggagaaggtggcccgctcctggtactgcaacagaggcctggtgtccctgagcgccaagattgacaggaagggctacaccccaggagaggtgattcctgtgtttgctgagattgacaatggcagcaccaggcctgtgctgcccagggctgctgtggtgcagacccagaccttcatggcccggggggccaggaagcagaagagagctgtggtggccagcctggccggggagcctgtgggccctggccagagggccctgtggcagggccgggccctgcgcatcccccctgtgggccccagcatcctgcactgccgggtgctgcacgtggactatgccctgaaggtgtgtgtggacatccctggcaccagcaagctgctgctggagctgcccctggtgattggcaccatccccctgcaccccttcggcagccgcagcagctctgtgggcagccacgccagcttcctgctggactggaggctgggcgccctgcctgagaggcctgaggcccctcctgagtacagcgaggtggtggccgacacagaggaggccgccctgggccagagccccttccccctgccccaggaccctgacatgagcctggagggccccttctttgcctacatccaggagttccgctaccggcccccacccctgtacagcgaggaggaccccaaccccctgctgggggacatgaggccccgctgcatgacctgctag

SEQ ID NO: 21105 - DNA, 1386 bp, Artificial Sequence
  Description of Artificial Sequence: Synthetic coding sequence
atgtacaacacagtgtggagcatggacagagatgatgctgactggagggaggtgatgatgccctacagcacagagctgatcttctacatcgagatggaccccccagccctgccccccaagccacccaagcccatgaccagcgctgtgcccaacggcatgaaggacagctctgtgtccctgcaggatgctgagtggtactggggagacatcagccgggaggaggtgaatgacaagctgcgggacatgccagatggcaccttcctggtgagagatgccagcaccaagatgcagggcgactacaccctgaccctgaggaagggcggcaacaacaagctgatcaagatctaccacagagatggcaagtatggcttcagtgaccccctgaccttcaacagcgtggtggagctgatcaaccactaccaccacgagagcctggcccagtacaaccccaagctggatgtgaagctgatgtaccctgtgagccgctaccagcaggaccagctggtgaaggaggacaacattgatgctgtgggcaagaagctgcaggagtaccacagccagtaccaggagaagagcaaggagtatgaccggctgtatgaggagtacaccaggaccagccaggagatccagatgaagaggacagccatcgaggccttcaatgagaccatcaagatctttgaggagcagtgccacacccaggagcagcacagcaaggagtacatcgagcgcttcagaagagagggcaatgagaaggagattgagcgcatcatgatgaactatgacaagctgaagagccggctgggggagatccatgacagcaagatgaggctggagcaggacctgaagaaccaggccctggacaaccgggagattgacaagaagatgaacagcatcaagccagacctgatccagctgaggaagatccgggaccagcacctggtgtggctgaaccacaagggcgtgcggcagaagaggctgaatgtgtggctgggcatcaagaatgaagatgctgatgagaactacttcatcaatgaggaggatgagaacctgccccactatgatgagaagacctggtttgtggaggacatcaacagagtgcaggccgaggacctgctgtatggcaagccagatggagccttcctgatccgggagagcagcaagaagggctgctacgcctgcagcgtggtggctgatggagaggtgaagcactgcgtcatctacagcacagcccggggctacggctttgctgagccctacaacctgtacagcagcctgaaggagctggtgctgcactaccagcagaccagcctggtgcagcacaatgacagcctgaatgtgcggctggcctaccctgtgcacgcccagatgcccagcctgtgcaggtag

SEQ ID NO: 21106 - DNA, 1101 bp, Artificial Sequence
  Description of Artificial Sequence: Synthetic coding sequence
atgtacaacacagtgtggagcatggacagagatgatgctgactggagggaggtgatgatgccctacagcacagagctgatcttctacatcgagatggaccccccagctgctgaggtgaatgacaagctgcgggacatgccagatggcaccttcctggtgagagatgccagcaccaagatgcagggcgactacaccctgaccctgaggaagggcggcaacaacaagctgatcaagatctaccacagagatggcaagtatggcttcagtgaccccctgaccttcaacagcgtggtggagctgatcaaccactaccaccacgagagcctggcccagtacaaccccaagctggatgtgaagctgatgtaccctgtgagccgctaccagcaggaccagctggtgaaggaggacaacattgatgctgtgggcaagaagctgcaggagtaccacagccagtaccaggagaagagcaaggagtatgaccggctgtatgaggagtacaccaggaccagccaggagatccagatgaagaggacagccatcgaggccttcaatgagaccatcaagatctttgaggagcagtgccacacccaggagcagcacagcaaggagtacatcgagcgcttcagaagagagggcaatgagaaggagattgagcgctggctgaaccacaagggcgtgcggcagaagaggctgaatgtgtggctgggcatcaagaatgaagatgctgatgagaactacttcatcaatgaagaagatgagaacctgccccactatgatgagaagacctggtttgtggaggacatcaacagagtgcaggccgaggacctgctgtatggcaagccagatggagccttcctgatccgggagagcagcaagaagggctgctacgcctgcagcgtggtggctgatggagaggtgaagcactgtgtgatctacagcacagcccggggctacggctttgctgagccctacaacctgtacagcagcctgaaggagctggtgctgcactaccagcagaccagcctggtgcagcacaatgacagcctgaatgtgcggctggcctaccctgtgcacgcccagatgcccagcctgtgcaggtag

SEQ ID NO: 21107 - DNA, 1209 bp, Artificial Sequence
  Description of Artificial Sequence: Synthetic coding sequence
atgtacaacacagtgtggagcatggacagagatgatgctgactggagggaggtgatgatgccctacagcacagagctgatcttctacatcgagatggaccccccagccctgccccccaagccacccaagcccatgaccagcgctgtgcccaacggcatgaaggacagctctgtgtccctgcaggatgctgagtggtactggggagacatcagccgggaggaggtgaatgacaagctgcgggacatgccagatggcaccttcctggtgagagatgccagcaccaagatgcagggcgactacaccctgaccctgaggaagggcggcaacaacaagctgatcaagatctaccacagagatggcaagtatggcttcagtgaccccctgaccttcaacagcgtggtggagctgatcaaccactaccaccacgagagcctggcccagtacaaccccaagctggatgtgaagctgatgtaccctgtgagccgctaccagcaggaccagctggtgaaggaggacaacattgatgctgtgggcaagaagctgcaggagtaccacagccagtaccaggagaagagcaaggagtatgaccggctgtatgaggagtacaccaggaccagccaggagatccagatgaagaggacagccatcgaggccttcaatgagaccatcaagatctttgaggagcagtgccacacccaggagcagcacagcaaggagtacatcgagcgcttcagaagagagggcaatgagaaggagattgagcgctggctgaaccacaagggcgtgcggcagaagaggctgaatgtgtggctgggcatcaagaatgaagatgctgatgagaactacttcatcaatgaagaagatgagaacctgccccactatgatgagaagacctggtttgtggaggacatcaacagagtgcaggccgaggacctgctgtatggcaagccagatggagccttcctgatccgggagagcagcaagaagggctgctacgcctgcagcgtggtggctgatggagaggtgaagcactgtgtgatctacagcacagcccggggctacggctttgctgagccctacaacctgtacagcagcctgaaggagctggtgctgcactaccagcagaccagcctggtgcagcacaatgacagcctgaatgtgcggctggcctaccctgtgcacgcccagatgcccagcctgtgcaggtag

SEQ ID NO: 21108 - DNA, 1386 bp, Artificial Sequence; identical to SEQ ID NO: 21105
  Description of Artificial Sequence: Synthetic coding sequence

SEQ ID NO: 21109 - DNA, 1386 bp, Artificial Sequence; identical to SEQ ID NO: 21105
  Description of Artificial Sequence: Synthetic coding sequence

SEQ ID NO: 21110 - DNA, 1209 bp, Artificial Sequence; identical to SEQ ID NO: 21107
  Description of Artificial Sequence: Synthetic coding sequence

SEQ ID NO: 21111 - DNA, 621 bp, Artificial Sequence
  Description of Artificial Sequence: Synthetic coding sequence
atgtacaacacagtgtggagcatggacagagatgatgctgactggagggaggtgatgatgccctacagcacagagctgatcttctacatcgagatggaccccccagccctgccccccaagccacccaagcccatgaccagcgctgtgcccaacggcatgaaggacagctctgtgtccctgcaggatgctgagtggtactggggagacatcagccgggaggaggtgaatgacaagctgcgggacatgccagatggcaccttcctggtgagagatgccagcaccaagatgcagggcgactacaccctgaccctgaggaagggcggcaacaacaagctgatcaagatctaccacagagatggcaagtatggcttcagtgaccccctgaccttcaacagcgtggtggagctgatcaaccactaccaccacgagagcctggcccagtacaaccccaagctggatgtgaagctgatgtaccctgtgagccgctaccagcaggaccagctggtgaaggaggacaacattgatgctgtgggcaagaagctgcaggagtaccacagccagtaccaggagaagagcaaggagtatgaccggctgtatgaggagtacaccaggaccagctag

SEQ ID NO: 21112 - DNA, 1524 bp, Artificial Sequence
  Description of Artificial Sequence: Synthetic coding sequence
atgggccccagccggctggtgcggggcccccggccccagggcatgaggagcccctaccgccggcccggcatgggctggccccggccccgcttccccaggatgttcaagtgcagcagaagacgctaccagcagggcctgcggggccgcacagccagcagcgctgccatcaacccagccacccgggccatgggcatcaacaacacccacacagacaccaccatcgtgtggatcttccccccccaggccctgccccccaagccacccaagcccatgaccagcgctgtgcccaacggcatgaaggacagctctgtgtccctgcaggatgctgagtggtactggggagacatcagccgggaggaggtgaatgacaagctgcgggacatgccagatggcaccttcctggtgagagatgccagcaccaagatgcagggcgactacaccctgaccctgaggaagggcggcaacaacaagctgatcaagatctaccacagagatggcaagtatggcttcagtgaccccctgaccttcaacagcgtggtggagctgatcaaccactaccaccacgagagcctggcccagtacaaccccaagctggatgtgaagctgatgtaccctgtgagccgctaccagcaggaccagctggtgaaggaggacaacattgatgctgtgggcaagaagctgcaggagtaccacagccagtaccaggagaagagcaaggagtatgaccggctgtatgaggagtacaccaggaccagccaggagatccagatgaagaggacagccatcgaggccttcaatgagaccatcaagatctttgaggagcagtgccacacccaggagcagcacagcaaggagtacatcgagcgcttcagaagagagggcaatgagaaggagattgagcgcatcatgatgaactatgacaagctgaagagccggctgggggagatccatgacagcaagatgaggctggagcaggacctgaagaaccaggccctggacaaccgggagattgacaagaagatgaacagcatcaagccagacctgatccagctgaggaagatccgggaccagcacctggtgtggctgaaccacaagggcgtgcggcagaagaggctgaatgtgtggctgggcatcaagaatgaagatgctgatgagaactacttcatcaatgaggaggatgagaacctgccccactatgatgagaagacctggtttgtggaggacatcaacagagtgcaggccgaggacctgctgtatggcaagccagatggagccttcctgatccgggagagcagcaagaagggctgctacgcctgcagcgtggtggctgatggagaggtgaagcactgcgtcatctacagcacagcccggggctacggctttgctgagccctacaacctgtacagcagcctgaaggagctggtgctgcactaccagcagaccagcctggtgcagcacaatgacagcctgaatgtgcggctggcctaccctgtgcacgcccagatgcccagcctgtgcaggtag

SEQ ID NO: 21113 - DNA, 2643 bp, Artificial Sequence
  Description of Artificial Sequence: Synthetic coding sequence
atgcagcccggggccaccacctgcacagaggaccgcatccagcacgccctggagcgctgcctgcacggcctgagcctgagccgccgcagcacctcctggagcgctggcctgtgcctgaactgctggagcctgcaggagctggtgtcccgggaccccggccacttcctgatcctgctggagcagatcctgcagaagacccgggaggtgcaggagaagggcacctatgacctgctgacccccctggccctgctcttctacagcacagtgctgtgcaccccccacttccccccagacagcgacctgctgctgaaggccgccagcacctaccaccgcttcctgacctggcctgtgccctactgcagcatctgccaggagctgctgaccttcattgatgctgagctgaaggcccctggcatctcctaccagaggctggtgcgggcagagcagggcctgcccatccgcagccacaggagcagcacagtgacagtgctgctgctgaaccctgtggaggtgcaggccgagttcctggccgtggccaacaagctgagcaccccaggccacagcccccacagcgcctacaccaccctgctgctgcacgccttccaggccacctttggagcccactgtgatgtgcccggcctgcactgccgcctgcaggccaagaccctggccgagctggaggacatcttcacagaaacagctgaggcccaggagctggccagcggcattggagatgctgctgaggcccggcgctggctgcggaccaagctgcaggccgtgggggagaaggccggcttccctggggtgctggacacagccaagccaggcaagctgcacaccatccccatccctgtggcccgctgctacacctacagctggagccaggacagctttgacatcctgcaggagatcctgctgaaggagcaggagctgctgcagcccggcatcctgggagatgatgaggaggaggaggaggaggaggaggaggtggaggaggacctggagacagatggccactgtgccgagcgggacagcctgctgagcaccagcagcctggccagccatgacagcaccctgagcctggccagcagccaggccagcggccctgccctgagccgccacctgctgaccagctttgtgtctggcctgagtgatggcatggattctggctacgtggaggacagcgaggagagcagcagcgagtggccctggaggcggggcagccaggagcggcggggccacagaagacctggccagaagttcatccgcatctacaagctgttcaagagcaccagccagctggtgctgcggcgggacagccgcagcctggagggcagcagtgacacagccctgcccctgcggcgggccggcagcctgtgcagccccctggatgagcctgtgtccccacccagccgggcccagaggagccgcagcctgccccagcccaagctgggcacccagctgcccagctggctgctggccccagccagccggccccagaggcggcggcccttcctgtctggagatgaggaccccaaggccagcaccctgcgggtggtggtgtttggaagtgaccgcatcagcggcaaggtggcccgggcctacagcaacctgcggcggctggagaacaaccggcccctgctgacccgcttcttcaagctgcagttcttctacgtgcctgtgaagaggagccacggcaccagccctggggcctgccccccacccaggagccagacccccagccccccaacagacagccccaggcatgccagccctggagagctgggcaccaccccctgggaggagagcaccaatgacatcagccactacctgggcatgctggacccctggtatgaaagaaatgtgctgggcctgatgcacctgcccccagaggtgctgtgccagcagagcctgaaggccgaggcccaggccctggagggcagccccacccagctgcccatcctggccgacatgctgctgtactactgccgctttgctgcccggcctgtgctgctgcaggtgtaccagacagagctgaccttcatcactggagagaagaccacagagatcttcatccacagcctggagctgggccacagcgctgccacccgggccatcaaggccagcggccctggcagcaagaggctgggcattgatggagaccgggaggccgtgcccctgaccctgcagatcatctacagcaaaggagccatcagcggccgcagccgctggagcaacctggagaaggtgtgcacctctgtgaacctgaacaaggcctgcaggaagcaggaggagctggacagctccatggaggccctgaccctgaacctgacagaggtggtgaagaggcagaacagcaagagcaagaagggcttcaaccagatcagcaccagccagatcaaggtggacaaggtgcagatcatcggcagcaacagctgcccctttgctgtgtgcctggaccaggatgagaggaagatcctgcagagcgtggtgcgctgtgaggtgagcccctgctacaagccagagaagagtgacctgagcagccccccccagaccccaccagacctgcctgcccaggccgccccagacctgtgcagcctgctgtgcctgcccatcatgaccttcagcggggccctgccctag

SEQ ID NO: 21114 - DNA, 2643 bp, Artificial Sequence; identical to SEQ ID NO: 21113
  Description of Artificial Sequence: Synthetic coding sequence

SEQ ID NO: 21115 - DNA, 447 bp, Artificial Sequence
  Description of Artificial Sequence: Synthetic coding sequence
atgaagctgctggtgctggccgtgctgctgactgtggccgctgctgacagcggcatcagccccagggctgtgtggcagttcaggaagatgatcaagtgtgtgattcctggcagtgaccccttcctggagtacaacaactacggctgctactgcggcctgggcggcagcggcacccctgtggatgagctggacaagtgctgccagacccatgacaactgctatgaccaggccaagaagctggacagctgcaagttcctgctggacaacccctacacccacacctacagctacagctgcagcggcagcgccatcacctgcagcagcaagaacaaggaatgtgaggccttcatctgcaactgtgacagaaatgctgccatctgcttcagcaaggccccctacaacaaggcccacaagaacctggacaccaagaagtactgccagagctag

SEQ ID NO: 21116 - DNA, 435 bp, Artificial Sequence
  Description of Artificial Sequence: Synthetic coding sequence
atgaagaccctgctgctgctggccgtcatcatgatcttcggcctgctgcaggcccacggcaacctggtgaacttccacaggatgatcaagctgaccaccgggaaggaggccgccctgtcctatggcttctacggctgccactgcggcgtgggcggccggggcagccccaaggatgccacagaccgctgctgcgtgacccatgactgctgctacaagaggctggagaagaggggctgcggcaccaagttcctgagctacaagttcagcaacagcggcagccgcatcacctgtgccaagcaggacagctgccgcagccagctgtgtgaatgtgacaaggccgccgccacctgctttgccaggaacaagaccacctacaacaagaagtaccagtactacagcaacaagcactgccggggcagcaccccccgctgctag

SEQ ID NO: 21117 - DNA, 435 bp, Artificial Sequence; identical to SEQ ID NO: 21116
  Description of Artificial Sequence: Synthetic coding sequence

SEQ ID NO: 21118 - DNA, 438 bp, Artificial Sequence
  Description of Artificial Sequence: Synthetic coding sequence
atggagctggccctgctgtgtggcctggtggtgatggccggggtcatccccatccagggcggcatcctgaacctgaacaagatggtgaagcaggtgacaggcaagatgcccatcctgagctactggccctacggctgccactgcggcctgggcggccggggccagcccaaggatgccacagactggtgctgccagacccatgactgctgctatgaccacctgaagacccagggctgcagcatctacaaggactactaccgctacaacttcagccagggcaacatccactgcagcgacaagggctcctggtgtgagcagcagctgtgtgcctgtgacaaggaggtggccttctgcctgaagaggaacctggacacctaccagaagaggctgcgcttctactggaggccccactgccggggccagaccccaggctgctag

SEQ ID NO: 21119 - DNA, 429 bp, Artificial Sequence
  Description of Artificial Sequence: Synthetic coding sequence
atgaagagcccccacgtgctggtgttcctgtgcctgctggtggccctggtgacaggcaacctggtgcagtttggagtgatgattgagaagatgaccgggaagagcgccctgcagtacaatgactatggctgctactgcggcatcggcggcagccactggcctgtggaccagacagactggtgctgccacgcccatgactgctgctacggccgcctggagaagctgggctgtgagcccaagctggagaagtacctgttctctgtgtctgagcggggcatcttctgtgccggccgcaccacctgccagaggctgacctgtgaatgtgacaagagagctgccctgtgcttcagaagaaacctgggcacctacaacagaaaatatgcccactaccccaacaagctgtgcaccggccccaccccaccctgctag

SEQ ID NO: 21120 - DNA, 636 bp, Artificial Sequence
  Description of Artificial Sequence: Synthetic coding sequence
atggctgatggagccaaggccaaccccaagggcttcaagaagaaggtgctggaccgctgcttcagcggctggaggggccccaggtttggagccagctgccccagcaggaccagccgcagcagcctgggcatgaagaagttcttcaccgtggccatcctggccggctctgtgctgagcacagcccacggcagcctgctgaacctgaaggccatggtggaggccgtgacaggccgcagcgccatcctgagctttgtgggctacggctgctactgcggcctgggcggccggggccagcccaaggatgaggtggactggtgctgccacgcccatgactgctgctaccaggagctgtttgaccagggctgccacccctacgtggaccactatgaccacaccatcgagaacaacacagaaattgtgtgcagcgacctgaacaagacagaatgtgacaagcagacctgcatgtgtgacaagaacatggtgctgtgcctgatgaaccagacctaccgggaggagtaccggggcttcctgaatgtgtactgccagggccccacccccaactgcagcatctatgagcccccacctgaggaggtgacctgcagccaccagagccctgcccccccagccccaccctag

SEQ ID NO: 21121 - DNA, 936 bp, Artificial Sequence
  Description of Artificial Sequence: Synthetic coding sequence
atgcctgccccccgggccccccgggccctggccgctgctgccccagccagcggcaaggccaagctgacccaccctgggaaggccatcctggccggcggcctggccggcggcatcgagatctgcatcaccttccccacagaatatgtgaagacccagctgcagctggatgagaggagccaccccccacgctaccggggcattggagactgtgtgcggcagacagtgcgcagccacggcgtgctgggcctgtaccggggcctgagcagcctgctgtatggcagcatccccaaggctgctgtgcgcttcggcatgtttgagttcctgagcaaccacatgagagatgcccagggccgcctggacagcacccggggcctgctgtgtggcctgggcgccggcgtggccgaggccgtggtggtggtgtgccccatggagaccatcaaggtgaagttcatccatgaccagaccagccccaaccccaagtaccggggcttcttccacggcgtgcgggagatcgtgcgggagcagggcctgaagggcacctaccagggcctgacagccaccgtgctgaagcagggcagcaaccaggccatccgcttctttgtgatgaccagcctgaggaactggtacagaggagacaaccccaacaagcccatgaaccccctcatcactggagtgtttggagccatcgccggggccgcctctgtgtttggaaacacccccctggatgtgatcaagaccaggatgcagggcctggaggcccacaagtacagaaacacctgggactgtggcctgcagatcctgaagaaggagggcctgaaggccttctacaagggcaccgtgccccggctgggccgggtgtgcctggatgtggccatcgtgtttgtgatctatgatgaggtggtgaagctgctgaacaaggtgtggaagacagactag

SEQ ID NO: 21122 - DNA, 2250 bp, Artificial Sequence
  Description of Artificial Sequence: Synthetic coding sequence
atgtccttcatcgacccctaccagcacatcatcgtggagcaccagtacagccacaagttcaccgtggtggtgctgcgggccaccaaggtgaccaagggggcctttggagacatgctggacaccccagacccctacgtggagctgttcatcagcaccaccccagacagcaggaagaggaccaggcacttcaacaatgacatcaaccctgtgtggaatgagacctttgagttcatcctggaccccaaccaggagaatgtgctggagatcaccctgatggatgccaactacgtgatggatgagaccctgggcacagccaccttcaccgtgtcctccatgaaggtgggggagaagaaggaggtgcccttcatcttcaaccaggtgacagagatggtgctggagatgagcctggaggtgtgcagctgcccagacctgcgcttctccatggccctgtgtgaccaggagaagaccttccggcagcagaggaaggagcacatccgggagagcatgaagaagctgctgggccccaagaacagcgagggcctgcacagcgccagagatgtgcctgtggtggccatcctgggcagcggcggcggcttccgggccatggtgggcttcagcggcgtgatgaaggccctgtatgaaagtggcatcctggactgtgccacctacgtggccggcctgagcggcagcacctggtacatgagcaccctgtacagccacccagacttccctgagaagggccctgaggagatcaatgaggagctgatgaagaatgtgagccacaaccccctgctgctgctgaccccccagaaggtgaagagatatgtggagagcctgtggaagaagaagagcagcggccagcctgtgaccttcacagacatcttcggcatgctgattggagagaccctcatccacaacaggatgaacaccaccctgagcagcctgaaggagaaggtgaacacagcccagtgccccctgcccctcttcacctgcctgcacgtgaagccagatgtgtctgagctgatgtttgctgactgggtggagttcagcccctatgagatcggcatggccaagtatggcaccttcatggccccagacctgtttggcagcaagttcttcatgggcaccgtggtgaagaagtatgaggagaaccccctgcacttcctgatgggcgtgtggggcagcgccttcagcatcctcttcaacagagtgctgggcgtgtctggcagccagagccggggcagcaccatggaggaggagctggagaacatcaccaccaagcacatcgtgtccaatgacagcagtgacagtgatgatgagagccatgagcccaagggcacagaaaatgaagatgctggcagtgactaccagagcgacaaccaggcctcctggatccacaggatgatcatggccctggtgtctgacagcgccctcttcaacacccgggagggccgggccggcaaggtgcacaacttcatgctgggcctgaacctgaacaccagctaccccctgagccccctgagtgactttgccacccaggacagctttgatgatgatgagctggatgctgctgtggccgaccctgatgaatttgagcgcatctatgagcccctggatgtgaagagcaagaagatccacgtggtggacagcggcctgaccttcaacctgccctaccccctcatcctgcggccccagaggggcgtggacctgatcatcagctttgacttcagcgcccggcccagcgacagcagcccccccttcaaggagctgctgctggccgagaagtgggccaagatgaacaagctgcccttccccaagattgacccctacgtgtttgaccgggagggcctgaaggaatgttatgtgttcaagcccaagaacccagacatggagaaggactgccccaccatcatccactttgtgctggccaacatcaacttcaggaagtaccgggcccctggggtgccccgggagacagaggaggagaaggagattgctgactttgacatctttgatgatcctgagagccccttcagcaccttcaacttccagtaccccaaccaggccttcaagaggctgcatgacctgatgcacttcaacaccctgaacaacattgatgtgatcaaggaggccatggtggagagcattgagtaccgccggcagaaccccagccgctgcagcgtgtccctgagcaatgtggaggcccggcgcttcttcaacaaggagttcctgagcaagcccaaggcctag

SEQ ID NO: 21123 - DNA, 150 bp, Artificial Sequence
  Description of Artificial Sequence: Synthetic coding sequence
atgtccttcatcgacccctaccagcacatcatcgtggagcaccagtacagccacaagttcaccgtggtggtgctgcgggccaccaaggtgaccaagggggcctttggagacatgcccaaggtgaccaagggggccttcggggacatgtag

SEQ ID NO: 21124 - DNA, 2070 bp, Artificial Sequence
  Description of Artificial Sequence: Synthetic coding sequence
atgtccttcatcgacccctaccagcacatcatcgtggagcaccagtacagccacaagttcaccgtggtggtgctgcgggccaccaaggtgaccaagggggcctttggagacatgctggacaccccagacccctacgtggagctgttcatcagcaccaccccagacagcaggaagaggaccaggcacttcaacaatgacatcaaccctgtgtggaatgagacctttgagttcatcctggaccccaaccaggagaatgtgctggagatcaccctgatggatgccaactacgtgatggatgagaccctgggcacagccaccttcaccgtgtcctccatgaaggtgggggagaagaaggaggtgcccttcatcttcaaccaggtgcctgtggtggccatcctgggcagcggcggcggcttccgggccatggtgggcttcagcggcgtgatgaaggccctgtatgaaagtggcatcctggactgtgccacctacgtggccggcctgagcggcagcacctggtacatgagcaccctgtacagccacccagacttccctgagaagggccctgaggagatcaatgaggagctgatgaagaatgtgagccacaaccccctgctgctgctgaccccccagaaggtgaagagatatgtggagagcctgtggaagaagaagagcagcggccagcctgtgaccttcacagacatcttcggcatgctgattggagagaccctcatccacaacaggatgaacaccaccctgagcagcctgaaggagaaggtgaacacagcccagtgccccctgcccctcttcacctgcctgcacgtgaagccagatgtgtctgagctgatgtttgctgactgggtggagttcagcccctatgagatcggcatggccaagtatggcaccttcatggccccagacctgtttggcagcaagttcttcatgggcaccgtggtgaagaagtatgaggagaaccccctgcacttcctgatgggcgtgtggggcagcgccttcagcatcctcttcaacagagtgctgggcgtgtctggcagccagagccggggcagcaccatggaggaggagctggagaacatcaccaccaagcacatcgtgtccaatgacagcagtgacagtgatgatgagagccatgagcccaagggcacagaaaatgaagatgctggcagtgactaccagagcgacaaccaggcctcctggatccacaggatgatcatggccctggtgtctgacagcgccctcttcaacacccgggagggccgggccggcaaggtgcacaacttcatgctgggcctgaacctgaacaccagctaccccctgagccccctgagtgactttgccacccaggacagctttgatgatgatgagctggatgctgctgtggccgaccctgatgaatttgagcgcatctatgagcccctggatgtgaagagcaagaagatccacgtggtggacagcggcctgaccttcaacctgccctaccccctcatcctgcggccccagaggggcgtggacctgatcatcagctttgacttcagcgcccggcccagcgacagcagcccccccttcaaggagctgctgctggccgagaagtgggccaagatgaacaagctgcccttccccaagattgacccctacgtgtttgaccgggagggcctgaaggaatgttatgtgttcaagcccaagaacccagacatggagaaggactgccccaccatcatccactttgtgctggccaacatcaacttcaggaagtaccgggcccctggggtgccccgggagacagaggaggagaaggagattgctgactttgacatctttgatgatcctgagagccccttcagcaccttcaacttccagtaccccaaccaggccttcaagaggctgcatgacctgatgcacttcaacaccctgaacaacattgatgtgatcaaggaggccatggtggagagcattgagtaccgccggcagaaccccagccgctgcagcgtgtccctgagcaatgtggaggcccggcgcttcttcaacaaggagttcctgagcaagcccaaggcctag

SEQ ID NO: 21125 - DNA, 2346 bp, Artificial Sequence
  Description of Artificial Sequence: Synthetic coding sequence
atggctgtggccgaggtgtccaggacctgcctgctgactgtgcgggtgctgcaggcccaccggctgcccagcaaggacctggtgacccccagcgactgctacgtgaccctgtggctgcccacagcctgcagccaccggctgcagaccaggacagtgaagaacagcagcagccctgtgtggaaccagagcttccacttccgcatccaccggcagctgaagaatgtgatggagctgaaggtgtttgaccaggacctggtgactggagatgatcctgtgctgtctgtgctgtttgatgctggcaccctgcgggccggggagttccggcgggagagcttcagcctgagcccccagggcgagggccgcctggaggtggagttccggctgcagagcctggccgacagaggagagtggctggtgtccaatggagtgctggtggcccgggagctgagctgcctgcacgtgcagctggaggagactggagaccagaagagcagcgagcaccgggtgcagctggtggtgcccggcagctgtgagggcccccaggaggcctctgtgggcaccggcaccttccgcttccactgcccagcctgctgggagcaggagctgagcatccggctgcaggatgcccctgaggagcagctgaaggcccccctgagcgccctgcccagcggccaggtggtgcggctggtgttccccaccagccaggagcccctgatgagggtggagctgaagaaggaggccggcctgcgggagctggccgtgcggctgggcttcggcccctgtgccgaggagcaggccttcctgagcaggaggaagcaggtggtggccgccgccctgcggcaggccctgcagctggatggagacctgcaggaggatgagatccctgtggtggccatcatggccaccggcggcggcatccgggccatgaccagcctgtatggccagctggccggcctgaaggagctgggcctgctggactgtgtgtcctacatcaccggggccagcggcagcacctgggccctggccaacctgtatgaggaccctgagtggagccagaaggacctggccggccccacagagctgctgaagacccaggtgaccaagaacaagctgggcgtgctggcccccagccagctgcagcgctaccggcaggagctggccgagcgggcccggctgggctaccccagctgcttcaccaacctgtgggccctgatcaatgaggccctgctgcatgatgagccccatgaccacaagctgagtgaccagcgggaggccctgagccacggccagaaccccctgcccatctactgtgccctgaacaccaagggccagagcctgaccacctttgaatttggagagtggtgtgagttcagcccctatgaggtgggcttccccaagtatggagccttcatccccagcgagctgtttggcagcgagttcttcatgggccagctgatgaagaggctgcctgagagccgcatctgcttcctggagggcatctggagcaacctgtatgctgccaacctgcaggacagcctgtactgggccagcgagcccagccagttctgggaccgctgggtgaggaaccaggccaacctggacaaggagcaggtgcccctgctgaagattgaggagccccccagcacagctggaagaattgctgagttcttcacagacctgctgacctggaggcccctggcccaggccacccacaacttcctgcggggcctgcacttccacaaggactacttccagcacccccacttcagcacctggaaggccaccaccctggatggcctgcccaaccagctgaccccatctgagccccacctgtgcctgctggatgtgggctacctgatcaacaccagctgcctgcccctgctgcagcccaccagagatgtggacctgatcctgagcctggactacaacctgcatggagccttccagcagctgcagctgctgggccgcttctgccaggagcagggcatccccttcccccccatcagccccagccctgaggagcagctgcagccccgggagtgccacaccttcagtgaccccacctgccctggggccccagctgtgctgcacttccccctggtgtctgacagcttccgggagtacagcgcccctggggtgcggaggaccccagaggaggccgccgccggggaggtgaacctgagcagcagtgacagcccctaccactacaccaaggtgacctacagccaggaggatgtggacaagctgctgcacctgacccactacaacgtgtgcaacaaccaggagcagctgctggaggccctgcggcaggccgtgcagaggcggcggcagaggcggccccactag

SEQ ID NO: 21126 - DNA, 417 bp, Artificial Sequence
  Description of Artificial Sequence: Synthetic coding sequence
atgaagggcctgctgcccctggcctggttcctggcctgcagcgtgcctgctgtgcagggcggcctgctggacctgaagtccatgattgagaaggtgacaggcaagaatgccctgaccaactacggcttctacggctgctactgcggctggggcggccggggcacccccaaggatggaacagactggtgctgctgggcccatgaccactgctacggccgcctggaggagaagggctgcaacatccgcacccagagctacaagtacagatttgcctggggcgtggtgacctgtgagcccggccccttctgccacgtgaacctgtgtgcctgtgacaggaagctggtgtactgcctgaagaggaacctgcggagctacaacccccagtaccagtacttccccaacatcctgtgcagctag

SEQ ID NO: 21127 - DNA, 2421 bp, Artificial Sequence
  Description of Artificial Sequence: Synthetic coding sequence
atgcagttcttcggccgcctggtgaacaccttcagcggcgtgaccaacctcttcagcaaccccttccgggtgaaggaggtggccgtggccgactacaccagcagtgacagagtgcgggaggagggccagctgatcctcttccagaacacccccaacagaacctgggactgtgtgctggtgaaccccaggaacagccagagcggcttccgcctcttccagctggagctggaggctgatgccctggtgaacttccaccagtacagcagccagctgctgcccttctatgagagcagcccccaggtgctgcacacagaggtgctgcagcacctgacagacctgatccggaaccaccccagctggagcgtggcccacctggccgtggagctgggcatccgggagtgcttccaccacagccgcatcatcagctgtgccaactgtgccgagaatgaggagggctgcacccccctgcacctggcctgcaggaaaggagatggagagatcctggtggagctggtgcagtactgccacacccagatggatgtgacagactacaagggggagaccgtcttccactatgctgtgcagggcgacaacagccaggtgctgcagctgctgggcagaaatgctgtggccggcctgaaccaggtgaacaaccagggcctgacccccctgcacctggcctgccagctgggcaagcaggagatggtgcgggtgctgctgctgtgcaatgcccgctgcaacatcatgggccccaacggctaccccatccacagcgccatgaagttcagccagaagggctgtgccgagatgatcatctccatggacagcagccagatccacagcaaggacccccgctacggggccagccccctgcactgggccaagaatgctgagatggccaggatgctgctgaagaggggctgcaatgtgaacagcaccagcagcgctggcaacacagccctgcacgtggccgtgatgaggaacagatttgactgtgccatcgtgctgctgacccatggagccaatgctgatgcccggggggagcacggcaacacccccctgcacctggccatgagcaaggacaacgtggagatgatcaaggccctgattgtgtttggagctgaggtggacaccccaaatgactttggagagacccccaccttcctggccagcaagattggccgcctggtgaccaggaaggccatcctgaccctgctgaggacagtgggcgctgagtactgcttcccccccatccatggagtgcctgctgagcagggcagcgctgccccccaccaccccttcagcctggagcgggcccagcccccacccatcagcctgaacaacctggagctgcaggacctgatgcacatcagccgggccaggaagccagccttcatcctgggctccatgagagatgagaagaggacccatgaccacctgctgtgcctggatggcggcggcgtgaagggcctcatcatcatccagctgctgattgccatcgagaaggccagcggcgtggccaccaaggacctgtttgactgggtggccggcaccagcactggaggcatcctggccctggccatcctgcacagcaagtccatggcctacatgaggggcatgtacttcaggatgaaggatgaggtgttccggggcagccggccctatgaaagtggccccctggaggagttcctgaagcgggagtttggagagcacaccaagatgacagatgtgaggaagcccaaggtgatgctgaccggcaccctgagtgaccggcagcctgctgagctgcacctgttcaggaactatgatgcccctgagaccgtgcgggagccccgcttcaaccagaatgtgaacctgcggcccccagcccagcccagcgaccagctggtgtggagggctgcccggagcagtggagctgcccccacctacttccggcccaacggccgcttcctggatggcggcctgctggccaacaaccccaccctggatgccatgacagagatccacgagtacaaccaggacctgatcaggaagggccaggccaacaaggtgaagaagctgagcatcgtggtgtccctgggcaccggccgcagcccccaggtgcctgtgacctgtgtggatgtgttccggcccagcaacccctgggagctggccaagacagtgtttggagccaaggagctgggcaagatggtggtggactgctgcacagatcctgatggccgggctgtggaccgggcccgggcctggtgtgagatggtgggcatccagtacttccggctgaacccccagctgggcacagacatcatgctggatgaggtgtctgacacagtgctggtgaatgccctgtgggagacagaggtgtacatctatgagcaccgggaggagttccagaagctgatccagctgctgctgagcccctag

SEQ ID NO: 21128 - DNA, 1284 bp, Artificial Sequence
  Description of Artificial Sequence: Synthetic coding sequence
atgcagttcttcggccgcctggtgaacaccttcagcggcgtgaccaacctcttcagcaaccccttccgggtgaaggaggtggccgtggccgactacaccagcagtgacagagtgcgggaggagggccagctgatcctcttccagaacacccccaacagaacctgggactgtgtgctggtgaaccccaggaacagccagagcggcttccgctgtgccaactgtgccgagaatgaggagggctgcacccccctgcacctggcctgcaggaaaggagatggagagatcctggtggagctggtgcagtactgccacacccagatggatgtgacagactacaagggggagaccgtcttccactatgctgtgcagggcgacaacagccaggtgctgcagctgctgggcagaaatgctgtggccggcctgaaccaggtgaacaaccagggcctgacccccctgcacctggcctgccagctgggcaagcaggagatggtgcgggtgctgctgctgtgcaatgcccgctgcaacatcatgggccccaacggctaccccatccacagcgccatgaagttcagccagaagggctgtgccgagatgatcatctccatggacagcagccagatccacagcaaggacccccgctacggggccagccccctgcactgggccaagaatgctgagatggccaggatgctgctgaagaggggctgcaatgtgaacagcaccagcagcgctggcaacacagccctgcacgtggccgtgatgaggaacagatttgactgtgccatcgtgctgctgacccatggagccaatgctgatgcccggggggagcacggcaacacccccctgcacctggccatgagcaaggacaacgtggagatgatcaaggccctgattgtgtttggagctgaggtggacaccccaaatgactttggagagacccccaccttcctggccagcaagattggccgcctggtgaccaggaaggccatcctgaccctgctgaggacagtgggcgctgagtactgcttcccccccatccatggagtgcctgctgagcagggcagcgctgccccccaccaccccttcagcctggagcgggcccagcccccacccatcagcctgaacaacctgggcagccaccccagccaggccggctggtgggcctggggcgccgccagtgatggcaccaccggcagccacgcccacctgaccggccctgaggcctctgtgcaccctggcctgcacgagggccgggaggccgaccggcagaacatggagagctag

SEQ ID NO: 21129 - DNA, 2259 bp, Artificial Sequence
  Description of Artificial Sequence: Synthetic coding sequence
atgcagttcttcggccgcctggtgaacaccttcagcggcgtgaccaacctcttcagcaaccccttccgggtgaaggaggtggccgtggccgactacaccagcagtgacagagtgcgggaggagggccagctgatcctcttccagaacacccccaacagaacctgggactgtgtgctggtgaaccccaggaacagccagagcggcttccgcctcttccagctggagctggaggctgatgccctggtgaacttccaccagtacagcagccagctgctgcccttctatgagagcagcccccaggtgctgcacacagaggtgctgcagcacctgacagacctgatccggaaccaccccagctggagcgtggcccacctggccgtggagctgggcatccgggagtgcttccaccacagccgcatcatcagctgtgccaactgtgccgagaatgaggagggctgcacccccctgcacctggcctgcaggaaaggagatggagagatcctggtggagctggtgcagtactgccacacccagatggatgtgacagactacaagggggagaccgtcttccactatgctgtgcagggcgacaacagccaggtgctgcagctgctgggcagaaatgctgtggccggcctgaaccaggtgaacaaccagggcctgacccccctgcacctggcctgccagctgggcaagcaggagatggtgcgggtgctgctgctgtgcaatgcccgctgcaacatcatgggccccaacggctaccccatccacagcgccatgaagttcagccagaagggctgtgccgagatgatcatctccatggacagcagccagatccacagcaaggacccccgctacggggccagccccctgcactgggccaagaatgctgagatggccaggatgctgctgaagaggggctgcaatgtgaacagcaccagcagcgctggcaacacagccctgcacgtggccgtgatgaggaacagatttgactgtgccatcgtgctgctgacccatggagccaatgctgatgcccggggggagcacggcaacacccccctgcacctggccatgagcaaggacaacgtggagatgatcaaggccctgattgtgtttggagctgaggtggacaccccaaatgactttggagagacccccaccttcctggccagcaagattggccggcagctgcaggacctgatgcacatcagccgggccaggaagccagccttcatcctgggctccatgagagatgagaagaggacccatgaccacctgctgtgcctggatggcggcggcgtgaagggcctcatcatcatccagctgctgattgccatcgagaaggccagcggcgtggccaccaaggacctgtttgactgggtggccggcaccagcactggaggcatcctggccctggccatcctgcacagcaagtccatggcctacatgaggggcatgtacttcaggatgaaggatgaggtgttccggggcagccggccctatgaaagtggccccctggaggagttcctgaagcgggagtttggagagcacaccaagatgacagatgtgaggaagcccaaggtgatgctgaccggcaccctgagtgaccggcagcctgctgagctgcacctgttcaggaactatgatgcccctgagaccgtgcgggagccccgcttcaaccagaatgtgaacctgcggcccccagcccagcccagcgaccagctggtgtggagggctgcccggagcagtggagctgcccccacctacttccggcccaacggccgcttcctggatggcggcctgctggccaacaaccccaccctggatgccatgacagagatccacgagtacaaccaggacctgatcaggaagggccaggccaacaaggtgaagaagctgagcatcgtggtgtccctgggcaccggccgcagcccccaggtgcctgtgacctgtgtggatgtgttccggcccagcaacccctgggagctggccaagacagtgtttggagccaaggagctgggcaagatggtggtggactgctgcacagatcctgatggccgggctgtggaccgggcccgggcctggtgtgagatggtgggcatccagtacttccggctgaacccccagctgggcacagacatcatgctggatgaggtgtctgacacagtgctggtgaatgccctgtgggagacagaggtgtacatctatgagcaccgggaggagttccagaagctgatccagctgctgctgagcccctag

SEQ ID NO: 21130 - DNA, 1440 bp, Artificial Sequence
  Description of Artificial Sequence: Synthetic coding sequence
atgcagttcttcggccgcctggtgaacaccttcagcggcgtgaccaacctcttcagcaaccccttccgggtgaaggaggtggccgtggccgactacaccagcagtgacagagtgcgggaggagggccagctgatcctcttccagaacacccccaacagaacctgggactgtgtgctggtgaaccccaggaacagccagagcggcttccgcctcttccagctggagctggaggctgatgccctggtgaacttccaccagtacagcagccagctgctgcccttctatgagagcagcccccaggtgctgcacacagaggtgctgcagcacctgacagacctgatccggaaccaccccagctggagcgtggcccacctggccgtggagctgggcatccgggagtgcttccaccacagccgcatcatcagctgtgccaactgtgccgagaatgaggagggctgcacccccctgcacctggcctgcaggaaaggagatggagagatcctggtggagctggtgcagtactgccacacccagatggatgtgacagactacaagggggagaccgtcttccactatgctgtgcagggcgacaacagccaggtgctgcagctgctgggcagaaatgctgtggccggcctgaaccaggtgaacaaccagggcctgacccccctgcacctggcctgccagctgggcaagcaggagatggtgcgggtgctgctgctgtgcaatgcccgctgcaacatcatgggccccaacggctaccccatccacagcgccatgaagttcagccagaagggctgtgccgagatgatcatctccatggacagcagccagatccacagcaaggacccccgctacggggccagccccctgcactgggccaagaatgctgagatggccaggatgctgctgaagaggggctgcaatgtgaacagcaccagcagcgctggcaacacagccctgcacgtggccgtgatgaggaacagatttgactgtgccatcgtgctgctgacccatggagccaatgctgatgcccggggggagcacggcaacacccccctgcacctggccatgagcaaggacaacgtggagatgatcaaggccctgattgtgtttggagctgaggtggacaccccaaatgactttggagagacccccaccttcctggccagcaagattggccgcctggtgaccaggaaggccatcctgaccctgctgaggacagtgggcgctgagtactgcttcccccccatccatggagtgcctgctgagcagggcagcgctgccccccaccaccccttcagcctggagcgggcccagcccccacccatcagcctgaacaacctggagctgcaggacctgatgcacatcagccgggccaggaagccagccttcatcctgggctccatgagagatgagaagaggacagacagaacatag

SEQ ID NO: 21131 - DNA, 2259 bp, Artificial Sequence; identical to SEQ ID NO: 21129
  Description of Artificial Sequence: Synthetic coding sequence

SEQ ID NO: 21132 - DNA, 2004 bp, Artificial Sequence
  Description of Artificial Sequence: Synthetic coding sequence
atgcagttcttcggccgcctggtgaacaccttcagcggcgtgaccaacctcttcagcaaccccttccgggtgaaggaggtggccgtggccgactacaccagcagtgacagagtgcgggaggagggccagctgatcctcttccagaacacccccaacagaacctgggactgtgtgctggtgaaccccaggaacagccagagcggcttccgcctcttccagctggagctggaggctgatgccctggtgaacttccaccagtacagcagccagctgggcaagcaggagatggtgcgggtgctgctgctgtgcaatgcccgctgcaacatcatgggccccaacggctaccccatccacagcgccatgaagttcagccagaagggctgtgccgagatgatcatctccatggacagcagccagatccacagcaaggaccccaggtatggagccagccccctgcactgggccaagaatgctgagatggccaggatgctgctgaagaggggctgcaatgtgaacagcaccagcagcgctggcaacacagccctgcacgtggccgtgatgaggaacagatttgactgtgccatcgtgctgctgacccacggggccaatgctgatgcccggggggagcacggcaacacccccctgcacctggccatgagcaaggacaacgtggagatgatcaaggccctgattgtgtttggagctgaggtggacaccccaaatgactttggagagacccccaccttcctggccagcaagattggccgcctggtgaccaggaaggccatcctgaccctgctgaggacagtgggcgctgagtactgcttcccccccatccacggcgtgcctgctgagcagggcagcgctgccccccaccaccccttcagcctggagcgggcccagcccccacccatcagcctgaacaacctggagctgcaggacctgatgcacatcagccgggccaggaagccagccttcatcctgggctccatgagagatgagaagaggacccatgaccacctgctgtgcctggatggcggcggcgtgaagggcctcatcatcatccagctgctgattgccatcgagaaggccagcggcgtggccaccaaggacctgtttgactgggtggccggcaccagcactggaggcatcctggccctggccatcctgcacagcaagtccatggcctacatgaggggcatgtacttcaggatgaaggatgaggtgttccggggcagccggccctatgagagcggccccctggaggagttcctgaagcgggagtttggagagcacaccaagatgacagatgtgaggaagcccaaggtgatgctgaccggcaccctgagtgaccggcagcctgctgagctgcacctgttcagaaattatgatgcccctgagaccgtgcgggagccccgcttcaaccagaatgtgaacctgcggcccccagcccagcccagcgaccagctggtgtggagggctgcccggagcagcggggccgcccccacctacttccggcccaacggccgcttcctggatggcggcctgctggccaacaaccccaccctggatgccatgacagagatccacgagtacaaccaggacctgatcaggaagggccaggccaacaaggtgaagaagctgagcatcgtggtgtccctgggcaccggccgcagcccccaggtgcctgtgacctgtgtggatgtgttccggcccagcaacccctgggagctggccaagacagtgtttggagccaaggagctgggcaagatggtggtggactgctgcacagatcctgatggccgggctgtggaccgggcccgggcctggtgtgagatggtgggcatccagtacttccggctgaacccccagctgggcacagacatcatgctggatgaggtgtctgacacagtgctggtgaatgccctgtgggagacagaggtgtacatctatgagcaccgggaggagttccagaagctgatccagctgctgctgagcccctag

SEQ ID NO: 21133 - DNA, 501 bp, Artificial Sequence
  Description of Artificial Sequence: Synthetic coding sequence
atgcagttcttcggccgcctggtgaacaccttcagcggcgtgaccaacctcttcagcaaccccttccgggtgaaggaggtggccgtggccgactacaccagcagtgacagagtgcgggaggagggccagctgatcctcttccagaacacccccaacagaacctgggactgtgtgctggtgaaccccaggaacagccagagcggcttccgctgtgccaactgtgccgagaatgaggagggctgcacccccctgcacctggcctgcaggaaaggagatggagagatcctggtggagctggtgcagtactgccacacccagatggatgtgacagactacaagggggagaccgtcttccactatgctgtgcagggcgacaacagccaggtgctgcagctgctgggcagaaatgctgtggccggcctgaaccaggtgaacaaccagggcctgacccccctgcacctggcctgccagctgggcaagcaggagatggtgcgggtgtag

SEQ ID NO: 21134 - DNA, 1299 bp, Artificial Sequence
  Description of Artificial Sequence: Synthetic coding sequence
atgcagttcttcggccgcctggtgaacaccttcagcggcgtgaccaacctcttcagcaaccccttccgggtgaaggaggtggccgtggccgactacaccagcagtgacagagtgcgggaggagggccagctgatcctcttccagaacacccccaacagaacctgggactgtgtgctggtgaaccccaggaacagccagagcggcttccgcctcttccagctggagctggaggctgatgccctggtgaacttccaccagtacagcagccagctgctgcccttctatgagagcagcccccaggtgctgcacacagaggtgctgcagcacctgacagacctgatccggaaccaccccagctggagcgtggcccacctggccgtggagctgggcatccgggagtgcttccaccacagccgcatcatccgggtgcgcagcgcccaccaggtgcccggcctgtgggagctgatcagcacccaccacgagattgagttcagccagcccccccaggccgtgcccatcgcccggaggacccggcgggccgcccacccctgcacctggccagctgcccgggtgatgggccgctcctggtggagctggtgcagcacagccaccctgcgctggatgagccccaccacccgggagcggcccagcagcatcatgctgagccgggtgaccatcctgcgctgctgccgctgtgccgagatgatcatctccatggacagcagccagatccacagcaaggaccccaggtatggagccagccccctgcactgggccaagaatgctgagatggccaggatgctgctgaagaggggctgcaatgtgaacagcaccagcagcgctggcaacacagccctgcacgtggccgtgatgaggaacagatttgactgtgccatcgtgctgctgacccacggggccaatgctgatgcccggggggagcacggcaacacccccctgcacctggccatgagcaaggacaacgtggagatgatcaaggccctgattgtgtttggagctgaggtggacaccccaaatgactttggagagacccccaccttcctggccagcaagattggccgcctggtgaccaggaaggccatcctgaccctgctgaggacagtgggcgctgagtactgcttcccccccatccacggcgtgcctgctgagcagggcagcgctgccccccaccaccccttcagcctggagcgggcccagcccccacccatcagcctgaacaacctgggcagccaccccagccaggccggctggtgggcctggggcgccgccagtgatggatag

SEQ ID NO: 21135 - DNA, 243 bp, Artificial Sequence
  Description of Artificial Sequence: Synthetic coding sequence
atgcagttcttcggccgcctggtgaacaccttcagcggcgtgaccaacctcttcagcaaccccttccgggtgaaggaggtggccgtggccgactacaccagcagtgacagagtgcgggaggagggccagctgatcctcttccagaacacccccaacagaacctgggactgtgtgctggtgaaccccaggaacagccagagcggcttccgcctcttccagctggagctggaggctgatgcctag

SEQ ID NO: 21136 - DNA, 498 bp, Artificial Sequence
  Description of Artificial Sequence: Synthetic coding sequence
atgggccccctgcctgtgtgcctgcccatcatgctgctgctgctgctgcccagcctgctgctgctgctgctgctgcccggccctggcagcggggaggccagccgcatcctgcgggtgcacagaagaggcatcctggagctggccggcaccgtgggctgtgtgggccccaggacccccatcgcctacatgaagtatggctgcttctgtggcctgggcggccacggccagcccagagatgccatcgactggtgctgccacggccatgactgctgctacaccagggctgaggaggccggctgcagccccaagacagagcgctacagctggcagtgtgtgaaccagagcgtgctgtgtggccctgctgagaacaagtgccaggagctgctgtgcaagtgtgaccaggagatcgccaactgcctggcccagacagagtacaacctgaagtacctgttctacccccagttcctgtgtgagccagacagccccaagtgtgactag

SEQ ID NO: 21137 - DNA, 498 bp, Artificial Sequence; identical to SEQ ID NO: 21136
  Description of Artificial Sequence: Synthetic coding sequence

SEQ ID NO: 21138 - DNA, 570 bp, Artificial Sequence
  Description of Artificial Sequence: Synthetic coding sequence
atggccctgctgagcaggcctgccctgaccctgctgctgctgctgatggctgctgtggtgcgctgccaggagcaggcccagaccacagactggagggccaccctgaagaccatcagaaatggagtgcacaagattgacacctacctgaatgctgccctggacctgctgggcggagaagatggcctgtgccagtacaagtgcagtgatggcagcaagcccttccccaggtatggctacaagcccagccccccaaatggctgcggcagccccctgtttggagtgcacctgaacatcggcatccccagcctgaccaagtgctgcaaccagcacgaccgctgctatgagacctgtgggaagagcaagaatgactgtgatgaggagttccagtactgcctgagcaagatctgcagagatgtgcagaagaccctgggcctgacccagcacgtgcaggcctgtgagaccaccgtggagctgctgtttgacagcgtcatccacctgggctgcaagccctacctggacagccagagagctgcctgccgctgccactatgaggagaagacagacctgtag

SEQ ID NO: 21139 - DNA, 213 bp, Artificial Sequence
  Description of Artificial Sequence: Synthetic coding sequence
atggccctgctgagcaggcctgccctgaccctgctgctgctgctgatggctgctgtggtgcgctgccaggagcaggcccagaccacagactggagggccaccctgaagaccatcagaaatggagtgcacaagattgacacctacctgaatgctgccctggacctgctgggcggagaagatggcctgtgccagtacaagtgcagtgatgcctag

SEQ ID NO: 21140 - DNA, 588 bp, Artificial Sequence
  Description of Artificial Sequence: Synthetic coding sequence
atgaagctggccagcggcttcctggtgctgtggctgagcctgggcggcggcctggcccagagcgacaccagcccagacacagaggagagctacagcgactggggcctgcggcacctgcggggcagctttgaatctgtgaacagctactttgacagcttcctggagctgctgggcggcaagaatggagtgtgccagtaccgctgccgctatggcaaggcccccatgccccggcccggctacaagccccaggagcccaacggctgcggcagctacttcctgggcctgaaggtgcctgagagcatggacctgggcatcccagccatgaccaagtgctgcaaccagctggatgtgtgctatgacacctgtggggccaacaagtaccgctgtgatgccaagttccgctggtgcctgcacagcatctgcagcgacctgaagaggagcctgggctttgtgtccaaggtggaggccgcctgtgacagcctggtggacaccgtcttcaacacagtgtggaccctgggctgccggcccttcatgaacagccagagagctgcctgcatctgtgccgaggaggagaaggaggagctgtag

SEQ ID NO: 21141 - DNA, 3876 bp, Artificial Sequence
  Description of Artificial Sequence: Synthetic coding sequence
atggccggggccgccagcccctgtgccaacggctgcggccctggggcccccagtgatgctgaggtgctgcacctgtgccgcagcctggaggtgggcaccgtgatgaccctcttctacagcaagaagagccagaggcctgagaggaagaccttccaggtgaagctggagacccggcagatcacctggagcagaggagctgacaagattgaaggagccatcgacatccgggagatcaaggagatccggcctgggaagaccagccgggactttgaccgctaccaggaggaccctgccttccggccagaccagagccactgctttgtgatcctgtatggcatggagttccggctgaagaccctgagcctgcaggccaccagtgaagatgaggtgaacatgtggatcaagggcctgacctggctgatggaggacaccctgcaggcccccacccccctgcagatcgagcgctggctgaggaagcagttctacagcgtggacaggaacagagaagatcgcatcagcgccaaggacctgaagaacatgctgagccaggtgaactacagagtgcccaacatgaggttcctgcgggagcggctgacagacctggagcagaggtctggggacatcacctacggccagtttgcccagctgtaccgcagcctgatgtacagcgcccagaagaccatggacctgcccttcctggaggccagcaccctgcgggccggggagaggcctgagctgtgccgggtgtccctgcctgagttccagcagttcctgctggactaccagggcgagctgtgggccgtggaccggctgcaggtgcaggagttcatgctgtccttcctgcgggaccccctgcgggagattgaggagccctacttcttcctggatgaatttgtgaccttcctgttcagcaaggagaacagcgtgtggaacagccagctggatgctgtgtgcccagacaccatgaacaaccccctgagccactactggatcagcagcagccacaacacctacctgaccggggaccagttcagcagcgagagcagcctggaggcctatgcccgctgcctgaggatgggctgccgctgcatcgagctggactgctgggatggcccagatggcatgcctgtgatctaccacggccacaccctgaccaccaagatcaagttcagtgatgtgctgcacaccatcaaggagcacgcctttgtggccagcgagtaccctgtgatcctgagcattgaggaccactgcagcatcgcccagcagaggaacatggcccagtacttcaagaaggtgctgggggacaccctgctgaccaagcctgtggagatctctgcagatggcctgcccagccccaaccagctgaagaggaagatcctgatcaagcacaagaagctggccgagggcagcgcctatgaggaggtgcccacctccatgatgtacagtgaaaatgacatcagcaacagcatcaagaatggcatcctgtacctggaggaccctgtgaaccacgagtggtacccccactactttgtgctgaccagcagcaagatctactacagcgaggagaccagcagtgaccagggcaatgaagatgaggaggagcccaaggaggtgagcagcagcacagagctgcacagcaatgagaagtggttccacggcaagctgggcgccggcagagatggccgccacatcgccgagcggctgctgacagagtactgcatcgagaccggggccccagatggcagcttcctggtgcgggagagcgagacctttgtgggggactacaccctgtccttctggagaaatggcaaggtgcagcactgccgcatccacagccggcaggatgctggcacccccaagttcttcctgacagacaacctggtgtttgacagcctgtatgacctgatcacccactaccagcaggtgcccctgcgctgcaatgaatttgagatgaggctgtctgagcctgtgccccagaccaatgcccacgagagcaaggagtggtaccacgccagcctgacccgggcccaggccgagcacatgctgatgagggtgcccagagatggagccttcctggtgaggaagagaaatgagcccaacagctatgccatctccttccgggcagagggcaagatcaagcactgccgggtgcagcaggagggccagacagtgatgctgggcaacagcgagtttgacagcctggtggacctgatctcctactatgagaagcaccccctgtacaggaagatgaagctgcgctaccccatcaatgaggaggccctggagaagattggaacagctgagccagactatggagccctgtatgagggcaggaaccctggcttctacgtggaggccaaccccatgcccaccttcaagtgtgctgtgaaggccctgtttgactacaaggcccagagagaagatgagctgaccttcatcaagagcgccatcatccagaatgtggagaagcaggagggcggctggtggaggggggactatggaggcaagaagcagctgtggttccccagcaactacgtggaggagatggtgaaccctgtggccctggagcctgagcgggagcacctggatgagaacagccccctgggggacctgctgcggggcgtgctggatgtgcctgcctgccagatcgccatccggcctgagggcaagaacaaccggctgtttgtgttcagcatctccatggcctctgtggcccactggagcctggatgtggccgctgacagccaggaggagctgcaggactgggtgaagaagatccgggaggtggcccagacagcagatgcccggctgacagagggcaagatcatggagaggaggaagaagatcgccctggagctgtctgagctggtggtgtactgcaggcctgtgccctttgatgaggagaagattggaacagagcgggcctgctacagagacatgagcagcttccctgagaccaaggccgagaagtatgtgaacaaggccaagggcaagaagttcctgcagtacaaccggctgcagctgagccgcatctaccccaagggccagaggctggacagcagcaactatgaccccctgcccatgtggatctgtggcagccagctggtggccctgaacttccagaccccagacaagcccatgcagatgaaccaggccctcttcatgacaggccgccactgcggctacgtgctgcagcccagcaccatgagagatgaggcctttgacccctttgacaagagcagcctgcggggcctggagccctgtgccatcagcattgaggtgctgggcgcccggcacctgcccaagaatggccggggcatcgtgtgcccctttgtggagattgaggtggccggggctgaatatgacagcaccaagcagaagacagaatttgtggtggacaatggcctgaaccctgtgtggccagccaagcccttccacttccagatcagcaaccctgagtttgccttcctgcgctttgtggtgtatgaggaggacatgttcagtgaccagaacttcctggcccaggccaccttccctgtgaagggcctgaagacaggctacagagctgtgcccctgaagaacaactacagcgaggacctggagctggccagcctgctgatcaagattgacatcttccctgccaagcaggagaatggagacctgagccccttcagcggcaccagcctgcgggagcggggcagtgatgccagcggccagctgttccacggccgggcccgggagggcagctttgagagccgctaccagcagccctttgaggacttccgcatcagccaggagcacctggccgaccactttgacagccgggagcggcgggcccccaggaggaccagggtgaatggagacaaccggctgtag

SEQ ID NO: 21142 - DNA, 3873 bp, Artificial Sequence
  Description of Artificial Sequence: Synthetic coding sequence
atggccggggccgccagcccctgtgccaacggctgcggccctggggcccccagtgatgctgaggtgctgcacctgtgccgcagcctggaggtgggcaccgtgatgaccctcttctacagcaagaagagccagaggcctgagaggaagaccttccaggtgaagctggagacccggcagatcacctggagcagaggagctgacaagattgaaggagccatcgacatccgggagatcaaggagatccggcctgggaagaccagccgggactttgaccgctaccaggaggaccctgccttccggccagaccagagccactgctttgtgatcctgtatggcatggagttccggctgaagaccctgagcctgcaggccaccagtgaagatgaggtgaacatgtggatcaagggcctgacctggctgatggaggacaccctgcaggcccccacccccctgcagatcgagcgctggctgaggaagcagttctacagcgtggacaggaacagagaagatcgcatcagcgccaaggacctgaagaacatgctgagccaggtgaactacagagtgcccaacatgaggttcctgcgggagcggctgacagacctggagcagaggtctggggacatcacctacggccagtttgcccagctgtaccgcagcctgatgtacagcgcccagaagaccatggacctgcccttcctggaggccagcaccctgcgggccggggagaggcctgagctgtgccgggtgtccctgcctgagttccagcagttcctgctggactaccagggcgagctgtgggccgtggaccggctgcaggtgcaggagttcatgctgtccttcctgcgggaccccctgcgggagattgaggagccctacttcttcctggatgaatttgtgaccttcctgttcagcaaggagaacagcgtgtggaacagccagctggatgctgtgtgcccagacaccatgaacaaccccctgagccactactggatcagcagcagccacaacacctacctgaccggggaccagttcagcagcgagagcagcctggaggcctatgcccgctgcctgaggatgggctgccgctgcatcgagctggactgctgggatggcccagatggcatgcctgtgatctaccacggccacaccctgaccaccaagatcaagttcagtgatgtgctgcacaccatcaaggagcacgcctttgtggccagcgagtaccctgtgatcctgagcattgaggaccactgcagcatcgcccagcagaggaacatggcccagtacttcaagaaggtgctgggggacaccctgctgaccaagcctgtggagatctctgcagatggcctgcccagccccaaccagctgaagaggaagatcctgatcaagcacaagaagctggccgagggcagcgcctatgaggaggtgcccacctccatgatgtacagtgaaaatgacatcagcaacagcatcaagaatggcatcctgtacctggaggaccctgtgaaccacgagtggtacccccactactttgtgctgaccagcagcaagatctactacagcgaggagaccagcagtgaccagggcaatgaagatgaggaggagcccaaggaggtgagcagcagcacagagctgcacagcaatgagaagtggttccacggcaagctgggcgccggcagagatggccgccacatcgccgagcggctgctgacagagtactgcatcgagaccggggccccagatggcagcttcctggtgcgggagagcgagacctttgtgggggactacaccctgtccttctggagaaatggcaaggtgcagcactgccgcatccacagccggcaggatgctggcacccccaagttcttcctgacagacaacctggtgtttgacagcctgtatgacctgatcacccactaccagcaggtgcccctgcgctgcaatgaatttgagatgaggctgtctgagcctgtgccccagaccaatgcccacgagagcaaggagtggtaccacgccagcctgacccgggcccaggccgagcacatgctgatgagggtgcccagagatggagccttcctggtgaggaagagaaatgagcccaacagctatgccatctccttccgggcagagggcaagatcaagcactgccgggtgcagcaggagggccagacagtgatgctgggcaacagcgagtttgacagcctggtggacctgatctcctactatgagaagcaccccctgtacaggaagatgaagctgcgctaccccatcaatgaggaggccctggagaagattggaacagctgagccagactatggagccctgtatgagggcaggaaccctggcttctacgtggaggccaaccccatgcccaccttcaagtgtgctgtgaaggccctgtttgactacaaggcccagagagaagatgagctgaccttcatcaagagcgccatcatccagaatgtggagaagcaggagggcggctggtggaggggggactatggaggcaagaagcagctgtggttccccagcaactacgtggaggagatggtgaaccctgtggccctggagcctgagcgggagcacctggatgagaacagccccctgggggacctgctgcggggcgtgctggatgtgcctgcctgccagatcgccatccggcctgagggcaagaacaaccggctgtttgtgttcagcatctccatggcctctgtggcccactggagcctggatgtggccgctgacagccaggaggagctgcaggactgggtgaagaagatccgggaggtggcccagacagcagatgcccggctgacagagggcaagatcatggagaggaggaagaagatcgccctggagctgtctgagctggtggtgtactgcaggcctgtgccctttgatgaggagaagattggaacagagcgggcctgctacagagacatgagcagcttccctgagaccaaggccgagaagtatgtgaacaaggccaagggcaagaagttcctgcagtacaaccggctgcagctgagccgcatctaccccaagggccagaggctggacagcagcaactatgaccccctgcccatgtggatctgtggcagccagctggtggccctgaacttccagaccccagacaagcccatgcagatgaaccaggccctcttcatgacaggccgccactgcggctacgtgctgcagcccagcaccatgagagatgaggcctttgacccctttgacaagagcagcctgcggggcctggagccctgtgccatcagcattgaggtgctgggcgcccggcacctgcccaagaatggccggggcatcgtgtgcccctttgtggagattgaggtggccggggctgaatatgacagcaccaagcagaagacagaatttgtggtggacaatggcctgaaccctgtgtggccagccaagcccttccacttccagatcagcaaccctgagtttgccttcctgcgctttgtggtgtatgaggaggacatgttcagtgaccagaacttcctggcccaggccaccttccctgtgaagggcctgaagacaggctacagagctgtgcccctgaagaacaactacagcgaggacctggagctggccagcctgctgatcaagattgacatcttccctgccaaggaaaatggagacctgagccccttcagcggcaccagcctgcgggagcggggcagtgatgccagcggccagctgttccacggccgggcccgggagggcagctttgagagccgctaccagcagccctttgaggacttccgcatcagccaggagcacctggccgaccactttgacagccgggagcggcgggcccccaggaggaccagggtgaatggagacaaccggctgtag

SEQ ID NO: 21143 - DNA, 3876 bp, Artificial Sequence; identical to SEQ ID NO: 21141
  Description of Artificial Sequence: Synthetic coding sequence

SEQ ID NO: 21144 - DNA, 3798 bp, Artificial Sequence
  Description of Artificial Sequence: Synthetic coding sequence
atgagcaccaccgtgaatgtggacagcctggccgagtatgagaagagccagatcaagagggccctggagctgggcaccgtgatgacagtgttctccttcaggaagagcaccccagagaggagaacagtgcaggtgatcatggagacccggcaggtggcctggagcaagacagctgacaagattgagggcttcctggacatcatggagatcaaggagatccggcctgggaagaacagcaaggactttgagcgggccaaggctgtgcggcagaaggaggactgctgcttcaccatcctgtatggcacccagtttgtgctgagcaccctgagcctggccgctgacagcaaagaagatgctgtgaactggctgagcggcctgaagatcctgcaccaggaggccatgaatgccagcacccccaccatcatcgagagctggctgaggaagcagatctacagcgtggaccagaccaggaggaacagcatcagcctgcgggagctgaagaccatcctgcccctcatcaacttcaaggtgtcctctgccaagttcctgaaggacaagtttgtggagatcggggcccacaaggatgagctgagctttgagcagttccacctgttctacaagaagctgatgtttgagcagcagaagagcatcctggatgagttcaagaaggacagcagcgtcttcatcctgggcaacacagacagaccagatgccagcgctgtgtacctgcatgacttccagcgcttcctgatccacgagcagcaggagcactgggcccaggacctgaacaaggtgcgggagaggatgaccaagttcattgatgacaccatgagggagacagctgagcccttcctgtttgtggatgagttcctgacctacctgttcagccgggagaacagcatctgggatgagaagtatgatgctgtggacatgcaggacatgaacaaccccctgagccactactggatcagcagcagccacaacacctacctgaccggggaccagctgcggtctgagagcagccctgaggcctacatccgctgcctgaggatgggctgccgctgcatcgagctggactgctgggatggcccagatggcaagcctgtgatctaccacggctggaccaggaccaccaagatcaagtttgatgatgtggtgcaggccatcaaggaccacgcctttgtgaccagcagcttccctgtgatcctgagcattgaggagcactgcagcgtggagcagcagaggcacatggccaaggccttcaaggaggtgtttggagacctgctgctgaccaagcccacagaggccagcgctgaccagctgcccagccccagccagctgcgggagaagatcatcatcaagcacaagaagctgggccccagaggagatgtggatgtgaacatggaggacaagaaggatgagcacaagcagcagggcgagctgtacatgtgggacagcattgaccagaagtggaccaggcactactgtgccatcgcagatgccaagctgtccttcagtgatgacatcgagcagaccatggaggaggaggtgccccaggacatccccccaacagagctgcactttggagagaagtggttccacaagaaggtggagaagaggaccagcgctgagaagctgctgcaggagtactgcatggagaccggcggcaaggatggcaccttcctggtgcgggagagcgagaccttccccaatgactacaccctgtccttctggaggagcggccgggtgcagcactgccgcatccgcagcaccatggagggcggcaccctgaagtactacctgacagacaacctgaccttcagcagcatctatgccctgatccagcactaccgggagacccacctgcgctgtgccgagtttgagctgcggctgacagatcctgtgcccaaccccaacccccatgagagcaagccctggtactatgacagcctgagcagaggagaggccgaggacatgctgatgaggatccccagagatggagccttcctgatcaggaagcgggagggcagtgacagctatgccatcaccttccgggcccggggcaaggtgaagcactgccgcatcaacagagatggccgccactttgtgctgggcaccagcgcctactttgagagcctggtggagctggtgtcctactatgagaagcacagcctgtacaggaagatgaggctgcgctaccctgtgaccccagagctgctggagcgctacaacatggagcgggacatcaacagcctgtatgatgtgtccaggatgtatgtggaccccagcgagatcaaccccagcatgccccagaggacagtgaaggccctgtatgactacaaggccaagagaagtgatgagctgtccttctgccgcggggccctgatccacaacgtgtccaaggagcccggcggctggtggaagggggactatggcacccgcatccagcagtacttccccagcaactacgtggaggacatcagcacagctgactttgaggagctggagaagcagatcatcgaggacaaccccctgggcagcctgtgccggggcatcctggacctgaacacctacaacgtggtgaaggccccccagggcaagaaccagaagagctttgtgttcatcctggagcccaagcagcagggcgacccccctgtggagtttgccacagacagagtggaggagctgtttgagtggttccagagcatccgggagatcacctggaagattgacaccaaggagaacaacatgaagtactgggagaagaaccagagcatcgccatcgagctgagtgacctggtggtgtactgcaagcccaccagcaagaccaaggacaacctggagaacccagacttccgggagatccgcagctttgtggagaccaaggctgacagcatcatccggcagaagcctgtggacctgctgaagtacaaccagaagggcctgaccagggtgtaccccaagggccagagggtggacagcagcaactatgaccccttccggctgtggctgtgtggcagccagatggtggccctgaacttccagacagctgacaagtacatgcagatgaaccacgccctcttcagcctgaatggaagaacaggctacgtgctgcagcctgagagcatgaggacagagaagtatgaccccatgcctcctgagagccagaggaagatcctgatgaccctgactgtgaaggtgctgggcgcccggcacctgcccaagctgggccgcagcatcgcctgcccctttgtggaggtggagatctgtggggctgaatatgacaacaacaagttcaagaccaccgtggtgaatgacaatggcctgagccccatctgggcccccacccaggagaaggtgacctttgagatctatgaccccaacctggccttcctgcgctttgtggtgtatgaggaggacatgttcagtgaccccaacttcctggcccacgccacctaccccatcaaggctgtgaagagcggcttccgctctgtgcccctgaagaatggctacagtgaagatattgagctggccagcctgctggtgttctgtgagatgaggcctgtgctggagagcgaggaggagctgtacagcagctgccggcagctgcggcggcggcaggaggagctgaacaaccagctgttcctgtatgacacccaccagaacctgagaaatgccaacagagatgccctggtgaaggagttctctgtgaatgaaaaccagctgcagctgtaccaggagaagtgcaacaagaggctgcgggagaagagggtgagcaacagcaagttctacagctag

SEQ ID NO: 21145 - DNA, 2916 bp, Artificial Sequence
  Description of Artificial Sequence: Synthetic coding sequence
atgagcctgaagaatgagccccgggtgaacaccagcgccctgcagaagattgctgctgacatgagcaacatcatcgagaacctggacacccgggagctgcactttgaaggagaggaggtggactatgatgtgagccccagcgaccccaagatccaggaggtgtacatccccttcagcgccatctacaacacccagggcttcaaggagcccaacatccagacctacctgagcggctgccccatcaaggcccaggtgctggaggtggagcgcttcaccagcaccaccagggtgcccagcatcaacctgtacaccatcgagctgacccatggagagttcaagtggcaggtgaagaggaagttcaagcacttccaggagttccaccgggagctgctgaagtacaaggccttcatccgcatccccatccccacccggcggcacaccttccggcggcagaatgtgcgggaggagccccgggagatgcccagcctgcccaggagcagcgagaacatgatccgggaggagcagttcctgggccgcaggaagcagctggaggactacctgaccaagatcctgaagatgcccatgtacagaaactaccacgccaccacagagttcctggacatcagccagctgtccttcatccatgacctgggccccaagggcatcgagggcatgatcatgaagaggtctgggggccaccgcatccctggcctgaactgctgcggccagggccgggcctgctaccgctggagcaagcgctggctgattgtgaaggacagcttcctgctgtacatgaagccagattctggggccatcgcctttgtgctgctggtggacaaggagttcaagatcaaggtgggcaagaaggagacagagaccaagtatggcatcagaattgacaacctgagcaggaccctcatcctgaagtgcaacagctacagacatgcccgctggtggggcggggccatcgaggagttcatccagaagcacggcaccaacttcctgaaggaccaccgcttcggcagctatgctgccatccaggagaatgccctggccaagtggtacgtgaatgccaagggctactttgaagatgtggccaatgccatggaggaggccaatgaggagatcttcatcacagactggtggctgagccctgagatcttcctgaagaggcctgtggtggagggcaaccgctggaggctggactgcatcctgaagaggaaggcccagcagggcgtgcgcatcttcatcatgctgtacaaggaggtggagctggccctgggcatcaacagcgagtacaccaagaggaccctgatgaggctgcaccccaacatcaaggtgatgaggcacccagaccacgtgagcagcacagtgtacctgtgggcccaccacgagaagctggtgatcatcgaccagagcgtggcctttgtgggcggcatcgacctggcctacggccgctgggatgacaatgagcaccggctgacagatgtgggctctgtgaagagggtgaccagcggccccagcctgggcagcctgcccccagctgccatggagagcatggagagcctgcggctgaaggacaagaatgaacctgtgcagaacctgcccatccagaagagcattgatgatgtggacagcaagctgaagggcatcggcaagcccaggaagttcagcaagttcagcctgtacaagcagctgcaccgccaccacctgcatgatgctgacagcatcagcagcattgacagcaccagcagctacttcaaccactaccgcagccaccacaacctgatccacggcctgaagccccacttcaagctgttccaccccagcagcgagagcgagcagggcctgacccggccccacgccgacaccggcagcatccgcagcctgcagacaggagtgggggagctgcacggggagacccgcttctggcacggcaaggactactgcaactttgtgttcaaggactgggtgcagctggacaagccctttgctgacttcatcgaccgctacagcacccccaggatgccctggcatgacatcgccagcgctgtgcacggcaaggccgccagagatgtggcccggcacttcatccagcgctggaacttcaccaagatcatgaagagcaagtaccgcagcctgagctaccccttcctgctgcccaagagccagaccacagcccacgagctgcgctaccaggtgcccggctctgtgcacgccaacgtgcagctgctgcggtctgctgctgactggagcgctggcatcaagtaccacgaggagagcatccacgccgcctacgtgcacgtgattgagaacagccgccactacatctacatcgagaaccagttcttcatcagctgtgctgatgacaaggtggtgttcaacaagattggagatgccatcgcccagaggatcctgaaggcccaccgggagaaccagaagtacagagtgtatgtggtgatccccctgctgcccggctttgaaggagacatcagcactggaggcggcaatgccctgcaggccatcatgcacttcaactaccgcaccatgtgccgcggggagaacagcatcctgggccagctgaaggccgagctgggcaaccagtggatcaactacatctccttctgtggcctgcggacccacgccgagctggagggcaacctggtgacagagctgatctacgtgcacagcaagctgctgattgctgatgacaacacagtcatcatcggcagcgccaacatcaatgaccgctccatgctgggcaagagggacagcgagatggccgtcatcgtgcaggacacagagaccgtgcccagcgtgatggatggcaaggagtaccaggccggccgctttgcccggggcctgcggctgcagtgcttccgcagcaagatgaccccaggagtggaggacccctag

SEQ ID NO: 21146 - DNA, 1794 bp, Artificial Sequence
  Description of Artificial Sequence: Synthetic coding sequence
atgagcctgaagaatgagccccgggtgaacaccagcgccctgcagaagattgctgctgacatgagcaacatcatcgagaacctggacacccgggagctgcactttgaaggagaggaggtggactatgatgtgagccccagcgaccccaagatccaggaggtgtacatccccttcagcgccatctacaacacccagggcttcaaggagcccaacatccagacctacctgagcggctgccccatcaaggcccaggtgctggaggtggagcgcttcaccagcaccaccagggtgcccagcatcaacctgtacaccatcgagctgacccatggagagttcaagtggcaggtgaagaggaagttcaagcacttccaggagttccaccgggagctgctgaagtacaaggccttcatccgcatccccatccccacccggcggcacaccttccggcggcagaatgtgcgggaggagccccgggagatgcccagcctgcccaggagcagcgagaacatgatccgggaggagcagttcctgggccgcaggaagcagctggaggactacctgaccaagatcctgaagatgcccatgtacagaaactaccacgccaccacagagttcctggacatcagccagctgtccttcatccatgacctgggccccaagggcatcgagggcatgatcatgaagaggtctgggggccaccgcatccctggcctgaactgctgcggccagggccgggcctgctaccgctggagcaagcgctggctgattgtgaaggacagcttcctgctgtacatgaagccagattctggggccatcgcctttgtgctgctggtggacaaggagttcaagatcaaggtgggcaagaaggagacagagaccaagtatggcatcagaattgacaacctgagcaggaccctcatcctgaagtgcaacagctacagacatgcccgctggtggggcggggccatcgaggagttcatccagaagcacggcaccaacttcctgaaggaccaccgcttcggcagctatgctgccatccaggagaatgccctggccaagtggtacgtgaatgccaagggctactttgaagatgtggccaatgccatggaggaggccaatgaggagatcttcatcacagactggtggctgagccctgagatcttcctgaagaggcctgtggtggagggcaaccgctggaggctggactgcatcctgaagaggaaggcccagcagggcgtgcgcatcttcatcatgctgtacaaggaggtggagctggccctgggcatcaacagcgagtacaccaagaggaccctgatgaggctgcaccccaacatcaaggtgatgaggcacccagaccacgtgagcagcacagtgtacctgtgggcccaccacgagaagctggtgatcatcgaccagagcgtggcctttgtgggcggcatcgacctggcctacggccgctgggatgacaatgagcaccggctgacagatgtgggctctgtgaagagggtgaccagcggccccagcctgggcagcctgcccatccctggccccagcgtggtgtaccggcaggtgtgggagagctgcatgggcaagccagacagcggcatggagaggaccacagccatcagcagcagcaagacaggcttcaacctgatcaacctgctgctgatcagcctgaccggcacccccaggcctggctgccccggcatgaccctgcccctgcagagcactggaagaaggctggtgatgtggcacgtgaccagcagcagcgctggcaccagccagaagctgtag

SEQ ID NO: 21147 - DNA, 3225 bp, Artificial Sequence
  Description of Artificial Sequence: Synthetic coding sequence
atgagcctgaagaatgagccccgggtgaacaccagcgccctgcagaagattgctgctgacatgagcaacatcatcgagaacctggacacccgggagctgcactttgaaggagaggaggtggactatgatgtgagccccagcgaccccaagatccaggaggtgtacatccccttcagcgccatctacaacacccagggcttcaaggagcccaacatccagacctacctgagcggctgccccatcaaggcccaggtgctggaggtggagcgcttcaccagcaccaccagggtgcccagcatcaacctgtacaccatcgagctgacccatggagagttcaagtggcaggtgaagaggaagttcaagcacttccaggagttccaccgggagctgctgaagtacaaggccttcatccgcatccccatccccacccggcggcacaccttccggcggcagaatgtgcgggaggagccccgggagatgcccagcctgcccaggagcagcgagaacatgatccgggaggagcagttcctgggccgcaggaagcagctggaggactacctgaccaagatcctgaagatgcccatgtacagaaactaccacgccaccacagagttcctggacatcagccagctgtccttcatccatgacctgggccccaagggcatcgagggcatgatcatgaagaggtctgggggccaccgcatccctggcctgaactgctgcggccagggccgggcctgctaccgctggagcaagcgctggctgattgtgaaggacagcttcctgctgtacatgaagccagattctggggccatcgcctttgtgctgctggtggacaaggagttcaagatcaaggtgggcaagaaggagacagagaccaagtatggcatcagaattgacaacctgagcaggaccctcatcctgaagtgcaacagctacagacatgcccgctggtggggcggggccatcgaggagttcatccagaagcacggcaccaacttcctgaaggaccaccgcttcggcagctatgctgccatccaggagaatgccctggccaagtggtacgtgaatgccaagggctactttgaagatgtggccaatgccatggaggaggccaatgaggagatcttcatcacagactggtggctgagccctgagatcttcctgaagaggcctgtggtggagggcaaccgctggaggctggactgcatcctgaagaggaaggcccagcagggcgtgcgcatcttcatcatgctgtacaaggaggtggagctggccctgggcatcaacagcgagtacaccaagaggaccctgatgaggctgcaccccaacatcaaggtgatgaggcacccagaccacgtgagcagcacagtgtacctgtgggcccaccacgagaagctggtgatcatcgaccagagcgtggcctttgtgggcggcatcgacctggcctacggccgctgggatgacaatgagcaccggctgacagatgtgggctctgtgaagagggtgaccagcggccccagcctgggcagcctgcccccagctgccatggagagcatggagagcctgcggctgaaggacaagaatgaacctgtgcagaacctgcccatccagaagagcattgatgatgtggacagcaagctgaagggcatcggcaagcccaggaagttcagcaagttcagcctgtacaagcagctgcaccgccaccacctgcatgatgctgacagcatcagcagcattgacagcaccagcagctacttcaaccactaccgcagccaccacaacctgatccacggcctgaagccccacttcaagctgttccaccccagcagcgagagcgagcagggcctgacccggccccacgccgacaccggcagcatccgcagcctgcagacaggagtgggggagctgcacggggagacccgcttctggcacggcaaggactactgcaactttgtgttcaaggactgggtgcagctggacaagccctttgctgacttcatcgaccgctacagcacccccaggatgccctggcatgacatcgccagcgctgtgcacggcaaggccgccagagatgtggcccggcacttcatccagcgctggaacttcaccaagatcatgaagagcaagtaccgcagcctgagctaccccttcctgctgcccaagagccagaccacagcccacgagctgcgctaccaggtgcccggctctgtgcacgccaacgtgcagctgctgcggtctgctgctgactggagcgctggcatcaagtaccacgaggagagcatccacgccgcctacgtgcacgtgattgagaacagccgccactacatctacatcgagaaccagttcttcatcagctgtgctgatgacaaggtggtgttcaacaagattggagatgccatcgcccagaggatcctgaaggcccaccgggagaaccagaagtacagagtgtatgtggtgatccccctgctgcccggctttgaaggagacatcagcactggaggcggcaatgccctgcaggccatcatgcacttcaactaccgcaccatgtgccgcggggagaacagcatcctgggccagctgaaggccgagctgggcaaccagtggatcaactacatctccttctgtggcctgcggacccacgccgagctggagggcaacctggtgacagagctgatctacgtgcacagcaagctgctgattgctgatgacaacacagtcatcatcggcagcgccaacatcaatgaccgctccatgctgggcaagagggacagcgagatggccgtcatcgtgcaggacacagagaccgtgcccagcgtgatggatggcaaggagtaccaggccggccgctttgcccggggcctgcggctgcagtgcttccgggtggtgctgggctacctggatgaccccagcgaggacatccaggaccctgtgtctgacaagttcttcaaggaggtgtgggtgtccacagctgccagaaatgccaccatctatgacaaggtgttccgctgcctgcccaatgatgaggtgcacaacctgatccagctgcgggacttcatcaacaagcctgtgctggccaaggaggaccccatccgggcagaggaggagctgaagaagatccggggcttcctggtgcagttccccttctacttcctgtctgaggagagcctgctgcccagcgtgggcaccaaggaggccatcgtgcccatggaggtgtggacctag

SEQ ID NO: 21148 - DNA, 3111 bp, Artificial Sequence
  Description of Artificial Sequence: Synthetic coding sequence
atgagcctgaagaatgagccccgggtgaacaccagcgccctgcagaagattgctgctgacatgagcaacatcatcgagaacctggacacccgggagctgcactttgaaggagaggaggtggactatgatgtgagccccagcgaccccaagatccaggaggtgtacatccccttcagcgccatctacaacacccagggcttcaaggagcccaacatccagacctacctgagcggctgccccatcaaggcccaggtgctggaggtggagcgcttcaccagcaccaccagggtgcccagcatcaacctgtacaccatcgagctgacccatggagagttcaagtggcaggtgaagaggaagttcaagcacttccaggagttccaccgggagctgctgaagtacaaggccttcatccgcatccccatccccacccggcggcacaccttccggcggcagaatgtgcgggaggagccccgggagatgcccagcctgcccaggagcagcgagaacatgatccgggaggagcagttcctgggccgcaggaagcagctggaggactacctgaccaagatcctgaagatgcccatgtacagaaactaccacgccaccacagagttcctggacatcagccagctgtccttcatccatgacctgggccccaagggcatcgagggcatgatcatgaagaggtctgggggccaccgcatccctggcctgaactgctgcggccagggccgggcctgctaccgctggagcaagcgctggctgattgtgaaggacagcttcctgctgtacatgaagccagattctggggccatcgcctttgtgctgctggtggacaaggagttcaagatcaaggtgggcaagaaggagacagagaccaagtatggcatcagaattgacaacctgagcaggaccctcatcctgaagtgcaacagctacagacatgcccgctggtggggcggggccatcgaggagttcatccagaagcacggcaccaacttcctgaaggaccaccgcttcggcagctatgctgccatccaggagaatgccctggccaagtggtacgtgaatgccaagggctactttgaagatgtggccaatgccatggaggaggccaatgaggagatcttcatcacagactggtggctgagccctgagatcttcctgaagaggcctgtggtggagggcaaccgctggaggctggactgcatcctgaagaggaaggcccagcagggcgtgcgcatcttcatcatgctgtacaaggaggtggagctggccctgggcatcaacagcgagtacaccaagaggaccctgatgaggctgcaccccaacatcaaggtgatgaggcacccagaccacgtgagcagcacagtgtacctgtgggcccaccacgagaagctggtgatcatcgaccagagcgtggcctttgtgggcggcatcgacctggcctacggccgctgggatgacaatgagcaccggctgacagatgtgggctctgtgaagagggtgaccagcggccccagcctgggcagcctgcccccagctgccatggagagcatggagagcctgcggctgaaggacaagaatgaacctgtgcagaacctgcccatccagaagagcattgatgatgtggacagcaagctgaagggcatcggcaagcccaggaagttcagcaagttcagcctgtacaagcagctgcaccgccaccacctgcatgatgctgacagcatcagcagcattgacagcaccagcaacacaggcagcatccgcagcctgcagacaggagtgggggagctgcacggggagacccgcttctggcacggcaaggactactgcaactttgtgttcaaggactgggtgcagctggacaagccctttgctgacttcatcgaccgctacagcacccccaggatgccctggcatgacatcgccagcgctgtgcacggcaaggccgccagagatgtggcccggcacttcatccagcgctggaacttcaccaagatcatgaagagcaagtaccgcagcctgagctaccccttcctgctgcccaagagccagaccacagcccacgagctgcgctaccaggtgcccggctctgtgcacgccaacgtgcagctgctgcggtctgctgctgactggagcgctggcatcaagtaccacgaggagagcatccacgccgcctacgtgcacgtgattgagaacagccgccactacatctacatcgagaaccagttcttcatcagctgtgctgatgacaaggtggtgttcaacaagattggagatgccatcgcccagaggatcctgaaggcccaccgggagaaccagaagtacagagtgtatgtggtgatccccctgctgcccggctttgaaggagacatcagcactggaggcggcaatgccctgcaggccatcatgcacttcaactaccgcaccatgtgccgcggggagaacagcatcctgggccagctgaaggccgagctgggcaaccagtggatcaactacatctccttctgtggcctgcggacccacgccgagctggagggcaacctggtgacagagctgatctacgtgcacagcaagctgctgattgctgatgacaacacagtcatcatcggcagcgccaacatcaatgaccgctccatgctgggcaagagggacagcgagatggccgtcatcgtgcaggacacagagaccgtgcccagcgtgatggatggcaaggagtaccaggccggccgctttgcccggggcctgcggctgcagtgcttccgggtggtgctgggctacctggatgaccccagcgaggacatccaggaccctgtgtctgacaagttcttcaaggaggtgtgggtgtccacagctgccagaaatgccaccatctatgacaaggtgttccgctgcctgcccaatgatgaggtgcacaacctgatccagctgcgggacttcatcaacaagcctgtgctggccaaggaggaccccatccgggcagaggaggagctgaagaagatccggggcttcctggtgcagttccccttctacttcctgtctgaggagagcctgctgcccagcgtgggcaccaaggaggccatcgtgcccatggaggtgtggacctag

SEQ ID NO: 21149 - DNA, 429 bp, Artificial Sequence
  Description of Artificial Sequence: Synthetic coding sequence
atgagcctgaagaatgagccccgggtgaacaccagcgccctgcagaagattgctgctgacatgagcaacatcatcgagaacctggacacccgggagctgcactttgaaggagaggaggtggactatgatgtgagccccagcgaccccaagatccaggaggtgtacatccccttcagcgccatctacaacacccagggcttcaaggagcccaacatccagacctacctgagcggctgccccatcaaggcccaggtgctggaggtggagcgcttcaccagcaccaccagggtgcccagcatcaacctgtacaccatcgagctgacccatggagagttcaagtggcaggtgaagaggaagttcaagcacttccaggagttccaccgggagctgctgaagtacaaggccttcatccgcatccccatcccctag

SEQ ID NO: 21150 - DNA, 2580 bp, Artificial Sequence
  Description of Artificial Sequence: Synthetic coding sequence
atgtacagcggggccggccctgccctggcccccccagcccctcctccacccatccagggctacgccttcaagcccccacccaggccagactttggcaccagcggccgcaccatcaagctgcaggccaacttctttgagatggacatccccaagattgacatctaccactatgagctggacatcaagccagagaagtgcccccggcgggtgaaccgggagatcgtggagcacatggtgcagcacttcaagacccagatctttggagacaggaagcctgtgtttgatggcaggaagaacctgtacacagccatgcccctgcccatcggccgggacaaggtggagctggaggtgaccctgcccggggagggcaaggaccgcatcttcaaggtgtccatcaagtgggtgtcctgtgtgtccctgcaggccctgcatgatgccctgagcggccgcctgcccagcgtgccctttgagaccatccaggccctggatgtggtgatgaggcacctgcccagcatgagatacacccctgtgggccgctccttcttcaccgccagcgagggctgcagcaaccccctgggcggcggccgggaggtgtggtttggcttccaccagagcgtgcggcccagcctgtggaagatgatgctgaacattgatgtgtctgccacagccttctacaaggcccagcctgtgattgaatttgtgtgtgaggtgctggacttcaagagcattgaggagcagcagaagcccctgacagacagccagagggtgaagttcaccaaggagatcaagggcctgaaggtggagatcacccactgcggccagatgaagaggaagtacagagtgtgcaatgtgacccggcggcctgccagccaccagaccttccccctgcagcaggagagcggccagacagtggagtgcaccgtggcccagtacttcaaggacagacacaagctggtgctgcgctacccccacctgccctgcctgcaggtgggccaggagcagaagcacacctacctgcccctggaggtgtgcaacatcgtggccggccagcgctgcatcaagaagctgacagacaaccagaccagcaccatgatccgggccacagcccggagcgccccagaccggcaggaggagatcagcaagctgatgaggtctgccagcttcaacacagacccctacgtgcgggagtttggcatcatggtgaaggatgagatgacagatgtgacaggccgggtgctgcagcccccatccatcctgtatggaggaagaaacaaggccatcgccacccctgtgcagggcgtgtgggacatgaggaacaagcagttccacacaggcatcgagatcaaggtgtgggccatcgcctgctttgccccccagaggcagtgcacagaggtgcacctgaagagcttcacagagcagctgaggaagatcagcagagatgctggcatgcccatccagggccagccctgcttctgcaagtatgcccagggcgctgacagcgtggagcccatgttccgccacctgaagaacacctacgccggcctgcagctggtggtggtgatcctgcccgggaagacccctgtgtatgcagaggtgaagagggtgggggacacagtgctgggcatggccacccagtgtgtgcagatgaagaatgtgcagaggaccaccccccagaccctgagcaacctgtgcctgaagatcaacgtgaagctgggcggcgtgaacaacatcctgctgccccagggccggccccctgtgttccagcagcccgtcatcttcctgggcgcagatgtgacccaccccccagctggagatggcaagaagcccagcattgctgctgtggtgggctccatggatgcccaccccaaccgctactgtgccaccgtgcgggtgcagcagcaccggcaggagatcatccaggacctggccgccatggtgcgggagctgctgatccagttctacaagagcacccgcttcaagcccacccgcatcatcttctacagagatggagtgtctgagggccagttccagcaggtgctgcaccacgagctgctggccatccgggaggcctgcatcaagctggagaaggactaccagcccggcatcaccttcatcgtggtgcagaagaggcaccacaccaggctcttctgcacagacaagaatgaaagagtgggcaagagcggcaacatcccagctggcaccaccgtggacaccaagatcacccaccccacagaatttgacttctacctgtgcagccacgccggcatccagggcaccagccggcccagccactaccacgtgctgtgggatgacaaccgcttcagcagtgatgagctgcagatcctgacctaccagctgtgccacacctacgtgcgctgcaccaggtctgtgtccatcccagccccagcctactatgcccacctggtggccttccgggcccgctaccacctggtggacaaggagcatgacagcgctgagggcagccacaccagcggccagagcaatggccgggaccaccaggccctggccaaggctgtgcaggtgcaccaggacaccctgcggaccatgtactttgcctag

SEQ ID NO: 21151 - DNA, 1926 bp, Artificial Sequence
  Description of Artificial Sequence: Synthetic coding sequence
atgctgtctggaattgaagctgctgctggggagtatgaagattctgagctgcgctgccgggtggccgtggaggagctgagccctgggggccagccccggcggcggcaggccctgaggacagctgagctgagcctgggcagaaatgaaagaagagagctgatgctgcggctgcaggcccctggccctgctggccggccccgctgcttccccctgcgggccgcccggctcttcaccaggtttgctgaggccggccgcagcaccctgcggctgcctgcccatgacacccctggggccggggctgtgcagctgctgctgagtgactgccccccagaccggctgcggcgcttcctgcggaccctgcggctgaagctggccgccgcccctggccctggccctgccagcgcccgggcccagctgctgggcccccggccccgggactttgtgaccatcagccctgtgcagcctgaggagcggcggctgcgggccgccaccagggtgcctgacaccaccctggtgaagaggcctgtggagccccaggccggggctgagcccagcacagaggccccccgctggcccctgcctgtgaagaggctgagcctgcccagcaccaagccccagctgtctgaggagcaggccgctgtgctgcgggctgtgctgaagggccagagcatcttcttcaccggcagcgctggcaccgggaagagctacctgctgaagaggatcctgggcagcctgccccccaccggcaccgtggccacagccagcactggagtggccgcctgccacatcggcggcaccaccctgcacgcctttgctggcatcggcagcggccaggcccccctggcccagtgtgtggccctggcccagaggcctggggtgcggcagggctggctgaactgccagaggctggtgattgatgagatctccatggtggaggccgacctgtttgacaagctggaggccgtggcccgggctgtgcggcagcagaacaagccctttggaggcatccagctgatcatctgtggggacttcctgcagctgccccctgtgaccaagggcagccagcccccacgcttctgcttccagagcaagtcctggaagagatgtgtgcctgtgaccctggagctgaccaaggtgtggaggcaggccgaccagaccttcatcagcctgctgcaggccgtgcggctgggccgctgcagtgatgaggtgacccggcagctgcaggccacagccagccacaaggtgggcagagatggcatcgtggccacccggctgtgcacccaccaggatgatgtggccctgaccaatgaaagaaggctgcaggagctgcccgggaaggtgcacagatttgaggccatggacagcaaccctgagctggccagcaccctggatgcccagtgccctgtgtcccagctgctgcagctgaagctgggcgcccaggtgatgctggtgaagaacctgtctgtgtcccggggcctggtgaatggagcccggggcgtggtggtgggctttgaggccgagggccggggcctgccccaggtgcgcttcctgtgtggggtgacagaggtgattcatgctgaccgctggacagtgcaggccaccggcggccagctgctgagccggcagcagctgcccctgcagctggcctgggccatgagcatccacaagagccagggcatgaccctggactgtgtggagatcagcctgggccgggtgtttgccagcggccaggcctacgtggccctgagccgggcccggagcctgcagggcctgcgggtgctggactttgaccccatggctgtgcgctgtgacccccgggtgctgcacttctacgccaccctgcggcggggccgcagcctgagcctggagagcccagatgatgatgaggccgccagtgaccaggagaacatggaccccatcctgtag

SEQ ID NO: 21152 - DNA, 2124 bp, Artificial Sequence
  Description of Artificial Sequence: Synthetic coding sequence
atgctgtctggaattgaagctgctgctggggagtatgaagattctgagctgcgctgccgggtggccgtggaggagctgagccctgggggccagccccggcggcggcaggccctgaggacagctgagctgagcctgggcagaaatgaaagaagagagctgatgctgcggctgcaggcccctggccctgctggccggccccgctgcttccccctgcgggccgcccggctcttcaccaggtttgctgaggccggccgcagcaccctgcggctgcctgcccatgacacccctggggccggggctgtgcagctgctgctgagtgactgccccccagaccggctgcggcgcttcctgcggaccctgcggctgaagctggccgccgcccctggccctggccctgccagcgcccgggcccagctgctgggcccccggccccgggactttgtgaccatcagccctgtgcagcctgaggagcggcggctgcgggccgccaccagggtgcctgacaccaccctggtgaagaggcctgtggagccccaggccggggctgagcccagcacagaggccccccgctggcccctgcctgtgaagaggctgagcctgcccagcaccaagccccagctgtctgaggagcaggccgctgtgctgcgggctgtgctgaagggccagagcatcttcttcaccggcagcgctggcaccgggaagagctacctgctgaagaggatcctgggcagcctgccccccaccggcaccgtggccacagccagcactggagtggccgcctgccacatcggcggcaccaccctgcacgcctttgctggcatcggcagcggccaggcccccctggcccagtgtgtggccctggcccagaggcctggggtgcggcagggctggctgaactgccagaggctggtgattgatgagatctccatggtggaggccgacctgtttgacaagctggaggccgtggcccgggctgtgcggcagcagaacaagccctttggaggcatccagctgatcatctgtggggacttcctgcagctgccccctgtgaccaagggcagccagcccccacgcttctgcttccagagcaagtcctggaagagatgtgtgcctgtgaccctggagctgaccaaggtgtggaggcaggccgaccagaccttcatcagcctgctgcaggccgtgcggctgggccgctgcagtgatgaggtgacccggcagctgcaggccacagccagccacaaggtgggcagagatggcatcgtggccacccggctgtgcacccaccaggatgatgtggccctgaccaatgaaagaaggctgcaggagctgcccgggaaggtgcacagatttgaggccatggacagcaaccctgagctggccagcaccctggatgcccagtgccctgtgtcccagctgctgcagctgaagctgggcgcccaggtgatgctggtgaagaacctgtctgtgtcccggggcctggtgaatggagcccggggcgtggtggtgggctttgaggccgagggccggggcctgccccaggtgcgcttcctgtgtggggtgacagaggtgattcatgctgaccgctggacagtgcaggccaccggcggccagctgctgagccggcagcagctgcccctgcagctggcctgggccatgagcatccacaagagccagggcatgaccctggactgtgtggagatcagcctgggccgggtgtttgccagcggccaggcctacgtggccctgagccgggcccggagcctgcagggcctgcgggtgctggactttgaccccatggctgtgcgctgtgacccccgggtgctgcacttctacgccaccctgcggcggggccgcagcctgagcctggccgctgagggcagaggaaatgaagatcgctgcagcggcagcagcatccgggccctgggcggggactggtggggcctgcggctgggcgccgccagcaagcagaggacagagctgcgctgtgtgtccacagcccggcccagcctggcccagcccaggaccaacaccctgcagagcctgaccaaggagcacaagctgcagaatgtgcacccctacttcaagctgctcttccagggcatcaacagcgtgtggggccactag

SEQ ID NO: 21153 - DNA, 1926 bp, Artificial Sequence; identical to SEQ ID NO: 21151
  Description of Artificial Sequence: Synthetic coding sequence

SEQ ID NO: 21154 - DNA, 801 bp, Artificial Sequence
  Description of Artificial Sequence: Synthetic coding sequence
atgctgtctggaattgaagctgctgctggggagtatgaagattctgagctgcgctgccgggtggccgtggaggagctgagccctgggggccagccccggcggcggcaggccctgaggacagctgagctgagcctgggcagaaatgaaagaagagagctgatgctgcggctgcaggcccctggccctgctggccggccccgctgcttccccctgcgggccgcccggctcttcaccaggtttgctgaggccggccgcagcaccctgcggctgcctgcccatgacacccctggggccggggctgtgcagctgctgctgagtgactgccccccagaccggctgcggcgcttcctgcggaccctgcggctgaagctggccgccgcccctggccctggccctgccagcgcccgggcccagctgctgggcccccggccccgggactttgtgaccatcagccctgtgcagcctgaggagcggcggctgcgggccgccaccagggtgcctgacaccaccctggtgaagaggcctgtggagccccaggccggggctgagcccagcacagaggccccccgctggcccctgcctgtgaagaggctgagcctgcccagcaccaagccccagctgtctgaggagcaggccgctgtgctgcgggctgtgctgaagggccagagcatcttcttcaccggcagcgctggcagcggcggccgggaggaggtgggcggccagtggtggggcggcatcgaggagcagggcgacctgagcaactttgcccctgtgcaggagcagggcagccacatctgctag

SEQ ID NO: 21155 - DNA, 987 bp, Artificial Sequence
  Description of Artificial Sequence: Synthetic coding sequence
atgtccatgctggccgagaggaggaggaagcagaagtgggccgtggacccccagaacacagcctggagcaatgatgacagcaagtttggccagaggatgctggagaagatgggctggagcaagggcaagggcctgggcgcccaggagcagggcgccacagaccacatcaaggtgcaggtgaagaacaaccacctgggcctgggcgccaccatcaacaatgaagacaactggatcgcccaccaggatgacttcaaccagctgctggccgagctgaacacctgccacggccaggagaccacagacagcagtgacaagaaggagaagaagagcttcagcctggaggagaagagcaagatcagcaagaacagagtgcactacatgaagttcaccaagggcaaggacctgagcagccgcagcaagacagacctggactgcatctttgggaagaggcagagcaagaagaccccagaaggagatgccagccccagcaccccagaagaaaatgagaccaccaccaccagcgccttcaccatccaggagtactttgccaagaggatggccgccctgaagaacaagccccaggtgcctgtgcccggcagtgacatcagcgagacccaggtggagaggaagaggggcaagaagaggaacaaggaggccaccgggaaggatgtggagagctacctgcagcccaaggccaagaggcacacagagggcaagccagagagagctgaggcccaggagcgggtggccaagaagaagagcgccccagctgaggagcagctgcggggcccctgctgggaccagagcagcaaggccagcgcccaggatgctggggaccacgtgcagcccccagagggccgggacttcaccctgaagcccaagaagaggcggggcaagaagaagctgcagaagcctgtggagattgctgaagatgccaccctggaggagaccctggtgaagaagaagaagaagaaggacagcaagtag

SEQ ID NO: 21156 - DNA, 519 bp, Artificial Sequence
  Description of Artificial Sequence: Synthetic coding sequence
atgctggccgagaggaggaggaagcagaagtgggccgtggacccccagaacacagcctggagcaatgatgacagcaagtttggccagaggatgctggagaagatgggctggagcaagggcaagggcctgggcgcccaggagcagggcgccacagaccacatcaaggtgcaggtgaagaacaaccacctgggcctgggcgccaccatcaacaatgaagacaactggatcgcccaccaggatgacttcaaccagctgctggccgagctgaacacctgccacggccaggagaccacagacagcagtgacaagaaggagaagaagagcttcagcctggaggagaagagcaagatcagcaagaacagagtgcactacatgaagttcaccaagggccgctgccagagcctgcacagcagaggagagagaaatcatgacaaccagaggctgcaccaccctggggtgctgtgccaggctgatggcagcacagaggagcaggcccctggcagcagcagccgggtgtag

SEQ ID NO: 21157 - DNA, 525 bp, Artificial Sequence
  Description of Artificial Sequence: Synthetic coding sequence
atgtccatgctggccgagaggaggaggaagcagaagtgggccgtggacccccagaacacagcctggagcaatgatgacagcaagtttggccagaggatgctggagaagatgggctggagcaagggcaagggcctgggcgcccaggagcagggcgccacagaccacatcaaggtgcaggtgaagaacaaccacctgggcctgggcgccaccatcaacaatgaagacaactggatcgcccaccaggatgacttcaaccagctgctggccgagctgaacacctgccacggccaggagaccacagacagcagtgacaagaaggagaagaagagcttcagcctggaggagaagagcaagatcagcaagaacagagtgcactacatgaagttcaccaagggccgctgccagagcctgcacagcagaggagagagaaatcatgacaaccagaggctgcaccaccctggggtgctgtgccaggctgatggcagcacagaggagcaggcccctggcagcagcagccgggtgtag

SEQ ID NO: 21158 - DNA, 972 bp, Artificial Sequence
  Description of Artificial Sequence: Synthetic coding sequence
atgcctgtgcacagcagaggagacaagaaggagaccaaccaccatgatgagatggaggtggactatgcagaaaatgaaggcagcagcagtgaagatgaggacacagagagcagctctgtgtctgaagatggagacagcagcgagatggatgatgaggactgtgagaggaggaggatggagtgcctggatgagatgagcaacctggagaagcagttcacagacctgaaggaccagctgtacaaggagcggctgagccaggtggatgccaagctgcaggaggtgattgctgggaaggcccctgagtacctggagcccctggccaccctgcaggagaacatgcagatccgcaccaaggtggccggcatctaccgggagctgtgcctggagagcgtgaagaacaagtatgaatgtgagatccaggccagccggcagcactgtgagagcgagaagctgctgctgtatgacacagtgcagagcgagctggaggagaagatccggcggctggaggaggacagacacagcattgacatcaccagcgagctgtggaatgatgagctgcagagcaggaagaagaggaaggaccccttctccccagacaagaagaagcctgtggtggtgtctggcccctacatcgtgtacatgctgcaggacctggacatcctggaggactggaccaccatcaggaaggccatggccaccctgggcccccaccgggtgaagacagagccccctgtgaagctggagaagcacctgcacagcgcccggtctgaggagggccgcctgtactatgatggagagtggtacatccggggccagaccatctgcatcgacaagaaggatgaatgtcccaccagcgctgtgatcaccaccatcaaccatgatgaggtgtggttcaagaggccagatggcagcaagagcaagctgtacatcagccagctgcagaagggcaagtacagcatcaagcacagctag

SEQ ID NO: 21159 - DNA, 666 bp, Artificial Sequence
  Description of Artificial Sequence: Synthetic coding sequence
atgcctgtgatgaggctcttcccctgcttcctgcagctgctggccggcctggccctgcctgctgtgcccccccagcagtgggccctgtctgctggaaatggcagcagcgaggtggaggtggtgcccttccaggaggtgtggggccgcagctactgccgggccctggagcggctggtggatgtggtgtctgagtaccccagcgaggtggagcacatgttcagccccagctgtgtgtccctgctgcgctgcaccggctgctgcggagatgagaacctgcactgtgtgcctgtggagacagccaacgtgaccatgcagctgctgaagatccgcagcggggaccggcccagctatgtggagctgaccttcagccagcacgtgcgctgtgaatgtcgccacagccctggccggcagagcccagacatgcctggggacttccgggcagatgcccccagcttcctgcccccccggcgcagcctgcccatgctgttcaggatggagtggggctgtgccctgaccggcagccagagcgctgtgtggcccagcagccctgtgcctgaggagatccccaggatgcaccctggaagaaatggcaagaagcagcagaggaagcccctgcgggagaagatgaagccagagcgctgtggagatgctgtgcccaggaggtag

SEQ ID NO: 21160 - DNA, 450 bp, Artificial Sequence
  Description of Artificial Sequence: Synthetic coding sequence
atgcctgtgatgaggctcttcccctgcttcctgcagctgctggccggcctggccctgcctgctgtgcccccccagcagtgggccctgtctgctggaaatggcagcagcgaggtggaggtggtgcccttccaggaggtgtggggccgcagctactgccgggccctggagcggctggtggatgtggtgtctgagtaccccagcgaggtggagcacatgttcagccccagctgtgtgtccctgctgcgctgcaccggctgctgcggagatgagaacctgcactgtgtgcctgtggagacagccaacgtgaccatgcagctgctgaagatccgcagcggggaccggcccagctatgtggagctgaccttcagccagcacgtgcgctgtgaatgtcggcccctgcgggagaagatgaagccagagcgctgtggagatgctgtgcccaggaggtag

SEQ ID NO: 21161 - DNA, 513 bp, Artificial Sequence
  Description of Artificial Sequence: Synthetic coding sequence
atgcctgtgatgaggctcttcccctgcttcctgcagctgctggccggcctggccctgcctgctgtgcccccccagcagtgggccctgtctgctggaaatggcagcagcgaggtggaggtggtgcccttccaggaggtgtggggccgcagctactgccgggccctggagcggctggtggatgtggtgtctgagtaccccagcgaggtggagcacatgttcagccccagctgtgtgtccctgctgcgctgcaccggctgctgcggagatgagaacctgcactgtgtgcctgtggagacagccaacgtgaccatgcagctgctgaagatccgcagcggggaccggcccagctatgtggagctgaccttcagccagcacgtgcgctgtgaatgtcggcccctgcgggagaagatgaagccagagcggcggcggcccaagggccggggcaagagaagaagagagaagcagaggcccacagactgccacctgtgtggagatgctgtgcccaggaggtag

SEQ ID NO: 21162 - DNA, 477 bp, Artificial Sequence
  Description of Artificial Sequence: Synthetic coding sequence
atggccctggaggtgctgatgctgctggccgtgctgatctggacaggagctgagaacctgcacgtgaagatcagctgcagcctggactggctgatggtgtctgtcatccctgtggccgagagcaggaacctgtacatctttgctgatgagctgcacctgggcatgggctgcccagccaaccgcatccacacctacgtgtatgagttcatctacctggtgcgggactgtggcatccgcaccagggtggtgtctgaggagaccctgctcttccagacagagctgtacttcaccccaagaaatattgaccatgacccccaggagatccacctggagtgcagcaccagcaggaagtctgtgtggctgacccctgtgtccacagaaaatgagatcaagctggaccccagccccttcatcgctgacttccagaccacagctgaggagctgggcctgctgagcagcagccccaacctgctgtag

SEQ ID NO: 21163 - DNA, 1188 bp, Artificial Sequence
  Description of Artificial Sequence: Synthetic coding sequence
atgagggccctgctggcccggctgctgctgtgtgtgctggtggtgtctgacagcaagggcagcaatgagctgcaccaggtgccctacaagagcaagacctgctatgagggcaatggccacttctaccggggcaaggccagcacagacaccatgggccggccctgcctgccctggaacagcgccaccgtgctgcagcagacctaccacgcccacagaagtgatgccctgcagctgggcctgggcaagcacaactactgcagaaatccagacaacagaagaagaccctggtgctacgtgcaggtgggcctgaagctgctggtgcaggagtgcatggtgcatgactgtgctgatggcaagaagcccagcagccccccagaggagctgaagttccagtgtggccagaagaccctgcggccccgcttcaagatcatcggcggggagttcaccaccatcgagaaccagccctggtttgctgccatctaccgccgccaccggggcggctctgtgacctacgtgtgtggcggcagcctcatcagcccctgctgggtgatcagcgccacccactgcttcatcgactaccccaagaaggaggactacatcgtgtacctgggccgcagccggctgaacagcaacacccagggcgagatgaagtttgaggtggagaacctgatcctgcacaaggactacagcgctgacaccctggcccaccacaatgacatcgccctgctgaagatccgcagcaaggagggccgctgtgcccagcccagcaggaccatccagaccatctgcctgcccagcatgtacaatgacccccagtttggcaccagctgtgagatcaccggctttgggaaggagaacagcacagactacctgtacccagagcagctgaagatgacagtggtgaagctgatcagccaccgggagtgccagcagccccactactacggcagcgaggtgaccaccaagatgctgtgtgccgctgacccccagtggaagacagacagctgccagggcgacagcggcggccccctggtgtgcagcctgcagggccgcatgaccctgactggaattgtgtcctggggccggggctgtgccctgaaggacaagccaggagtgtacaccagggtgagccacttcctgccctggatccgcagccacaccaaggaggagaatggcctggccctgtag

SEQ ID NO: 21164 - DNA, 1188 bp, Artificial Sequence; identical to SEQ ID NO: 21163
  Description of Artificial Sequence: Synthetic coding sequence

SEQ ID NO: 21165 - DNA, 1296 bp, Artificial Sequence
  Description of Artificial Sequence: Synthetic coding sequence
atgagggccctgctggcccggctgctgctgtgtgtgctggtggtgtctgacagcaagggcagcaatgagctgcaccaggtgcccagcaactgtgactgcctgaatggaggcacctgtgtgagcaacaagtacttcagcaacatccactggtgcaactgccccaagaagtttggaggccagcactgtgaaattgacaagagcaagacctgctatgagggcaatggccacttctaccggggcaaggccagcacagacaccatgggccggccctgcctgccctggaacagcgccaccgtgctgcagcagacctaccacgcccacagaagtgatgccctgcagctgggcctgggcaagcacaactactgcagaaatccagacaacagaagaagaccctggtgctacgtgcaggtgggcctgaagctgctggtgcaggagtgcatggtgcatgactgtgctgatggcaagaagcccagcagccccccagaggagctgaagttccagtgtggccagaagaccctgcggccccgcttcaagatcatcggcggggagttcaccaccatcgagaaccagccctggtttgctgccatctaccgccgccaccggggcggctctgtgacctacgtgtgtggcggcagcctcatcagcccctgctgggtgatcagcgccacccactgcttcatcgactaccccaagaaggaggactacatcgtgtacctgggccgcagccggctgaacagcaacacccagggcgagatgaagtttgaggtggagaacctgatcctgcacaaggactacagcgctgacaccctggcccaccacaatgacatcgccctgctgaagatccgcagcaaggagggccgctgtgcccagcccagcaggaccatccagaccatctgcctgcccagcatgtacaatgacccccagtttggcaccagctgtgagatcaccggctttgggaaggagaacagcacagactacctgtacccagagcagctgaagatgacagtggtgaagctgatcagccaccgggagtgccagcagccccactactacggcagcgaggtgaccaccaagatgctgtgtgccgctgacccccagtggaagacagacagctgccagggcgacagcggcggccccctggtgtgcagcctgcagggccgcatgaccctgactggaattgtgtcctggggccggggctgtgccctgaaggacaagccaggagtgtacaccagggtgagccacttcctgccctggatccgcagccacaccaaggaggagaatggcctggccctgtag

SEQ ID NO: 21166 - DNA, 1245 bp, Artificial Sequence
  Description of Artificial Sequence: Synthetic coding sequence
atggtgttccacctgcggaccaggtatgagcaggccaactgtgactgcctgaatggaggcacctgtgtgagcaacaagtacttcagcaacatccactggtgcaactgccccaagaagtttggaggccagcactgtgaaattgacaagagcaagacctgctatgagggcaatggccacttctaccggggcaaggccagcacagacaccatgggccggccctgcctgccctggaacagcgccaccgtgctgcagcagacctaccacgcccacagaagtgatgccctgcagctgggcctgggcaagcacaactactgcaggaacccagacaacagaagaagaccctggtgctacgtgcaggtgggcctgaagctgctggtgcaggagtgcatggtgcatgactgtgctgatggcaagaagcccagcagccccccagaggagctgaagttccagtgtggccagaagaccctgcggccccgcttcaagatcattggaggagagttcaccaccatcgagaaccagccctggtttgctgccatctacagaagacacagaggaggctctgtgacctacgtgtgtggcggcagcctcatcagcccctgctgggtgatcagcgccacccactgcttcatcgactaccccaagaaggaggactacatcgtgtacctgggccgcagccggctgaacagcaacacccagggcgagatgaagtttgaggtggagaacctgatcctgcacaaggactacagcgctgacaccctggcccaccacaatgacatcgccctgctgaagatccgcagcaaggagggccgctgtgcccagcccagcaggaccatccagaccatctgcctgcccagcatgtacaatgacccccagtttggcaccagctgtgagatcactggatttgggaaggagaacagcacagactacctgtacccagagcagctgaagatgacagtggtgaagctgatcagccaccgggagtgccagcagccccactactacggcagcgaggtgaccaccaagatgctgtgtgccgctgacccccagtggaagacagacagctgccagggcgacagcggcggccccctggtgtgcagcctgcagggccgcatgaccctgaccggcatcgtgtcctggggccggggctgtgccctgaaggacaagccaggagtgtacaccagggtgagccacttcctgccctggatccgcagccacaccaaggaggagaatggcctggccctgtag

SEQ ID NO: 21167 - DNA, 3984 bp, Artificial Sequence
  Description of Artificial Sequence: Synthetic coding sequence
atggaggcccccctgcagacaggcatggtgctgggcgtgatgattggagctggggtggccgtggtggtgacagctgtgctgatcctgctggtggtgcggcggctgcgggtgcccaagaccccagccccagatggcccccgctaccgcttcaggaagagggacaaggtgctcttctacggcaggaagatcatgaggaaggtgtcccagagcaccagcagcctggtggacacctctgtgtctgccaccagccggcccaggatgaggaagaagctgaagatgctgaacatcgccaagaagatcctgcgcatccagaaggagacccccaccctgcagaggaaggagcccccacctgctgtgctggaggccgacctgacagaaggagacctggccaacagccacctgcccagcgaggtgctgtacatgctgaagaatgtgcgggtgctgggccactttgagaagcccctcttcctggagctgtgccgccacatggtgttccagaggctgggccagggcgactatgtgttccggcccggccagccagatgccagcatctacgtggtgcaggacggcctgctggagctgtgcctgcccggcccagatggcaaggaatgtgtggtgaaggaggtggtgcctggggacagcgtgaacagcctgctgagcatcctggatgtgatcaccggccaccagcacccccagaggacagtgtctgcccgggccgcccgggacagcacagtgctgcggctgcctgtggaggccttctctgctgtgttcaccaagtacccagagagcctggtgcgggtggtgcagatcatcatggtgcggctgcagagggtgaccttcctggccctgcacaactacctgggcctgaccaatgaactcttcagccatgagatccagcccctgcggctcttccccagccctggcctgcccaccaggaccagccctgtgcggggcagcaagaggatggtgtccaccagcgccacagatgagccccgggagaccccaggccggcccccagaccccaccggggcccccctgcccggccccaccggggaccctgtgaagcccaccagcctggagaccccatctgcccccctgctgagccgctgtgtgtccatgcctggggacatcagcggcctgcagggcggccccaggagtgactttgacatggcctatgaaagaggccgcatctctgtgtccctgcaggaggaggccagcggcggcagcctggccgccccagcccggacccccacccaggagccccgggagcagcctgctggggcctgtgagtacagctactgtgaagatgagagcgccaccggcggctgccccttcggcccctaccagggccggcagaccagcagcatctttgaagctgccaagcaggagctggccaagctgatgagaattgaggaccccagcctgctgaacagccgggtgctgctgcaccacgccaaggccggcaccatcatcgcccggcagggcgaccaggatgtgtccctgcactttgtgctgtggggctgcctgcacgtgtaccagaggatgattgacaaggccgaggatgtgtgcctgtttgtggcccagcctggagagctggtgggccagctggccgtgctgaccggggagcccctcatcttcaccctgcgggcccagagggactgcaccttcctgcgcatcagcaagagtgacttctatgagatcatgagggcccagcccagcgtggtgctgtctgctgcccacacagtggccgccaggatgagcccctttgtgcggcagatggactttgccatcgactggacagctgtggaggccggccgggccctgtaccggcagggcgacagaagtgactgcacctacatcgtgctgaatggccgcctgcggagcgtcatccagaggggcagcggcaagaaggagctggtgggggagtatggccgcggggacctgattggagtggtggaggccctgacccggcagccccgggccaccaccgtgcatgctgtgcgggacacagagctggccaagctgcctgagggcaccctgggccacatcaagaggcgctacccccaggtggtgaccaggctcatccacctgctgagccagaagatcctgggcaacctgcagcagctgcagggccccttccctgctggcagcggcctgggcgtgcccccccacagcgagctgaccaacccagccagcaacctggccaccgtggccatcctgcctgtgtgtgccgaggtgcccatggtggccttcaccctggagctgcagcacgccctgcaggccatcggccccaccctgctgctgaacagcgacatcatccgggcccggctgggcgccagcgccctggacagcatccaggagttccggctgagcggctggctggcccagcaggaggatgcccacagaattgtgctgtaccagacagatgccagcctgaccccctggacagtgcgctgcctgcggcaggccgactgcatcctgattgtgggcctgggggaccaggagcccaccctgggccagctggagcagatgctggagaacacagctgtgcgggccctgaagcagctggtgctgctgcaccgggaggagggcgccggccccaccaggacagtggagtggctgaacatgaggtcctggtgcagcggccacctgcacctgcgctgcccccggcggctcttcagcagaagaagccctgccaagctgcacgagctgtatgagaaggtgttcagcagaagagctgacagacacagcgacttcagccggctggcccgggtgctgactggaaacaccatcgccctggtgctgggcggcggcggggcccggggctgcagccacatcggcgtgctgaaggccctggaggaggccggcgtgcctgtggacctggtgggcggcaccagcatcggcagcttcatcggggccctgtatgcagaggagaggtctgccagcaggaccaagcagagggcccgggagtgggccaagtccatgacctctgtgctggagcctgtgctggacctgacctaccctgtgacctccatgttcaccggcagcgccttcaacagaagcatccacagggtcttccaggacaagcagatcgaggacctgtggctgccctacttcaacgtgaccacagacatcacagccagcgccatgagggtgcacaaggatggcagcctgtggaggtatgtgcgggcctccatgaccctgagcggctacctgccccccctgtgtgaccccaaggatggccacctgctgatggatggcggctacatcaacaacctgcctgctgacatcgcccgctccatgggcgccaagacagtgattgccattgatgtgggcagccaggatgaaacagacctgagcacctacggggacagcctgagcggctggtggctgctgtggaagaggctgaacccctgggccgacaaggtgaaggtgcctgacatggccgagatccagagccggctggcctacgtgtcctgtgtgcggcagctggaggtggtgaagagcagcagctactgtgagtacctgcggccccccatcgactgcttcaagaccatggactttgggaagtttgaccagatctatgatgtgggctaccagtatggcaaggctgtgtttggaggctggagcagaggaaatgtgattgagaagatgctgacagaccggcgcagcacagacctgaatgaaagcagaagagcagatgtgctggccttccccagcagcggcttcacagacctggccgagatcgtgtccagaattgagccccccaccagctatgtgtctgatggctgtgctgatggagaggagagtgactgcctgacagaatatgaggaggatgctggccctgactgcagcagagatgaaggaggcagccctgagggcgccagccccagcacagccagcgagatggaggaggagaagagcatcctgcggcagaggcgctgcctgccccaggagcccccaggcagcgccacagatgcctag

SEQ ID NO: 21168 - DNA, 846 bp, Artificial Sequence
  Description of Artificial Sequence: Synthetic coding sequence
atgggccacccccccctgctgcccctgctgctgctgctgcacacctgtgtgcctgcctcctggggcctgcgctgcatgcagtgcaagaccaatggagactgccgggtggaggagtgtgccctgggccaggacctgtgcaggaccaccatcgtgcggctgtgggaggagggggaggagctggagctggtggagaagagctgcacccacagcgagaagaccaacagaaccctgagctacagaacaggcctgaagatcaccagcctgacagaggtggtgtgtggcctggacctgtgcaaccagggcaacagcggccgggctgtgacctacagccgcagccgctacctggagtgcatcagctgtggcagcagtgacatgagctgtgagcggggccgccaccagagcctgcagtgccgcagccctgaggagcagtgcctggatgtggtgacccactggatccaggagggggaggagggccggcccaaggatgacagacacctgcggggctgcggctacctgcccggctgccccggcagcaatggcttccacaacaatgacaccttccacttcctgaagtgctgcaacaccaccaagtgcaatgaaggccccatcctggagctggagaacctgccccagaatggccggcagtgctacagctgcaagggcaacagcacccacggctgcagcagcgaggagaccttcctgattgactgccggggccccatgaaccagtgcctggtggccaccggcacccatgagaggagcctgtggggctcctggctgccctgcaagagcaccacagccctgcggcccccctgctgtgaggaggcccaggccacccacgtgtag

SEQ ID NO: 21169 - DNA, 1008 bp, Artificial Sequence
  Description of Artificial Sequence: Synthetic coding sequence
atgggccacccccccctgctgcccctgctgctgctgctgcacacctgtgtgcctgcctcctggggcctgcgctgcatgcagtgcaagaccaatggagactgccgggtggaggagtgtgccctgggccaggacctgtgcaggaccaccatcgtgcggctgtgggaggagggggaggagctggagctggtggagaagagctgcacccacagcgagaagaccaacagaaccctgagctacagaacaggcctgaagatcaccagcctgacagaggtggtgtgtggcctggacctgtgcaaccagggcaacagcggccgggctgtgacctacagccgcagccgctacctggagtgcatcagctgtggcagcagtgacatgagctgtgagcggggccgccaccagagcctgcagtgccgcagccctgaggagcagtgcctggatgtggtgacccactggatccaggagggggaggagggccggcccaaggatgacagacacctgcggggctgcggctacctgcccggctgccccggcagcaatggcttccacaacaatgacaccttccacttcctgaagtgctgcaacaccaccaagtgcaatgaaggccccatcctggagctggagaacctgccccagaatggccggcagtgctacagctgcaagggcaacagcacccacggctgcagcagcgaggagaccttcctgattgactgccggggccccatgaaccagtgcctggtggccaccggcacccatgagcccaagaaccagagctacatggtgcggggctgtgccacagcctccatgtgccagcacgcccacctgggagatgccttctccatgaaccacattgatgtgtcctgctgcaccaagagcggctgcaaccacccagacctggatgtgcagtaccgcagcggggccgccccccagcccggccctgcccacctgagcctgaccatcaccctgctgatgacagcccggctgtggggcggcaccctgctgtggacctag

SEQ ID NO: 21170 - DNA, 1038 bp, Artificial Sequence
  Description of Artificial Sequence: Synthetic coding sequence
atgagcctgtttggcctgctgctgctgaccagcgccctggccggccagaggcagggcacccaggccgagagcaacctgagcagcaagttccagttcagcagcaacaaggagcagaatggagtgcaggacccccagcacgagcgcatcatcaccgtgtccaccaacggcagcatccacagcccccgcttcccccacacctaccccaggaacacagtgctggtgtggaggctggtggccgtggaggagaatgtgtggatccagctgacctttgatgagcgcttcggcctggaggaccctgaagatgacatctgcaagtatgactttgtggaggtggaggagcccagtgatggcaccatcctgggccgctggtgtggcagcggcaccgtgcctgggaagcagatcagcaagggcaaccagatccgcatccgctttgtgtctgatgagtacttccccagcgagcccggcttctgcatccactacaacatcgtgatgccccagttcacagaggccgtgagccccagcgtgctgcccccatctgccctgcccctggacctgctgaacaatgccatcacagccttcagcaccctggaggacctgatccgctacctggagcctgagcgctggcagctggacctggaggacctgtaccggcccacctggcagctgctgggcaaggcctttgtgtttggaaggaagagccgggtggtggacctgaacctgctgacagaggaggtgcggctgtacagctgcaccccaagaaacttctctgtgtccatccgggaggagctgaagaggacagacaccatcttctggccaggctgcctgctggtgaagagatgtggcggcaactgtgcctgctgcctgcacaactgcaatgaatgccagtgtgtgcccagcaaggtgaccaagaagtaccacgaggtgctgcagctgcggcccaagacaggagtgcggggcctgcacaagagcctgacagatgtggccctggagcaccacgaggagtgtgactgtgtgtgccggggcagcactggaggatag

SEQ ID NO: 21171 - DNA, 549 bp, Artificial Sequence
  Description of Artificial Sequence: Synthetic coding sequence
atgccccagttcacagaagctgtgagccccagcgtgctgccccccagcgccctgcccctggacctgctgaacaatgccatcacagccttcagcaccctggaggacctgatccgctacctggagcctgagcgctggcagctggacctggaggacctgtaccggcccacctggcagctgctgggcaaggcctttgtgtttggaaggaagagccgggtggtggacctgaacctgctgacagaggaggtgcggctgtacagctgcacccccaggaacttctctgtgtccatccgggaggagctgaagaggacagacaccatcttctggccaggctgcctgctggtgaagagatgtggcggcaactgtgcctgctgcctgcacaactgcaatgaatgccagtgtgtgcccagcaaggtgaccaagaagtaccacgaggtgctgcagctgcggcccaagacaggagtgcggggcctgcacaagagcctgacagatgtggccctggagcaccatgaagaatgtgactgtgtgtgccggggcagcactggaggatag

SEQ ID NO: 21172 - DNA, 573 bp, Artificial Sequence
  Description of Artificial Sequence: Synthetic coding sequence
atgatgcagtacacctggctgctgaccaagcagttcacagaagctgtgagccccagcgtgctgccccccagcgccctgcccctggacctgctgaacaatgccatcacagccttcagcaccctggaggacctgatccgctacctggagcctgagcgctggcagctggacctggaggacctgtaccggcccacctggcagctgctgggcaaggcctttgtgtttggaaggaagagccgggtggtggacctgaacctgctgacagaggaggtgcggctgtacagctgcacccccaggaacttctctgtgtccatccgggaggagctgaagaggacagacaccatcttctggccaggctgcctgctggtgaagagatgtggcggcaactgtgcctgctgcctgcacaactgcaatgaatgccagtgtgtgcccagcaaggtgaccaagaagtaccacgaggtgctgcagctgcggcccaagacaggagtgcggggcctgcacaagagcctgacagatgtggccctggagcaccatgaagaatgtgactgtgtgtgccggggcagcactggaggatag

SEQ ID NO: 21173 - DNA, 504 bp, Artificial Sequence
  Description of Artificial Sequence: Synthetic coding sequence
atgagcctgtttggcctgctgctgctgaccagcgccctggccggccagaggcagggcacccaggccgagagcaacctgagcagcaagttccagttcagcagcaacaaggagcagaatggagtgcaggacccccagcacgagcgcatcatcaccgtgtccaccaacggcagcatccacagcccccgcttcccccacacctaccccaggaacacagtgctggtgtggaggctggtggccgtggaggagaatgtgtggatccagctgacctttgatgagcgcttcggcctggaggaccctgaagatgacatctgcaagtatgactttgtggaggtggaggagcccagtgatggcaccatcctgggccgctggtgtggcagcggcaccgtgcctgggaagcagatcagcaagggcaaccagatccgcatccgctttgtgtctgatgagtacttccccagcgagcccagcaacagaggaggcaagatcatccagctgcacaccagctag

SEQ ID NO: 21174 - DNA, 2217 bp, Artificial Sequence
  Description of Artificial Sequence: Synthetic coding sequence
atgcagccccgctgggcccagggcgccaccatgtggctgggcgtgctgctgaccctgctgctgtgcagcagcctggagggccaggagaacagcttcaccatcaacagcgtggacatgaagagcctgcctgactggacagtgcagaatggcaagaacctgaccctgcagtgctttgctgatgtgtccaccaccagccacgtgaagccccagcaccagatgctgttctacaaggatgatgtgctcttctacaacatcagctccatgaagagcacagagagctacttcatccctgaggtgcgcatctatgacagcggcacctacaagtgcaccgtcatcgtgaacaacaaggagaagaccacagctgagtaccaggtgctggtggagggcgtgcccagcccccgggtgaccctggacaagaaggaggccatccagggcggcatcgtgcgggtgaactgcagcgtgcctgaggagaaggcccccatccacttcaccatcgagaagctggagctgaatgagaagatggtgaagctgaagcgggagaagaacagccgggaccagaacttcgtcatcctggagttccctgtggaggagcaggacagagtgctgtccttccgctgccaggcccgcatcatcagcggcatccacatgcagaccagcgagagcaccaagtctgagctggtgacagtgacagagagcttcagcacccccaagttccacatcagccccaccggcatgatcatggagggcgcccagctgcacatcaagtgcaccatccaggtgacccacctggcccaggagttccctgagatcatcatccagaaggacaaggccatcgtggcccacaacagacatggcaacaaggctgtgtacagcgtgatggccatggtggagcacagcggcaactacacctgcaaggtggagagcagccgcatcagcaaggtgagcagcatcgtggtgaacatcacagagctgttcagcaagccagagctggagagcagcttcacccacctggaccagggcgagcggctgaacctgagctgcagcatccctggggcccccccagccaacttcaccatccagaaggaggacaccatcgtgtcccagacccaggacttcaccaagatcgccagcaagagtgacagcggcacctacatctgcacagctggcatcgacaaggtggtgaagaagagcaacacagtgcagatcgtggtgtgtgagatgctgagccagccccgcatctcctatgatgcccagtttgaagtcatcaagggccagaccatcgaggtgcgctgtgagagcatcagcggcaccctgcccatctcctaccagctgctgaagaccagcaaggtgctggagaacagcaccaagaacagcaatgaccctgctgtgttcaaggacaaccccacagaagatgtggagtaccagtgtgtggccgacaactgccacagccacgccaagatgctgtctgaggtgctgcgggtgaaggtgattgcccctgtggatgaggtgcagatcagcatcctgagcagcaaggtggtggagagcggagaagatattgtgctgcagtgtgctgtgaatgaaggcagcggccccatcacctacaagttctaccgggagaaggagggcaagcccttctaccagatgaccagcaatgccacccaggccttctggaccaagcagaaggccagcaaggagcaggagggggagtactactgcacagccttcaacagagccaaccacgccagctctgtgcccaggagcaagatcctgactgtgcgggtcatcctggccccctggaagaagggcctgattgctgtggtgatcattggagtcatcatcgccctgctgatcatcgccgccaagtgctacttcctgaggaaggccaaggccaagcagatgcctgtggagatgagcaggcctgctgtgcccctgctgaacagcaacaatgagaagatgtctgaccccaacatggaggccaacagccactacggccacaatgatgatgtgaggaaccacgccatgaagcccatcaatgacaacaaggagcccctgaacagtgatgtgcagtacacagaggtgcaggtgtcctctgctgagagccacaaggacctgggcaagaaggacacagaaacagtgtacagcgaggtgaggaaggctgtgcctgatgctgtggagagccgctacagcaggacagagggcagcctggatggcacctag

SEQ ID NO: 21175 - DNA, 636 bp, Artificial Sequence
  Description of Artificial Sequence: Synthetic coding sequence
atgaggaccctggcctgcctgctgctgctgggctgcggctacctggcccacgtgctggccgaggaggccgagatcccccgggaggtgattgaaaggctggcccggagccagatccacagcatccgggacctgcagaggctgctggagattgacagcgtgggcagcgaggacagcctggacaccagcctgcgggcccacggcgtgcacgccaccaagcacgtgcctgagaagaggcccctgcccatccggaggaagaggagcattgaggaggccgtgcctgctgtgtgcaagaccaggacagtcatctatgagatccccaggagccaggtggaccccaccagcgccaacttcctgatctggccaccctgtgtggaggtgaagcgctgcaccggctgctgcaacaccagctctgtgaagtgccagcccagccgggtgcaccacaggtctgtgaaggtggccaaggtggagtatgtgaggaagaagcccaagctgaaggaggtgcaggtgcggctggaggagcacctggagtgtgcctgtgccaccaccagcctgaacccagactaccgggaggaggacaccggccggccccgggagagcggcaagaagaggaagaggaagaggctgaagcccacctag

SEQ ID NO: 21176 - DNA, 591 bp, Artificial Sequence
  Description of Artificial Sequence: Synthetic coding sequence
atgaggaccctggcctgcctgctgctgctgggctgcggctacctggcccacgtgctggccgaggaggccgagatcccccgggaggtgattgaaaggctggcccggagccagatccacagcatccgggacctgcagaggctgctggagattgacagcgtgggcagcgaggacagcctggacaccagcctgcgggcccacggcgtgcacgccaccaagcacgtgcctgagaagaggcccctgcccatccggaggaagaggagcattgaggaggccgtgcctgctgtgtgcaagaccaggacagtcatctatgagatccccaggagccaggtggaccccaccagcgccaacttcctgatctggccaccctgtgtggaggtgaagcgctgcaccggctgctgcaacaccagctctgtgaagtgccagcccagccgggtgcaccacaggtctgtgaaggtggccaaggtggagtatgtgaggaagaagcccaagctgaaggaggtgcaggtgcggctggaggagcacctggagtgtgcctgtgccaccaccagcctgaacccagactaccgggaggaggacacagatgtgaggtag

SEQ ID NO: 21177 - DNA, 162 bp, Artificial Sequence
  Description of Artificial Sequence: Synthetic coding sequence
atgaggaccctggcctgcctgctgctgctgggctgcggctacctggcccacgtgctggccgaggaggccgagatcccccgggaggtgattgaaaggctggcccggagccagatccacagcatccgggacctgcagaggctgctggagattgacagcgtgtag

SEQ ID NO: 21178 - DNA, 3270 bp, Artificial Sequence
  Description of Artificial Sequence: Synthetic coding sequence
atgggcaccagccacccagccttcctggtgctgggctgcctgctgaccggcctgagcctcatcctgtgccagctgagcctgcccagcatcctgcccaatgaaaatgagaaggtggtgcagctgaacagcagcttcagcctgcgctgcttcggggagagcgaggtgtcctggcagtaccccatgtctgaggaggagagcagtgatgtggagatcagaaatgaggagaacaacagcggcctgtttgtgacagtgctggaggtgtcctctgccagcgctgcccacacaggcctgtacacctgctactacaaccacacccagacagaagaaaatgagctggagggccgccacatctacatctacgtgcctgaccctgatgtggcctttgtgcccctgggcatgacagactacctggtgattgtggaggatgatgattctgccatcatcccctgcaggaccacagatcctgagacccctgtgaccctgcacaacagcgagggcgtggtgcctgccagctatgacagccggcagggcttcaacggcaccttcaccgtgggcccctacatctgtgaggccaccgtgaagggcaagaagttccagaccatccccttcaacgtgtatgccctgaaggccaccagcgagctggacctggagatggaggccctgaagacagtgtacaagtctggagagaccatcgtggtgacctgtgctgtgttcaacaatgaggtggtggacctgcagtggacctacccaggagaggtgaagggcaagggcatcaccatgctggaggagatcaaggtgcccagcatcaagctggtgtacaccctgactgtgcctgaggccaccgtgaaggacagcggggactatgaatgtgccgcccggcaggccacccgggaggtgaaggagatgaagaaggtgaccatctctgtgcatgagaagggcttcatcgagatcaagcccaccttcagccagctggaggccgtgaacctgcacgaggtgaagcactttgtggtggaggtgcgggcctaccccccaccccgcatctcctggctgaagaacaacctgaccctgattgagaacctgacagagatcaccacagatgtggagaagatccaggagatccgctaccgcagcaagctgaagctgatccgggccaaggaggaggacagcggccactacaccatcgtggcccagaatgaagatgctgtgaagagctacacctttgagctgctgacccaggtgcccagcagcatcctggacctggtggatgaccaccacggcagcactggaggccagacagtgcgctgcacagctgagggcacccccctgcctgacatcgagtggatgatctgcaaggacatcaagaagtgcaacaatgagacctcctggaccatcctggccaacaacgtgagcaacatcatcacagagatccacagccgggacaggagcacagtggagggccgggtgacctttgccaaggtggaggagaccatcgctgtgcgctgcctggccaagaacctgctgggcgctgagaaccgggagctgaagctggtggcccccaccctgcggtctgagctgactgtggccgctgctgtgctggtgctgctggtgattgtcatcatcagcctgattgtgctggtggtgatctggaagcagaagcccaggtatgagatccgctggagggtcatcgagagcatcagcccagatggccacgagtacatctacgtggaccccatgcagctgccctatgacagccgctgggagttccccagagatggcctggtgctgggccgggtgctgggcagcggggccttcggcaaggtggtggagggcacagcctacggcctgagccgcagccagcctgtgatgaaggtggccgtgaagatgctgaagcccacagcccggagcagcgagaagcaggccctgatgtctgagctgaagatcatgacccacctgggcccccacctgaacatcgtgaacctgctgggcgcctgcaccaagagcggccccatctacatcatcacagagtactgcttctatggagacctggtgaactacctgcacaagaacagagacagcttcctgagccaccaccctgagaagcccaagaaggagctggacatcttcggcctgaacccagcagatgagagcaccaggagctatgtgatcctgagctttgagaacaacggggactacatggacatgaagcaggccgacaccacccagtatgtgcccatgctggagaggaaggaggtgtccaagtacagcgacatccagaggagcctgtatgacaggcctgccagctacaagaagaagtccatgctggacagcgaggtgaagaacctgctgagtgatgacaacagcgagggcctgaccctgctggacctgctgtccttcacctaccaggtggcccggggcatggagttcctggccagcaagaactgtgtgcaccgggacctggccgccagaaatgtgctgctggcccagggcaagatcgtgaagatctgtgactttggcctggcccgggacatcatgcatgacagcaactacgtgtccaagggcagcaccttcctgcctgtgaagtggatggcccctgagagcatctttgacaacctgtacaccaccctgagtgatgtgtggagctatggcatcctgctgtgggagatcttcagcctgggcggcaccccctacccaggcatgatggtggacagcaccttctacaacaagatcaagagcggctacaggatggccaagccagaccacgccaccagcgaggtgtatgagatcatggtgaagtgctggaacagcgagcctgagaagaggcccagcttctaccacctgtctgaaattgtggagaacctgctgcccggccagtacaagaagagctatgagaagatccacctggacttcctgaagagtgaccaccctgctgtggccaggatgagggtggacagcgacaatgcctacatcggcgtgacctacaagaatgaggaggacaagctgaaggactgggagggcggcctggatgagcagaggctgtctgctgacagcggctacatcatccccctgcctgacattgatcctgtgcctgaggaggaggacctgggcaagaggaacagacacagcagccagaccagcgaggagagcgccatcgagaccggcagcagcagcagcaccttcatcaagagagaagatgagaccatcgaggacatcgacatgatggatgacatcggcatcgacagcagtgacctggtggaggacagcttcctgtag

SEQ ID NO: 21179 - DNA, 480 bp, Artificial Sequence
  Description of Artificial Sequence: Synthetic coding sequence
atgggcaccagccacccagccttcctggtgctgggctgcctgctgaccggcctgagcctcatcctgtgccagctgagcctgcccagcatcctgcccaatgaaaatgagaaggtggtgcagctgaacagcagcttcagcctgcgctgcttcggggagagcgaggtgtcctggcagtaccccatgtctgaggaggagagcagtgatgtggagatcagaaatgaggagaacaacagcggcctgtttgtgacagtgctggaggtgtcctctgccagcgctgcccacacaggcctgtacacctgctactacaaccacacccagacagaagaaaatgagctggagggccgccacatctacatctacgtgcctgaccctgatgtggcctttgtgcccctgggcatgacagactacctggtgattgtggaggatgatgattctgccatcatcccctgcaggaccacagatcctgagacccctgtgtag

SEQ ID NO: 21180 - DNA, 477 bp, Artificial Sequence
  Description of Artificial Sequence: Synthetic coding sequence
atgggcaccagccacccagccttcctggtgctgggctgcctgctgaccggcctgagcctcatcctgtgccagctgagcctgcccagcatcctgcccaatgaaaatgagaaggtggtgcagctgaacagcagcttcagcctgcgctgcttcggggagagcgaggtgtcctggcagtaccccatgtctgaggaggagagcagtgatgtggagatcagaaatgaggagaacaacagcggcctgtttgtgacagtgctggaggtgtcctctgccagcgctgcccacacaggcctgtacacctgctactacaaccacacccagacagaagaaaatgagctggagggccgccacatctacatctacgtgcctgaccctgatgtggcctttgtgcccctgggcatgacagactacctggtgattgtggaggatgatgattctgccatcatcccctgcaggaccacagatcctgagaccccctag

SEQ ID NO: 21181 - DNA, 657 bp, Artificial Sequence
  Description of Artificial Sequence: Synthetic coding sequence
atgggcaccagccacccagccttcctggtgctgggctgcctgctgaccggcctgagcctcatcctgtgccagctgagcctgcccagcatcctgcccaatgaaaatgagaaggtggtgcagctgaacagcagcttcagcctgcgctgcttcggggagagcgaggtgtcctggcagtaccccatgtctgaggaggagagcagtgatgtggagatcagaaatgaggagaacaacagcggcctgtttgtgacagtgctggaggtgtcctctgccagcgctgcccacacaggcctgtacacctgctactacaaccacacccagacagaagaaaatgagctggagggccgccacatctacatctacgtgcctgaccctgatgtggcctttgtgcccctgggcatgacagactacctggtgattgtggaggatgatgattctgccatcatcccctgcaggaccacagatcctgagacccctgtgaccctgcacaacagcgagggcgtggtgcctgccagctatgacagccggcagggcttcaacggcaccttcaccgtgggcccctacatctgtgaggccaccgtgaagggcaagaagttccagaccatccccttcaacgtgtatgccctgaagggcacctgcatcatctccttcctgctgtag

SEQ ID NO: 21182 - DNA, 465 bp, Artificial Sequence
  Description of Artificial Sequence: Synthetic coding sequence
atgggcaccagccacccagccttcctggtgctgggctgcctgctgaccggcctgagcctcatcctgtgccagctgagcctgcccagcatcctgcccaatgaaaatgagaaggtggtgcagctgaacagcagcttcagcctgcgctgcttcggggagagcgaggtgtcctggcagtaccccatgtctgaggaggagagcagtgatgtggagatcagaaatgaggagaacaacagcggcctgtttgtgacagtgctggaggtgtcctctgccagcgctgcccacacaggcctgtacacctgctactacaaccacacccagacagaagaaaatgagctggagggccgccacatctacatctacgtgcctgaccctgatgtggcctttgtgcccctgggcatgacagactacctggtgattgtggaggatgatgattctgccatcatcccctgcaggaccacagactag

SEQ ID NO: 21183 - DNA, 3321 bp, Artificial Sequence
  Description of Artificial Sequence: Synthetic coding sequence
atgaggctgcccggggccatgcctgccctggccctgaagggggagctgctgctgctgagcctgctgctgctgctggagccccagatcagccagggcctggtggtgaccccacctggccctgagctggtgctgaatgtgagcagcacctttgtgctgacctgcagcggcagcgcccctgtggtgtgggagaggatgagccaggagcccccccaggagatggccaaggcccaggacggcaccttcagctctgtgctgaccctgaccaacctgaccggcctggacacaggagagtacttctgcacccacaatgacagccggggcctggagacagatgagaggaagaggctgtacatctttgtgcctgaccccaccgtgggcttcctgcccaatgatgctgaggagctgttcatcttcctgacagagatcacagagatcaccatcccctgccgggtgacagacccccagctggtggtgaccctgcacgagaagaagggagatgtggccctgcctgtgccctatgaccaccagaggggcttcagcggcatctttgaggacaggagctacatctgcaagaccaccatcggggaccgggaggtggacagtgatgcctactacgtgtaccgcctgcaggtgagcagcatcaacgtgtctgtgaatgctgtgcagacagtggtgcggcagggcgagaacatcaccctgatgtgcatcgtgattggaaatgaggtggtgaactttgagtggacctaccccaggaaggagagcggccgcctggtggagcctgtgacagacttcctgctggacatgccctaccacatccgcagcatcctgcacatccccagcgctgagctggaggacagcggcacctacacctgcaatgtgacagagagcgtgaatgaccaccaggatgagaaggccatcaacatcaccgtggtggagagcggctacgtgcggctgctgggggaggtgggcaccctgcagtttgctgagctgcacaggagcaggaccctgcaggtggtgtttgaggcctaccccccacccaccgtgctgtggttcaaggacaacagaaccctgggggacagcagcgctggggagatcgccctgagcaccagaaatgtgtctgagaccaggtatgtgtctgagctgaccctggtgcgggtgaaggtggccgaggccggccactacaccatgagggccttccatgaagatgctgaggtgcagctgtccttccagctgcagatcaacgtgcctgtgcgggtgctggagctgtctgagagccacccagattctggagagcagacagtgcgctgccggggccggggcatgccccagcccaacatcatctggagcgcctgccgggacctgaagcgctgcccccgggagctgccccccaccctgctgggcaacagcagcgaggaggagagccagctggagaccaacgtgacctactgggaggaggagcaggagtttgaggtggtgtccaccctgcggctgcagcacgtggaccggcccctgtctgtgcgctgcaccctgagaaatgctgtgggccaggacacccaggaggtgattgtggtgccccacagcctgcccttcaaggtggtggtgatcagcgccatcctggccctggtggtgctgaccatcatcagcctcatcatcctgatcatgctgtggcagaagaagcccaggtatgagatccgctggaaggtgattgaatctgtgtccagtgatggccacgagtacatctacgtggaccccatgcagctgccctatgacagcacctgggagctgccccgggaccagctggtgctgggccgcaccctgggcagcggggccttcggccaggtggtggaggccacagcccacggcctgagccacagccaggccaccatgaaggtggccgtgaagatgctgaagagcacagcccggagcagcgagaagcaggccctgatgtctgagctgaagatcatgagccacctgggcccccacctgaatgtggtgaacctgctgggcgcctgcaccaagggcggccccatctacatcatcacagagtactgccgctacggggacctggtggactacctgcacaggaacaagcacaccttcctgcagcaccacagcgacaagaggcggccccccagcgctgagctgtacagcaatgccctgcctgtgggcctgcccctgcccagccacgtgtccctgactggagagagtgatggcggctacatggacatgagcaaggatgagagcgtggactatgtgcccatgctggacatgaagggagatgtgaagtatgctgacatcgagagcagcaactacatggccccctatgacaactacgtgcccagcgcccctgagaggacctgccgggccaccctcatcaatgaaagccctgtgctgagctacatggacctggtgggcttctcctaccaggtggccaacggcatggagttcctggccagcaagaactgtgtgcaccgggacctggccgccagaaatgtgctgatctgtgagggcaagctggtgaagatctgtgactttggcctggcccgggacatcatgagggacagcaactacatcagcaagggcagcaccttcctgcccctgaagtggatggcccctgagagcatcttcaacagcctgtacaccaccctgagtgatgtgtggagctttggcatcctgctgtgggagatcttcaccctgggcggcaccccctacccagagctgcccatgaatgagcagttctacaatgccatcaagaggggctacaggatggcccagcctgcccacgccagtgatgagatctatgagatcatgcagaagtgctgggaggagaagtttgagatccggccccccttcagccagctggtgctgctgctggagcggctgctgggggagggctacaagaagaagtaccagcaggtggatgaggagttcctgcggagtgaccacccagccatcctgcggagccaggcccggctgcccggcttccacggcctgcggagccccctggacaccagctctgtgctgtacacagctgtgcagcccaatgaaggagacaatgactacatcatccccctgcctgaccccaagccagaggtggctgatgagggccccctggagggcagccccagcctggccagcagcaccctgaatgaggtgaacaccagcagcaccatcagctgtgacagccccctggagccccaggatgagcctgagcctgagccccagctggagctgcaggtggagcctgagcctgagctggagcagctgcctgacagcggctgcccagcccccagggctgaggccgaggacagcttcctgtag

SEQ ID NO: 21184 - DNA, 525 bp, Artificial Sequence
  Description of Artificial Sequence: Synthetic coding sequence
atgaggctgcccggggccatgcctgccctggccctgaagggggagctgctgctgctgagcctgctgctgctgctggagccccagatcagccagggcctggtggtgaccccacctggccctgagctggtgctgaatgtgagcagcacctttgtgctgacctgcagcggcagcgcccctgtggtgtgggagaggatgagccaggagcccccccaggagatggccaaggcccaggacggcaccttcagctctgtgctgaccctgaccaacctgaccggcctggacacaggagagtacttctgcacccacaatgacagccggggcctggagacagatgagaggaagaggctgtacatctttgtgcctgaccccaccgtgggcttcctgcccaatgatgctgaggagctgttcatcttcctgacagagatcacagagatcaccatcccctgccgggtgacagacccccagctggtggtgaccctgcacgagaagaagggagatgtggccctgcctgtgccctatgactag

SEQ ID NO: 21185 - DNA, 2331 bp, Artificial Sequence
  Description of Artificial Sequence: Synthetic coding sequence
gctgccagcgagccagacacagctggctctgtgcggggcctgcccacagcccactgccctgtggtggacaacagaaccctgggggacagcagcgctggggagatcgccctgagcaccagaaatgtgtctgagaccaggtatgtgtctgagctgaccctggtgcgggtgaaggtggccgaggccggccactacaccatgagggccttccatgaagatgctgaggtgcagctgtccttccagctgcagatcaacgtgcctgtgcgggtgctggagctgtctgagagccacccagattctggagagcagacagtgcgctgccggggccggggcatgccccagcccaacatcatctggagcgcctgccgggacctgaagcgctgcccccgggagctgccccccaccctgctgggcaacagcagcgaggaggagagccagctggagaccaacgtgacctactgggaggaggagcaggagtttgaggtggtgtccaccctgcggctgcagcacgtggaccggcccctgtctgtgcgctgcaccctgagaaatgctgtgggccaggacacccaggaggtgattgtggtgccccacagcctgcccttcaaggtggtggtgatcagcgccatcctggccctggtggtgctgaccatcatcagcctcatcatcctgatcatgctgtggcagaagaagcccaggtatgagatccgctggaaggtgattgaatctgtgtccagtgatggccacgagtacatctacgtggaccccatgcagctgccctatgacagcacctgggagctgccccgggaccagctggtgctgggccgcaccctgggcagcggggccttcggccaggtggtggaggccacagcccacggcctgagccacagccaggccaccatgaaggtggccgtgaagatgctgaagagcacagcccggagcagcgagaagcaggccctgatgtctgagctgaagatcatgagccacctgggcccccacctgaatgtggtgaacctgctgggcgcctgcaccaagggcggccccatctacatcatcacagagtactgccgctacggggacctggtggactacctgcacaggaacaagcacaccttcctgcagcaccacagcgacaagaggcggccccccagcgctgagctgtacagcaatgccctgcctgtgggcctgcccctgcccagccacgtgtccctgactggagagagtgatggcggctacatggacatgagcaaggatgagagcgtggactatgtgcccatgctggacatgaagggagatgtgaagtatgctgacatcgagagcagcaactacatggccccctatgacaactacgtgcccagcgcccctgagaggacctgccgggccaccctcatcaatgaaagccctgtgctgagctacatggacctggtgggcttctcctaccaggtggccaacggcatggagttcctggccagcaagaactgtgtgcaccgggacctggccgccagaaatgtgctgatctgtgagggcaagctggtgaagatctgtgactttggcctggcccgggacatcatgagggacagcaactacatcagcaagggcagcaccttcctgcccctgaagtggatggcccctgagagcatcttcaacagcctgtacaccaccctgagtgatgtgtggagctttggcatcctgctgtgggagatcttcaccctgggcggcaccccctacccagagctgcccatgaatgagcagttctacaatgccatcaagaggggctacaggatggcccagcctgcccacgccagtgatgagatctatgagatcatgcagaagtgctgggaggagaagtttgagatccggccccccttcagccagctggtgctgctgctggagcggctgctgggggagggctacaagaagaagtaccagcaggtggatgaggagttcctgcggagtgaccacccagccatcctgcggagccaggcccggctgcccggcttccacggcctgcggagccccctggacaccagctctgtgctgtacacagctgtgcagcccaatgaaggagacaatgactacatcatccccctgcctgaccccaagccagaggtggctgatgagggccccctggagggcagccccagcctggccagcagcaccctgaatgaggtgaacaccagcagcaccatcagctgtgacagccccctggagccccaggatgagcctgagcctgagccccagctggagctgcaggtggagcctgagcctgagctggagcagctgcctgacagcggctgcccagcccccagggctgaggccgaggacagcttcctgtag

SEQ ID NO: 21186 - DNA, 891 bp, Artificial Sequence
  Description of Artificial Sequence: Synthetic coding sequence
atgggcctgagccacagcaagacccacctgcgggtcatcaaggtggcccccctgcagaacaaggaggtggagaccccatctgctggccgggtggactttgccttcaaccagaacctggaggagaagaccagctacagcctggcccggctgcaggaccagaacaaggccctggagggccagctgccccccctgcaggagaactggtacggccgctacagcacagccagccgggacatgtactttgacatccccctggagcaccgggagaccagcatcatcaagaggcaccccccccagaggctgcagaagctggagcccatcgacctgcccagggtcatcaccagcggccgcctgctgagccagcgggaggcccggaccatgcacaaggccaagcaggtgctggagaagaagatgcagacccccatgtacaccagcgagaaccggcagtacctgcacaagatgcaggtgctggagatgatcaggaagaggcaggaggcccagatggagctgaagaagagcctgcatggagaggcccgcatcaacaagcagagcccccgggaccacaaggccaagaagaccctgcagagcaccccaagaaatgatgaccatgacctgctgaccatgctgcctgatgagatcctgaacagaggccctggcaacagcaagaacacagagttcctgaagcaccaggccgtgaacaactactgcccctggaagattggcaagatggagacctggctgcacgagcaggaggcccagggccagctgctgtgggacagcagcagcagtgacagtgatgagcagggcaaggatgagaagaagccccgggccctggtgaggaccaggacagagcgcatccccctgtttgatgagttctttgaccaggagtag

SEQ ID NO: 21187 - DNA, 1734 bp, Artificial Sequence
  Description of Artificial Sequence: Synthetic coding sequence
atgcctgagggcgcccagggcctgagcctgagcaagcccagccccagcctgggctgcggcagaagaggagaggtgtgtgactgtggcaccgtgtgtgagaccaggacagccccagctgcccccaccatggccagcccccggggcagcggcagcagcaccagcctgagcacagtgggcagcgagggggaccctgcccctggccccaccccagcctgcagcgccagcaggcctgagcccctgcccggcccccccatccggctgcacctgagccctgtgggcatccctggcagcgcccggcccagccggctggagcgggtggcccgggagatcgtggagacagagcgggcctacgtgcgggacctgcggagcatcgtggaggactacctgggccccctgctggatggcggcgtgctgggcctgtctgtggagcaggtgggcaccctgtttgccaacatcgaggacatctatgagttcagcagcgagctgctggaggacctggagaacagcagcagcgctgggggcattgctgaatgttttgtgcagaggtctgaggactttgacatctacaccctgtactgcatgaactaccccagcagcctggccctgctgcgggagctgagcctgagccccccagctgccctgtggctgcaggagcggcaggcccagctgcggcacagcctgcccctgcagagcttcctgctgaagcctgtgcagaggatcctgaagtaccacctgctgctgcaggagctgggcaagcactgggccgagggccctggcaccggcggccgggagatggtggaggaggccatcgtgtccatgacagctgtggcctggtacatcaatgacatgaagaggaagcaggagcacgccgcccggctgcaggaggtgcagaggcggctgggcggctggacaggccctgagctgagcgcctttggagagctggtgctggagggcgccttccggggcggcggcggcggcggcccccggctgcggggcggggagcggctgctcttcctgttcagcaggatgctgctggtggccaagagaagaggcctggagtacacctacaagggccacatcttctgctgcaacctgtctgtgtctgagagcccccgggaccccctgggcttcaaggtgtctgacctgaccatccccaagcaccgccacctgctgcaggccaagaaccaggaggagaagaggctgtggatccactgcctgcagaggctcttctttgagaaccacccagccagcatcccagccaaggccaagcaggtgctgctggagaacagcctgcactgtgcccccaagagcaagcctgtgctggagcccctgaccccacccctgggcagcccccggcccagagatgcccggagcttcaccccaggaagaagaaacacagcccccagccctggccccagcgtcatccggcggggccggcggcagagcgagcctgtgaaggacccctacgtgatgttcccccagaatgccaagccaggcttcaagcatgctggcagcgagggggagctgtacccacctgagagccagccccctgtgtctggcagcgcccccccagaggacctggaggatgctggcccccccaccctggaccccagcggcaccagcatcacagaggagatcctggagctgctgaaccagaggggcctgcgggaccccggggagagcatgggcctgcaccgggcccagggcgccccagatgcccccttccacatgtag

SEQ ID NO: 21188 - DNA, 4161 bp, Artificial Sequence
  Description of Artificial Sequence: Synthetic coding sequence
atgcctgagggcgcccagggcctgagcctgagcaagcccagccccagcctgggctgcggcagaagaggagaggtgtgtgactgtggcaccgtgtgtgagaccaggacagccccagctgcccccaccatggccagcccccggggcagcggcagcagcaccagcctgagcacagtgggcagcgagggggaccctgcccctggccccaccccagcctgcagcgccagcaggcctgagcccctgcccggcccccccatccggctgcacctgagccctgtgggcatccctggcagcgcccggcccagccggctggagcgggtggcccgggagatcgtggagacagagcgggcctacgtgcgggacctgcggagcatcgtggaggactacctgggccccctgctggatggcggcgtgctgggcctgtctgtggagcaggtgggcaccctgtttgccaacatcgaggacatctatgagttcagcagcgagctgctggaggacctggagaacagcagcagcgctgggggcattgctgaatgttttgtgcagaggtctgaggactttgacatctacaccctgtactgcatgaactaccccagcagcctggccctgctgcgggagctgagcctgagccccccagctgccctgtggctgcaggagcggcaggcccagctgcggcacagcctgcccctgcagagcttcctgctgaagcctgtgcagaggatcctgaagtaccacctgctgctgcaggagctgggcaagcactgggccgagggccctggcaccggcggccgggagatggtggaggaggccatcgtgtccatgacagctgtggcctggtacatcaatgacatgaagaggaagcaggagcacgccgcccggctgcaggaggtgcagaggcggctgggcggctggacaggccctgagctgagcgcctttggagagctggtgctggagggcgccttccggggcggcggcggcggcggcccccggctgcggggcggggagcggctgctcttcctgttcagcaggatgctgctggtggccaagagaagaggcctggagtacacctacaagggccacatcttctgctgcaacctgtctgtgtctgagagcccccgggaccccctgggcttcaaggtgtctgacctgaccatccccaagcaccgccacctgctgcaggccaagaaccaggaggagaagaggctgtggatccactgcctgcagaggctcttctttgagaaccacccagccagcatcccagccaaggccaagcaggtgctgctggagaacagcctgcactgtgcccccaagagcaagcctgtgctggagcccctgaccccacccctgggcagcccccggcccagagatgcccggagcttcaccccaggaagaagaaacacagcccccagccctggccccagcgtcatccggcggggccggcggcagagcgagcctgtgaaggacccctacgtgatgttcccccagaatgccaagccaggcttcaagcatgctggcagcgagggggagctgtacccacctgagagccagccccctgtgtctggcagcgcccccccagaggacctggaggatgctggcccccccaccctggaccccagcggcaccagcatcacagaggagatcctggagctgctgaaccagaggggcctgcgggaccccggccccagcacccatgacatccccaagtttcctggggacagccaggtgcctggggacagcgagaccctgaccttccaggccctgcccagccgggacagcagcgaggaggaggaggaggaggaggagggcctggagatggatgagcggggccccagccccctgcacgtgctggagggcctggagagcagcattgctgctgagatgcccagcatcccctgcctgaccaagatcccagatgtgcccaacctgcctgagatccccagccgctgtgagatccctgagggcagccggctgcccagcctgagtgacatcagtgatgtgtttgagatgccctgcctgcctgccatccccagcgtgcccaacacccccagcctgagcagcacccccaccctgagctgtgacagctggctgcagggccccctgcaggagcctgctgaggccccagccacccggcgggagctgttcagcggcagcaaccctgggaagctgggggagccccccagcggcggcaaggccggccctgaggaggatgaggagggcgtgtccttcacagacttccagccccaggatgtgacccagcaccagggcttcccagatgagctggccttccgcagctgcagcgagatccgcagcgcctggcaggccctggagcagggccagctggcccggcccggcttccctgagcccctgctgatcctggaggacagcgacctgggcggggacagcggcagcggcaaggccggggcccccagcagcgagaggacagccagccgggtgcgggagctggcccggctgtacagcgagcgcatccagcagatgcagagagctgagacccgggccagcgccaatgcccccaggagaagaccccgggtgctggcccagccccagcccagcccctgcctgccccaggagcaggccgagcccggcctgctgcctgccttcggccacgtgctggtgtgtgagctggccttccccctgacctgtgcccaggagagcgtgcccctgggccctgctgtgtgggtgcaggccgccatccccctgagcaagcagggcggcagcccagatggccagggcctgcacgtgagcaacctgcccaagcaggacctgcccggcatccacgtgtctgctgccaccctgctgcctgagcagggcggcagccgccacgtgcaggccccagctgccacccccctgcccaagcaggagggccccctgcacctgcaggtgcctgccctgaccaccttcagtgaccagggccaccctgagatccaggtgcctgccaccacccccctgcctgagcacaggagccacatggtgatcccagcccccagcacagccttctgcccagagcagggccactgtgccgacatccacgtgcccaccaccccagccctgcccaaggagatctgcagcgacttcaccgtgtctgtgaccacccctgtgcccaagcaggagggccacctggacagcgagagccccaccaacatccccctgaccaagcagggcggcagcagagatgtgcagggccctgaccctgtgtgcagccagcccatccagcccctgtcctggcacggcagcagcctggacccccagggccctggggacaccctgccccccctgccctgccacctgcctgacctgcagatccctggcaccagccccctgcctgcccacggcagccacctggaccaccgcatcccagccaatgcccccctgagcctgagccaggagctgcctgacacccaggtgcctgccaccacccccctgcccctgccccaggtgctgacagacatctgggtgcaggccctgcccaccagccccaagcagggcagcctgcctgacatccagggccctgctgctgccccacccctgcctgagcccagcctgacagacacccaggtgcagaagctgacccccagcctggagcagaagagcctgattgatgcccacgtgcctgctgccacccccctgcctgagcggggcggcagcctggacatccagggcctgagccccacccctgtgcagaccaccatggtgctgagcaagccaggcggcagcctggccagccacgtggcccggctggagagcagtgacctgaccccaccccacagccccccacccagcagccggcagctgctgggccccaatgctgctgccctgagccgctacctggccgccagctacatcagccagagcctggcccggcggcagggccctgggggcggggccccagctgccagccggggctcctggagcagcgcccccaccagccgggccagcagccccccaccccagccccagcccccacctcctccagcccggcggctgtcctatgccaccaccgtgaacatccacgtgggcggcggcggccgcctgcggcctgccaaggcccaggtgcggctgaaccacccagccctgctggccagcacccaggagagcatgggcctgcaccgggcccagggcgccccagatgcccccttccacatgtag

SEQ ID NO: 21189 - DNA, 1734 bp, Artificial Sequence; identical to SEQ ID NO: 21187
  Description of Artificial Sequence: Synthetic coding sequence

SEQ ID NO: 21190 - DNA, 4074 bp, Artificial Sequence
  Description of Artificial Sequence: Synthetic coding sequence
atgcctgagggcgcccagggcctgagcctgagcaagcccagccccagcctgggctgcggcagaagaggagaggtgtgtgactgtggcaccgtgtgtgagaccaggacagccccagctgcccccaccatggccagcccccggggcagcggcagcagcaccagcctgagcacagtgggcagcgagggggaccctgcccctggccccaccccagcctgcagcgccagcaggcctgagcccctgcccggcccccccatccggctgcacctgagccctgtgggcatccctggcagcgcccggcccagccggctggagcgggtggcccgggagatcgtggagacagagcgggcctacgtgcgggacctgcggagcatcgtggaggactacctgggccccctgctggatggcggcgtgctgggcctgtctgtggagcaggtgggcaccctgtttgccaacatcgaggacatctatgagttcagcagcgagctgctggaggacctggagaacagcagcagcgctgggggcattgctgaatgttttgtgcagaggtctgaggactttgacatctacaccctgtactgcatgaactaccccagcagcctggccctgctgcgggagctgagcctgagccccccagctgccctgtggctgcaggagcggcaggcccagctgcggcacagcctgcccctgcagagcttcctgctgaagcctgtgcagaggatcctgaagtaccacctgctgctgcaggagctgggcaagcactgggccgagggccctggcaccggcggccgggagatggtggaggaggccatcgtgtccatgacagctgtggcctggtacatcaatgacatgaagaggaagcaggagcacgccgcccggctgcaggaggtgcagaggcggctgggcggctggacaggccctgagctgagcgcctttggagagctggtgctggagggcgccttccggggcggcggcggcggcggcccccggctgcggggcggggagcggctgctcttcctgttcagcaggatgctgctggtggccaagagaagaggcctggagtacacctacaagggccacatcttctgctgcaacctgtctgtgtctgagagcccccgggaccccctgggcttcaaggtgtctgacctgaccatccccaagcaccgccacctgctgcaggccaagaaccaggaggagaagaggctgtggatccactgcctgcagaggctcttctttgagaaccacccagccagcatcccagccaaggccaagcaggtgctgctggagaacagcctgcactgtgcccccaagagcaagcctgtgctggagcccctgaccccacccctgggcagcccccggcccagagatgcccggagcttcaccccaggaagaagaaacacagccaagccaggcttcaagcacgccggcagcgagggggagctgtacccacctgagagccagccccctgtgtctggcagcgcccctcctgaggacctggaggatgctggcccccccaccctggaccccagcggcaccagcatcacagaggagatcctggagctgctgaaccagaggggcctgcgggaccccggccccagcacccatgacatccccaagtttcctggggacagccaggtgcctggggacagcgagaccctgaccttccaggccctgcccagccgggacagcagcgaggaggaggaggaggaggaggagggcctggagatggatgagcggggccccagccccctgcacgtgctggagggcctggagagcagcattgctgctgagatgcccagcatcccctgcctgaccaagatcccagatgtgcccaacctgcctgagatccccagccgctgtgagatccctgagggcagccggctgcccagcctgagtgacatcagtgatgtgtttgagatgccctgcctgcctgccatccccagcgtgcccaacacccccagcctgagcagcacccccaccctgagctgtgacagctggctgcagggccccctgcaggagcctgctgaggccccagccacccggcgggagctgttcagcggcagcaaccctgggaagctgggggagcccccatctgggggcaaggccggcccagaagaagatgaggagggcgtgtccttcacagacttccagccccaggatgtgacccagcaccagggcttcccagatgagctggccttccgcagctgcagcgagatccgcagcgcctggcaggccctggagcagggccagctggcccggcccggcttccctgagcccctgctgatcctggaggacagcgacctgggcggggacagcggcagcggcaaggccggggcccccagcagcgagaggacagccagccgggtgcgggagctggcccggctgtacagcgagcgcatccagcagatgcagagagctgagacccgggccagcgccaatgccccccggcggcggccccgggtgctggcccagccccagcccagcccctgcctgccccaggagcaggccgagcccggcctgctgcctgcctttggacatgtgctggtgtgtgagctggccttccccctgacctgtgcccaggagagcgtgcccctgggccctgctgtgtgggtgcaggccgccatccccctgagcaagcagggcggcagcccagatggccagggcctgcacgtgagcaacctgcccaagcaggacctgcccggcatccacgtgtctgctgccaccctgctgcctgagcagggcggcagcagacatgtgcaggccccagctgccacccccctgcccaagcaggagggccccctgcacctgcaggtgcctgccctgaccaccttcagtgaccagggccaccctgagatccaggtgcctgccaccacccccctgcctgagcacaggagccacatggtgatcccagcccccagcacagccttctgcccagagcagggccactgtgccgacatccacgtgcccaccaccccagccctgcccaaggagatctgcagcgacttcaccgtgtctgtgaccacccctgtgcccaagcaggagggccacctggacagcgagagccccaccaacatccccctgaccaagcagggcggcagcagagatgtgcagggccctgaccctgtgtgcagccagcccatccagcccctgtcctggcacggcagcagcctggacccccagggccctggggacaccctgccccccctgccctgccacctgcctgacctgcagatccctggcaccagccccctgcctgcccacggcagccacctggaccaccgcatcccagccaatgcccccctgagcctgagccaggagctgcctgacacccaggtgcctgccaccacccccctgcccctgccccaggtgctgacagacatctgggtgcaggccctgcccaccagccccaagcagggcagcctgcctgacatccagggccctgctgctgccccacccctgcctgagcccagcctgacagacacccaggtgcagaagctgacccccagcctggagcagaagagcctgattgatgcccacgtgcctgctgccacccccctgcctgagcggggcggcagcctggacatccagggcctgagccccacccctgtgcagaccaccatggtgctgagcaagccaggcggcagcctggccagccacgtggcccggctggagagcagtgacctgaccccaccccacagccccccacccagcagccggcagctgctgggccccaatgctgctgccctgagccgctacctggccgccagctacatcagccagagcctggcccggcggcagggccctgggggcggggccccagctgccagccggggctcctggagcagcgcccccaccagccgggccagcagccccccaccccagccccagcccccacctcctccagcccggcggctgtcctatgccaccaccgtgaacatccacgtgggcggcggcggccgcctgcggcctgccaaggcccaggtgcggctgaaccacccagccctgctggccagcacccaggagagcatgggcctgcaccgggcccagggcgccccagatgcccccttccacatgtag

SEQ ID NO: 21191 - DNA, 597 bp, Artificial Sequence
  Description of Artificial Sequence: Synthetic coding sequence
atgcctgagggcgcccagggcctgagcctgagcaagcccagccccagcctgggctgcggcagaagaggagaggtgtgtgactgtggcaccgtgtgtgagaccaggacagctgccccagctgcccccaccatggccagcccccggggcagcggcagcagcaccagcctgagcacagtgggcagcgagggggaccctgcccctggccccaccccagcctgcagcgccagcaggcctgagcccctgcccggcccccccatccggctgcacctgagccctgtgggcatccctggcagcgcccggcccagccggctggagcgggtggcccgggagatcgtggagacagagcgggcctacgtgcgggacctgcggagcatcgtggaggactacctgggccccctgctggatggaggagtgctgggcctgtctgtggagcaggtgggcaccctgtttgccaacatcgaggacatctatgagttcagcagcgagctgctggaggacctggagaacagcagcagcgctgggggcattgctgagtgctttgtgcagaggagtgaagattttgacatctacaccctgtactgcatgaactacccctag

SEQ ID NO: 21192 - DNA, 3714 bp, Artificial Sequence
  Description of Artificial Sequence: Synthetic coding sequence
atgcctgagggcgcccagggcctgagcctgagcaagcccagccccagcctgggctgcggcagaagaggagaggtgtgtgactgtggcaccgtgtgtgagaccaggacaggcagcgcccggcccagccggctggagcgggtggcccgggagatcgtggagacagagcgggcctacgtgcgggacctgcggagcatcgtggaggactacctgggccccctgctggatggaggagtgctgggcctgtctgtggagcaggtgggcaccctgtttgccaacatcgaggacatctatgagttcagcagcgagctgctggaggacctggagaacagcagcagcgctgggggcattgctgagtgctttgtgcagaggagtgaagattttgacatctacaccctgtactgcatgaactaccccagcagcctggccctgctgcgggagctgagcctgagccccccagctgccctgtggctgcaggagcggcaggcccagctgcggcacagcctgcccctgcagagcttcctgctgaagcctgtgcagaggatcctgaagtaccacctgctgctgcaggagctgggcaagcactgggccgagggccctggcactggaggccgggagatggtggaggaggccatcgtgtccatgacagctgtggcctggtacatcaatgacatgaagaggaagcaggagcacgccgcccggctgcaggaggtgcagaggcggctgggcggctggacaggccctgagctgagcgccttcggggagctggtgctggagggcgccttccggggcggcggcggcggcggcccccggctgcggggcggggagcggctgctcttcctgttcagcaggatgctgctggtggccaagaggcggggcctggagtacacctacaagggccacatcttctgctgcaacctgtctgtgtctgagagcccccgggaccccctgggcttcaaggtgtctgacctgaccatccccaagcaccgccacctgctgcaggccaagaaccaggaggagaagaggctgtggatccactgcctgcagaggctcttctttgagaaccacccagccagcatcccagccaaggccaagcaggtgctgctggagaacagcctgcactgtgcccccaagagcaagcctgtgctggagcccctgaccccacccctgggcagcccccggcccagagatgcccgctccttcaccccaggaagaagaaacacagcccccagccctggccccagcgtcatcagaagaggccggcggcagagcgagcctgtgaaggacccctacgtgatgttcccccagaatgccaagccaggcttcaagcacgccggcagcgagggggagctgtacccacctgagagccagccccctgtgtctggcagcgcccctcctgaggacctggaggatgctggcccccccaccctggaccccagcggcaccagcatcacagaggagatcctggagctgctgaaccagaggggcctgcgggaccccggccccagcacccatgacatccccaagtttcctggggacagccaggtgcctggggacagcgagaccctgaccttccaggccctgcccagccgggacagcagcgaggaggaggaggaggaggaggagggcctggagatggatgagcggggccccagccccctgcacgtgctggagggcctggagagcagcattgctgctgagatgcccagcatcccctgcctgaccaagatcccagatgtgcccaacctgcctgagatccccagccgctgtgagatccctgagggcagccggctgcccagcctgagtgacatcagtgatgtgtttgagatgccctgcctgcctgccatccccagcgtgcccaacacccccagcctgagcagcacccccaccctgagctgtgacagctggctgcagggccccctgcaggagcctgctgaggccccagccacccggcgggagctgttcagcggcagcaaccctgggaagctgggggagcccccatctgggggcaaggccggcccagaagaagatgaggagggcgtgtccttcacagacttccagccccaggatgtgacccagcaccagggcttcccagatgagctggccttccgcagctgcagcgagatccgcagcgcctggcaggccctggagcagggccagctggcccggcccggcttccctgagcccctgctgatcctggaggacagcgacctgggcggggacagcggcagcggcaaggccggggcccccagcagcgagaggacagccagccgggtgcgggagctggcccggctgtacagcgagcgcatccagcagatgcagagagctgagacccgggccagcgccaatgccccccggcggcggccccgggtgctggcccagccccagcccagcccctgcctgccccaggagcaggccgagcccggcctgctgcctgcctttggacatgtgctggtgtgtgagctggccttccccctgacctgtgcccaggagagcgtgcccctgggccctgctgtgtgggtgcaggccgccatccccctgagcaagcagggcggcagcccagatggccagggcctgcacgtgagcaacctgcccaagcaggacctgcccggcatccacgtgtctgctgccaccctgctgcctgagcagggcggcagcagacatgtgcaggccccagctgccacccccctgcccaagcaggagggccccctgcacctgcaggtgcctgccctgaccaccttcagtgaccagggccaccctgagatccaggtgcctgccaccacccccctgcctgagcacaggagccacatggtgatcccagcccccagcacagccttctgcccagagcagggccactgtgccgacatccacgtgcccaccaccccagccctgcccaaggagatctgcagcgacttcaccgtgtctgtgaccacccctgtgcccaagcaggagggccacctggacagcgagagccccaccaacatccccctgaccaagcagggcggcagcagagatgtgcagggccctgaccctgtgtgcagccagcccatccagcccctgtcctggcacggcagcagcctggacccccagggccctggggacaccctgccccccctgccctgccacctgcctgacctgcagatccctggcaccagccccctgcctgcccacggcagccacctggaccaccgcatcccagccaatgcccccctgagcctgagccaggagctgcctgacacccaggtgcctgccaccacccccctgcccctgccccaggtgctgacagacatctgggtgcaggccctgcccaccagccccaagcagggcagcctgcctgacatccagggccctgctgctgccccacccctgcctgagcccagcctgacagacacccaggtgcagaagctgacccccagcctggagcagaagagcctgattgatgcccacgtgcctgctgccacccccctgcctgagcggggcggcagcctggacatccagggcctgagccccacccctgtgcagaccaccatggtgctgagcaagccaggcggcagcctggccagccacgtggccaggaacctgtgggccttcaccggcccccggggcctgctgatgccacccagcacctgtgagcccggccacgaggccagcctgaagcagggcttccagccagatgccatcgacccccagaacctgacctggaagagccgccactag

SEQ ID NO: 21193 - DNA, 1128 bp, Artificial Sequence
  Description of Artificial Sequence: Synthetic coding sequence
atgatgaagaagaacaacagcgccaagaggggcccccaggacggcaaccagcagcctgcccctcctgagaaggtgggctgggtgaggaagttctgtgggaagggcatcttccgggagatctggaagaacagatatgtggtgctgaagggggaccagctgtacatcagcgagaaggaggtgaaggatgagaagaacatccaggaggtgtttgacctgagtgactatgaaaaatgtgaggagctgaggaagagcaagagccgcagcaagaagaaccacagcaagttcaccctggcccacagcaagcagcccggcaacacagcccccaacctgatcttcctggccgtgtccccagaggagaaggagagctggatcaatgccctgaacagcgccatcacccgggccaagaaccgcatcctggatgaggccagcaccagcaccagtgatggcatgctgaccctggacctgatccaggaggaggaccccagccctgaggagcccaccagctgtgccgagagcttccgggtggacctggacaagtctgtggcccagctggccggcagcagaagaagagctgacagcgaccgcatccagcccagcgctgaccgggccagcagcctgagccggccctgggagaagacagacaagggggccacctacaccccccaggcccccaagaagctgacccccacagagaagggccgctgtgccagcctggaggagatcctgagccagagagatgctgccagcgcccggaccctgcagctgcgggcagaggagccccccaccccagccctgcccaaccctggccagctgagccgcatccaggacctggtggccaggaagctggaggagacccaggagctgctggccgaggtgcagggcctgggagatggcaagaggaaggccaaggaccccccaagaagccccccagacagcgagagcgagcagctgctgctggagacagagcggctgctgggggaggccagcagcaactggagccaggccaagagggtgctgcaggaggtgcgggagctgcgggacctgtaccggcagatggacctgcagaccccagacagccacctgcggcagaccaccccccacagccagtacaggaagagcctgatgtag

SEQ ID NO: 21194 - DNA, 1230 bp, Artificial Sequence
  Description of Artificial Sequence: Synthetic coding sequence
atgatgaagaagaacaacagcgccaagaggggcccccaggacggcaaccagcagcctgcccctcctgagaaggtgggctgggtgaggaagttctgtgggaagggcatcttccgggagatctggaagaacagatatgtggtgctgaagggggaccagctgtacatcagcgagaaggaggtgaaggatgagaagaacatccaggaggtgtttgacctgagtgactatgaaaaatgtgaggagctgaggaagagcaagagccgcagcaagaagaaccacagcaagttcaccctggcccacagcaagcagcccggcaacacagcccccaacctgatcttcctggccgtgtccccagaggagaaggagagctggatcaatgccctgaacagcgccatcacccgggccaagaaccgcatcctggatgaggtgacagtggaggaggacagctacctggcccaccccacccgggaccgggccaagatccagcacagccggcggccccccacccggggccacctgatggctgtggccagcaccagcaccagtgatggcatgctgaccctggacctgatccaggaggaggaccccagccctgaggagcccaccagctgtgccgagagcttccgggtggacctggacaagtctgtggcccagctggccggcagcagaagaagagctgacagcgaccgcatccagcccagcgctgaccgggccagcagcctgagccggccctgggagaagacagacaagggggccacctacaccccccaggcccccaagaagctgacccccacagagaagggccgctgtgccagcctggaggagatcctgagccagagagatgctgccagcgcccggaccctgcagctgcgggcagaggagccccccaccccagccctgcccaaccctggccagctgagccgcatccaggacctggtggccaggaagctggaggagacccaggagctgctggccgaggtgcagggcctgggagatggcaagaggaaggccaaggaccccccaagaagccccccagacagcgagagcgagcagctgctgctggagacagagcggctgctgggggaggccagcagcaactggagccaggccaagagggtgctgcaggaggtgcgggagctgcgggacctgtaccggcagatggacctgcagaccccagacagccacctgcggcagaccaccccccacagccagtacaggaagagcctgatgtag

SEQ ID NO: 21195 - DNA, 681 bp, Artificial Sequence
  Description of Artificial Sequence: Synthetic coding sequence
atgctgaccctggacctgatccaggaggaggaccccagccctgaggagcccaccagctgtgccgagagcttccgggtggacctggacaagtctgtggcccagctggccggcagcagaagaagagctgacagcgaccgcatccagcccagcgctgaccgggccagcagcctgagccggccctgggagaagacagacaagggggccacctacaccccccaggcccccaagaagctgacccccacagagaagggccgctgtgccagcctggaggagatcctgagccagagagatgctgccagcgcccggaccctgcagctgcgggcagaggagccccccaccccagccctgcccaaccctggccagctgagccgcatccaggacctggtggccaggaagctggaggagacccaggagctgctggccgaggtgcagggcctgggagatggcaagaggaaggccaaggacccccccaggagccccccagattctgagagcgagcagctgctgctggagacagagcggctgctgggggaggccagcagcaactggagccaggccaagagggtgctgcaggaggtgcgggagctgcgggacctgtaccggcagatggacctgcagaccccagacagccacctgcggcagaccaccccccacagccagtacaggaagagcctgatgtag

SEQ ID NO: 21196 - DNA, 675 bp, Artificial Sequence
  Description of Artificial Sequence: Synthetic coding sequence
atgcccagcaccctgcccagccctgagcccaggacagtgtcctggatgagcaccagcctgcaggtgacagtggaggaggacagctacctggcccaccccacccgggaccgggccaagatccagcacagccggcggccccccacccggggccacctgatggctgtggccagcaccagcaccagtgatggcatgctgaccctggacctgatccaggaggaggaccccagccctgaggagcccaccagctgtgccgagagcttccgggtggacctggacaagtctgtggcccagctggccggcagcagaagaagagctgacagcgaccgcatccagcccagcgctgaccgggccagcagcctgagccggccctgggagaagacagacaagggggccacctacaccccccaggcccccaagaagctgacccccacagagaagggccgctgtgccagcctggaggagatcctgagccagagagatgctgccagcgcccggaccctgcagctgcgggcagaggagccccccaccccagccctgcccaaccctggccagctgagccgcatccaggacctggtggccaggaagctggaggagacccaggagctgctggccgaggtgcagggcctgggagatggcaagaggaaggccaaggaccccccaagaagccccccatag

SEQ ID NO: 21197 - DNA, 384 bp, Artificial Sequence
  Description of Artificial Sequence: Synthetic coding sequence
atgacagctgctgccacagccaccgtgctgaaggagggcgtgctggagaagaggtctgggggcctgctgcagctgtggaagaggaagagatgtgtgctgacagagcggggcctgcagctgtttgaggccaagggcaccggcggccggcccaaggagctgagctttgcccgcatcaaggctgtggagtgtgtggagagcacaggccgccacatctacttcaccctggtgacagaaggaggaggagaaattgacttccgctgccccctggaggaccccggctggaatgcccagatcaccctgggcctggtgaagttcaagaaccagcaggccatccagacagtgcgggcccggcagagcctgggcaccggcaccctggtgtcctag

SEQ ID NO: 21198 - DNA, 384 bp, Artificial Sequence; identical to SEQ ID NO: 21197
  Description of Artificial Sequence: Synthetic coding sequence

SEQ ID NO: 21199 - DNA, 1710 bp, Artificial Sequence
  Description of Artificial Sequence: Synthetic coding sequence
atgagctttggcatcctgaagccagacctgcgcatcgtgtttgtgcacaacaaggctgtgatctggcagaagagccgggtgtctgaccacaagatggccctgatgtctgtgctgggcacagctgtgatgaacaacatggagagcttccagtaccacagcgaggagagccagatctacctgagcggcttcctgcccaagtgtgatgctgaccacagcttcaccagcctgagcaccccagagaggagcttcatcttcatcaacagcaggcctgtgcaccagaaggacatcctgaagctgatccgccaccactacaacctgaagtgcctgaaggagagcacccggctgtaccctgtgttcttcctgaagattgatgtgcccacagcagatgtggatgtgaacctgaccccagacaagagccaggtgctgctgcagaacaaggagagcgtgctgattgccctggagaacctgatgaccacctgctacggccccctgcccagcaccaacagctatgagaacaacaagacagatgtgtctgctgctgacatcgtgctgagcaagacagctgagacagatgtgctcttcaacaaggtggagagcagcggcaagaactacagcaatgtggacaccagcgtcatccccttccagaatgacatgcacaatgatgaaagtggcaagaacacagatgactgcctgaaccaccagatcagcattggagactttggctacggccactgcagcagcgagatcagcaacatcgacaagaacaccaagaatgccttccaggacatctccatgagcaatgtgtcctgggagaacagccagacagagtacagcaagacctgcttcatcagctctgtgaagcacacccagagtgaaaatggaaacaaggaccacattgatgagagcggggagaatgaggaggaggccggcctggagaacagcagcgagatctctgcagatgagtggagccggggcaacatcctgaagaacagcgtgggggagaacatcgagcctgtgaagatcctggtgcctgagaagagcctgccctgcaaggtgagcaacaacaactaccccatccctgagcagatgaacctgaatgaagacagctgcaacaagaagagcaatgtgattgacaacaagagcggcaaggtgacagcctatgacctgctgagcaacagagtcatcaagaagcccatgtctgccagcgccctgtttgtgcaggaccaccggccccagttcctgattgagaaccccaagaccagcctggaggatgccaccctgcagatcgaggagctgtggaagaccctgtctgaggaggagaagctgaagtatgaggagaaggccaccaaggacctggagcgctacaacagccagatgaagagggccatcgagcaggagagccagatgagcctgaaggatggcaggaagaagatcaagcccaccagcgcctggaacctggcccagaagcacaagctgaagaccagcctgagcaaccagcccaagctggatgagctgctgcagagccagatcgagaagagaagaagccagaacatcaagatggtgcagatccccttctccatgaagaacctgaagatcaacttcaagaagcagaacaaggtggacctggaggagaaggatgagccctgcctgatccacaacctgcgcttcccagatgcctggctgatgaccagcaagacagagagcttctag

SEQ ID NO: 21200 - DNA, 2271 bp, Artificial Sequence
  Description of Artificial Sequence: Synthetic coding sequence
atgagctttggcatcctgaagccagacctgcgcatcgtgtttgtgcacaacaaggctgtgatctggcagaagagccgggtgtctgaccacaagatggccctgatgtctgtgctgggcacagctgtgatgaacaacatggagagcttccagtaccacagcgaggagagccagatctacctgagcggcttcctgcccaagtgtgatgctgaccacagcttcaccagcctgagcaccccagagaggagcttcatcttcatcaacagcaggcctgtgcaccagaaggacatcctgaagctgatccgccaccactacaacctgaagtgcctgaaggagagcacccggctgtaccctgtgttcttcctgaagattgatgtgcccacagcagatgtggatgtgaacctgaccccagacaagagccaggtgctgctgcagaacaaggagagcgtgctgattgccctggagaacctgatgaccacctgctacggccccctgcccagcaccaacagctatgagaacaacaagacagatgtgtctgctgctgacatcgtgctgagcaagacagctgagacagatgtgctcttcaacaaggtggagagcagcggcaagaactacagcaatgtggacaccagcgtcatccccttccagaatgacatgcacaatgatgaaagtggcaagaacacagatgactgcctgaaccaccagatcagcattggagactttggctacggccactgcagcagcgagatcagcaacatcgacaagaacaccaagaatgccttccaggacatctccatgagcaatgtgtcctgggagaacagccagacagagtacagcaagacctgcttcatcagctctgtgaagcacacccagagtgaaaatggaaacaaggaccacattgatgagagcggggagaatgaggaggaggccggcctggagaacagcagcgagatctctgcagatgagtggagccggggcaacatcctgaagaacagcgtgggggagaacatcgagcctgtgaagatcctggtgcctgagaagagcctgccctgcaaggtgagcaacaacaactaccccatccctgagcagatgaacctgaatgaagacagctgcaacaagaagagcaatgtgattgacaacaagagcggcaaggtgacagcctatgacctgctgagcaacagagtcatcaagaagcccatgtctgccagcgccctgtttgtgcaggaccaccggccccagttcctgattgagaaccccaagaccagcctggaggatgccaccctgcagatcgaggagctgtggaagaccctgtctgaggaggagaagctgaagtatgaggagaaggccaccaaggacctggagcgctacaacagccagatgaagagggccatcgagcaggagagccagatgagcctgaaggatggcaggaagaagatcaagcccaccagcgcctggaacctggcccagaagcacaagctgaagaccagcctgagcaaccagcccaagctggatgagctgctgcagagccagatcgagaagagaagaagccagaacatcaagatggtgcagatccccttctccatgaagaacctgaagatcaacttcaagaagcagaacaaggtggacctggaggagaaggatgagccctgcctgatccacaacctgcgcttcccagatgcctggctgatgaccagcaagacagaggtgatgctgctgaacccctacagagtggaggaggccctgctcttcaagaggctgctggagaaccacaagctgcctgctgagcccctggagaagcccatcatgctgacagagagcctcttcaacggcagccactacctggatgtgctgtacaagatgacagcagatgaccagcgctacagcggcagcacctacctgagtgacccccggctgacagccaacggcttcaagatcaagctgatccctggggtgtccatcacagagaactacctggagattgagggcatggccaactgcctgcccttctatggagtggccgacctgaaggagatcctgaatgccatcctgaacagaaatgccaaggaggtgtatgaatgtcggcccaggaaggtgatctcctacctggagggggaggccgtgcggctgagccggcagctgcccatgtacctgagcaaagaagacatccaggacatcatctacaggatgaagcaccagtttggaaatgagatcaaggaatgtgtgcacggccggcccttcttccaccacctgacctacctgcctgagaccacctag

SEQ ID NO: 21201 - DNA, 222 bp, Artificial Sequence
  Description of Artificial Sequence: Synthetic coding sequence
atgaagcagctgcctgctgccaccgtgcggctgctgagcagcagccagatcatcacctctgtggtgtctgtggtgaaggagctgattgagaacagcctggatgctggggccacctctgtggatgtgaagctggagaactacggctttgacaagattgaggtgcgggacaatggagagggcatcaaggctgtggatgcccctgtgatggccatgaagtactag

SEQ ID NO: 21202 - DNA, 585 bp, Artificial Sequence
  Description of Artificial Sequence: Synthetic coding sequence
atgaagcagctgcctgctgccaccgtgcggctgctgagcagcagccagatcatcacctctgtggtgtctgtggtgaaggagctgattgagaacagcctggatgctggggccacctctgtggatgtgaagctggagaactacggctttgacaagattgaggtgcgggacaatggagagggcatcaaggctgtggatgcccctgtgatggccatgaagtactacaccagcaagatcaacagccatgaggacctggagaacctgaccacctacggcttccggggggaggccctgggcagcatctgctgcatcgccgaggtgctgatcaccaccaggacagctgctgacaacttcagcacccagtatgtgctggatggcagcggccacatcctgagccagaagcccagccacctgggccagggcaccaccgtgacagccctgcggctcttcaagaacctgcctgtgaggaagcagttctacagcacagccaagaagtgcaaggatgagatcaagaagatccaggacctgctgatgagctttggcatcctgaagccagacctgcgcatcgtgtttgtgcacaacaagtag

SEQ ID NO: 21203 - DNA, 2271 bp, Artificial Sequence; identical to SEQ ID NO: 21200
  Description of Artificial Sequence: Synthetic coding sequence

SEQ ID NO: 21204 - DNA, 2799 bp, Artificial Sequence
  Description of Artificial Sequence: Synthetic coding sequence
atgaagcagctgcctgctgccaccgtgcggctgctgagcagcagccagatcatcacctctgtggtgtctgtggtgaaggagctgattgagaacagcctggatgctggggccacctctgtggatgtgaagctggagaactacggctttgacaagattgaggtgcgggacaatggagagggcatcaaggctgtggatgcccctgtgatggccatgaagtactacaccagcaagatcaacagccatgaggacctggagaacctgaccacctacggcttccggggggaggccctgggcagcatctgctgcatcgccgaggtgctgatcaccaccaggacagctgctgacaacttcagcacccagtatgtgctggatggcagcggccacatcctgagccagaagcccagccacctgggccagggcaccaccgtgacagccctgcggctcttcaagaacctgcctgtgaggaagcagttctacagcacagccaagaagtgcaaggatgagatcaagaagatccaggacctgctgatgagctttggcatcctgaagccagacctgcgcatcgtgtttgtgcacaacaaggctgtgatctggcagaagagccgggtgtctgaccacaagatggccctgatgtctgtgctgggcacagctgtgatgaacaacatggagagcttccagtaccacagcgaggagagccagatctacctgagcggcttcctgcccaagtgtgatgctgaccacagcttcaccagcctgagcaccccagagaggagcttcatcttcatcaacagcaggcctgtgcaccagaaggacatcctgaagctgatccgccaccactacaacctgaagtgcctgaaggagagcacccggctgtaccctgtgttcttcctgaagattgatgtgcccacagcagatgtggatgtgaacctgaccccagacaagagccaggtgctgctgcagaacaaggagagcgtgctgattgccctggagaacctgatgaccacctgctacggccccctgcccagcaccaacagctatgagaacaacaagacagatgtgtctgctgctgacatcgtgctgagcaagacagctgagacagatgtgctcttcaacaaggtggagagcagcggcaagaactacagcaatgtggacaccagcgtcatccccttccagaatgacatgcacaatgatgaaagtggcaagaacacagatgactgcctgaaccaccagatcagcattggagactttggctacggccactgcagcagcgagatcagcaacatcgacaagaacaccaagaatgccttccaggacatctccatgagcaatgtgtcctgggagaacagccagacagagtacagcaagacctgcttcatcagctctgtgaagcacacccagagtgaaaatggaaacaaggaccacattgatgagagcggggagaatgaggaggaggccggcctggagaacagcagcgagatctctgcagatgagtggagccggggcaacatcctgaagaacagcgtgggggagaacatcgagcctgtgaagatcctggtgcctgagaagagcctgccctgcaaggtgagcaacaacaactaccccatccctgagcagatgaacctgaatgaagacagctgcaacaagaagagcaatgtgattgacaacaagagcggcaaggtgacagcctatgacctgctgagcaacagagtcatcaagaagcccatgtctgccagcgccctgtttgtgcaggaccaccggccccagttcctgattgagaaccccaagaccagcctggaggatgccaccctgcagatcgaggagctgtggaagaccctgtctgaggaggagaagctgaagtatgaggagaaggccaccaaggacctggagcgctacaacagccagatgaagagggccatcgagcaggagagccagatgagcctgaaggatggcaggaagaagatcaagcccaccagcgcctggaacctggcccagaagcacaagctgaagaccagcctgagcaaccagcccaagctggatgagctgctgcagagccagatcgagaagagaagaagccagaacatcaagatggtgcagatccccttctccatgaagaacctgaagatcaacttcaagaagcagaacaaggtggacctggaggagaaggatgagccctgcctgatccacaacctgcgcttcccagatgcctggctgatgaccagcaagacagaggtgatgctgctgaacccctacagagtggaggaggccctgctcttcaagaggctgctggagaaccacaagctgcctgctgagcccctggagaagcccatcatgctgacagagagcctcttcaacggcagccactacctggatgtgctgtacaagatgacagcagatgaccagcgctacagcggcagcacctacctgagtgacccccggctgacagccaacggcttcaagatcaagctgatccctggggtgtccatcacagagaactacctggagattgagggcatggccaactgcctgcccttctatggagtggccgacctgaaggagatcctgaatgccatcctgaacagaaatgccaaggaggtgtatgaatgtcggcccaggaaggtgatctcctacctggagggggaggccgtgcggctgagccggcagctgcccatgtacctgagcaaagaagacatccaggacatcatctacaggatgaagcaccagtttggaaatgagatcaaggaatgtgtgcacggccggcccttcttccaccacctgacctacctgcctgagaccacctag

SEQ ID NO: 21205 - DNA, 135 bp, Artificial Sequence
  Description of Artificial Sequence: Synthetic coding sequence
atgaagcagctgcctgctgccaccgtgcggctgctgagcagcagccagatcatcacctctgtggtgtctgtggtgaaggagctgattgagaacagcctggatgctggggccacctctgtggatgtgaagctgtag

SEQ ID NO: 21206 - DNA, 2313 bp, Artificial Sequence
  Description of Artificial Sequence: Synthetic coding sequence
atgaagcagctgcctgctgccaccgtgcggctgctgagcagcagccagatcatcacctctgtggtgtctgtggtgaaggagctgattgagaacagcctggatgctggggccacctctgtggatgtgaagctggagaactacggctttgacaagattgaggtgcgggacaatggagagggcatcaaggctgtggatgcccctgtgatggccatgaagtactacaccagcaagatcaacagccatgaggacctggagaacctgaccacctacggcttccggggggaggccctgggcagcatctgctgcatcgccgaggtgctgatcaccaccaggacagctgctgacaacttcagcacccagtatgtgctggatggcagcggccacatcctgagccagaagcccagccacctgggccagggcaccaccgtgacagccctgcggctcttcaagaacctgcctgtgaggaagcagttctacagcacagccaagaagtgcaaggatgagatcaagaagatccaggacctgctgatgagctttggcatcctgaagccagacctgcgcatcgtgtttgtgcacaacaaggctgtgatctggcagaagagccgggtgtctgaccacaagatggccctgatgtctgtgctgggcacagctgtgatgaacaacatggagagcttccagtaccacagcgaggagagccagatctacctgagcggcttcctgcccaagtgtgatgctgaccacagcttcaccagcctgagcaccccagagaggagcttcatcttcatcaacagcaggcctgtgcaccagaaggacatcctgaagctgatccgccaccactacaacctgaagtgcctgaaggagagcacccggctgtaccctgtgttcttcctgaagattgatgtgcccacagcagatgtggatgtgaacctgaccccagacaagagccaggtgctgctgcagaacaaggagagcgtgctgattgccctggagaacctgatgaccacctgctacggccccctgcccagcaccaacagctatgagaacaacaagacagatgtgtctgctgctgacatcgtgctgagcaagacagctgagacagatgtgctcttcaacaaggtggagagcagcggcaagaactacagcaatgtggacaccagcgtcatccccttccagaatgacatgcacaatgatgaaagtggcaagaacacagatgactgcctgaaccaccagatcagcattggagactttggctacggccactgcagcagcgagatcagcaacatcgacaagaacaccaagaatgccttccaggacatctccatgagcaatgtgtcctgggagaacagccagacagagtacagcaagacctgcttcatcagctctgtgaagcacacccagagtgaaaatggaaacaaggaccacattgatgagagcggggagaatgaggaggaggccggcctggagaacagcagcgagatctctgcagatgagtggagccggggcaacatcctgaagaacagcgtgggggagaacatcgagcctgtgaagatcctggtgcctgagaagagcctgccctgcaaggtgagcaacaacaactaccccatccctgagcagatgaacctgaatgaagacagctgcaacaagaagagcaatgtgattgacaacaagagcggcaaggtgacagcctatgacctgctgagcaacagagtcatcaagaagcccatgtctgccagcgccctgtttgtgcaggaccaccggccccagttcctgattgagaaccccaagaccagcctggaggatgccaccctgcagatcgaggagctgtggaagaccctgtctgaggaggagaagctgaacctcttcaacggcagccactacctggatgtgctgtacaagatgacagcagatgaccagcgctacagcggcagcacctacctgagtgacccccggctgacagccaacggcttcaagatcaagctgatccctggggtgtccatcacagagaactacctggagattgagggcatggccaactgcctgcccttctatggagtggccgacctgaaggagatcctgaatgccatcctgaacagaaatgccaaggaggtgtatgaatgtcggcccaggaaggtgatctcctacctggagggggaggccgtgcggctgagccggcagctgcccatgtacctgagcaaagaagacatccaggacatcatctacaggatgaagcaccagtttggaaatgagatcaaggaatgtgtgcacggccggcccttcttccaccacctgacctacctgcctgagaccacctag

SEQ ID NO: 21207 - DNA, 2682 bp, Artificial Sequence
  Description of Artificial Sequence: Synthetic coding sequence
atgaagcagctgcctgctgccaccgtgcggctgctgagcagcagccagatcatcacctctgtggtgtctgtggtgaaggagctgattgagaacagcctggatgctggggccacctctgtggatgtgaagctggagaactacggctttgacaagattgaggtgcgggacaatggagagggcatcaaggctgtggatgcccctgtgatggccatgaagtactacaccagcaagatcaacagccatgaggacctggagaacctgaccacctacggcttccggggggaggccctgggcagcatctgctgcatcgccgaggtgctgatcaccaccaggacagctgctgacaacttcagcacccagtatgtgctggatggcagcggccacatcctgagccagaagcccagccacctgggccagggcaccaccgtgacagccctgcggctcttcaagaacctgcctgtgaggaagcagttctacagcacagccaagaagtgcaaggatgagatcaagaagatccaggacctgctgatgagctttggcatcctgaagccagacctgcgcatcgtgtttgtgcacaacaagatctacctgagcggcttcctgcccaagtgtgatgctgaccacagcttcaccagcctgagcaccccagagaggagcttcatcttcatcaacagcaggcctgtgcaccagaaggacatcctgaagctgatccgccaccactacaacctgaagtgcctgaaggagagcacccggctgtaccctgtgttcttcctgaagattgatgtgcccacagcagatgtggatgtgaacctgaccccagacaagagccaggtgctgctgcagaacaaggagagcgtgctgattgccctggagaacctgatgaccacctgctacggccccctgcccagcaccaacagctatgagaacaacaagacagatgtgtctgctgctgacatcgtgctgagcaagacagctgagacagatgtgctcttcaacaaggtggagagcagcggcaagaactacagcaatgtggacaccagcgtcatccccttccagaatgacatgcacaatgatgagagcggcaagaacacagatgactgcctgaaccaccagatcagcatcggggactttggctacggccactgcagcagcgagatcagcaacatcgacaagaacaccaagaatgccttccaggacatctccatgagcaatgtgtcctgggagaacagccagacagagtacagcaagacctgcttcatcagctctgtgaagcacacccagagtgaaaatggaaacaaggaccacattgatgaaagtggagaaaatgaggaggaggccggcctggagaacagcagcgagatctctgcagatgagtggagccggggcaacatcctgaagaacagcgtgggagaaaatattgagcctgtgaagatcctggtgcctgagaagagcctgccctgcaaggtgagcaacaacaactaccccatccctgagcagatgaacctgaatgaagacagctgcaacaagaagagcaatgtcatcgacaacaagagcggcaaggtgacagcctatgacctgctgagcaacagagtcatcaagaagcccatgtctgccagcgccctgtttgtgcaggaccaccggccccagttcctgattgagaaccccaagaccagcctggaggatgccaccctgcagatcgaggagctgtggaagaccctgtctgaggaggagaagctgaagtatgaggagaaggccaccaaggacctggagcgctacaacagccagatgaagagggccatcgagcaggagagccagatgagcctgaaggatggcaggaagaagatcaagcccaccagcgcctggaacctggcccagaagcacaagctgaagaccagcctgagcaaccagcccaagctggatgagctgctgcagagccagatcgagaagaggaggagccagaacatcaagatggtgcagatccccttctccatgaagaacctgaagatcaacttcaagaagcagaacaaggtggacctggaggagaaggatgagccctgcctgatccacaacctgcgcttcccagatgcctggctgatgaccagcaagacagaggtgatgctgctgaacccctacagagtggaggaggccctgctcttcaagaggctgctggagaaccacaagctgcctgctgagcccctggagaagcccatcatgctgacagagagcctcttcaacggcagccactacctggatgtgctgtacaagatgacagcagatgaccagcgctacagcggcagcacctacctgagtgacccccggctgacagccaacggcttcaagatcaagctgatccctggggtgtccatcacagagaactacctggagattgagggcatggccaactgcctgcccttctacggcgtggccgacctgaaggagatcctgaatgccatcctgaacagaaatgccaaggaggtgtatgagtgccggcccaggaaggtgatctcctacctggagggggaggccgtgcggctgagccggcagctgcccatgtacctgagcaaggaggacatccaggacatcatctacaggatgaagcaccagtttggaaatgagatcaaggaatgtgtgcacggccggcccttcttccaccacctgacctacctgcctgagaccacctag

SEQ ID NO: 21208 - DNA, 2589 bp, Artificial Sequence
  Description of Artificial Sequence: Synthetic coding sequence
atggagcgggcagagagcagcagcacagagcccgccaaggccatcaagcccatcgacaggaagtctgtgcaccagatctgcagcggccaggtggtgctgagcctgagcacagctgtgaaggagctggtggagaacagcctggatgctggggccaccaacatcgacctgaagctgaaggactatggagtggacctgattgaggtgtctgacaatggctgcggcgtggaggaggagaactttgagggcctgaccctgaagcaccacaccagcaagatccaggagtttgctgacctgacccaggtggagaccttcggcttccggggggaggccctgagcagcctgtgtgccctgagtgatgtgaccatcagcacctgccacgccagcgccaaggtgggcacccggctgatgtttgaccacaacgggaagatcatccagaagaccccctacccccggccccggggcaccaccgtgtctgtgcagcagctgttcagcaccctgcctgtgcgccacaaggagttccagaggaacatcaagaaggagtatgccaagatggtgcaggtgctgcacgcctactgcatcatctctgctggcatccgggtgtcctgcaccaaccagctgggccagggcaagaggcagcctgtggtgtgcacaggaggcagccccagcatcaaggaaaatattggctctgtgtttggccagaagcagctgcagagcctcatcccctttgtgcagctgccccccagcgacagcgtgtgtgaggagtatggcctgagctgcagtgatgccctgcacaacctcttctacatcagcggcttcatcagccagtgcacccacggcgtgggccgcagcagcacagaccggcagttcttcttcatcaacagaagaccctgtgaccctgccaaggtgtgccgcctggtgaatgaggtgtaccacatgtacaacagacaccagtacccctttgtggtgctgaacatctctgtggacagtgaatgtgtggacatcaacgtgaccccagacaagaggcagatcctgctgcaggaggagaagctgctgctggccgtgctgaagaccagcctcatcggcatgtttgacagtgatgtgaacaagctgaatgtgtcccagcagcccctgctggatgtggagggcaacctgatcaagatgcatgctgctgacctggagaagcccatggtggagaagcaggaccagagccccagcctgaggactggagaggagaagaaggatgtgtccatcagccggctgcgggaggccttcagcctgcggcacaccacagagaacaagccccacagccccaagaccccagagcccaggaggagccccctgggccagaagaggggcatgctgagcagcagcaccagcggggccatcagtgacaagggcgtgctgcggccccagaaggaggccgtgagcagcagccacggccccagcgaccccacagacagagctgaggtggagaaggacagcggccacggcagcacctctgtggacagcgagggcttcagcatcccagacaccggcagccactgcagcagtgaatatgctgccagcagccctggggaccggggcagccaggagcacgtggacagccaggagaaggcccccaagacagatgacagcttcagtgatgtggactgccacagcaaccaggaggacaccggctgcaagttccgggtgctgccccagcccaccaacctggccacccccaacaccaagcgcttcaagaaggaggagatcctgagcagcagtgacatctgccagaagctggtgaacacccaggacatgtctgccagccaggtggatgtggccgtgaagatcaacaagaaggtggtgcccctggacttctccatgagcagcctggccaagaggatcaagcagctgcaccacgaggcccagcagagcgagggggagcagaactacaggaagttccgggccaagatctgccctggagagaaccaggccgcagaagatgagctgaggaaggagatcagcaagaccatgtttgctgagatggagatcatcggccagttcaacctgggcttcatcatcaccaagctgaatgaagacatcttcatcgtggaccagcacgccacagatgagaagtacaactttgagatgctgcagcagcacacagtgctgcagggccagaggctcatcgccccccagaccctgaacctgacagctgtgaatgaagctgtgctgattgagaacctggagatcttcaggaagaatggatttgattttgtgattgatgaaaatgcccctgtgacagagcgggccaagctgatcagcctgcccaccagcaagaactggaccttcggcccccaggatgtggatgagctgatcttcatgctgagtgacagccctggggtgatgtgccggcccagccgggtgaagcagatgtttgccagccgggcctgcaggaagtctgtgatgattggaacagccctgaacaccagcgagatgaagaagctgatcacccacatgggagagatggaccacccctggaactgcccccacggccggcccaccatgaggcacatcgccaacctgggcgtcatcagccagaactag

SEQ ID NO: 21209 - DNA, 1386 bp, Artificial Sequence
  Description of Artificial Sequence: Synthetic coding sequence
atggagcgggcagagagcagcagcacagagcccgccaaggccatcaagcccatcgacaggaagtctgtgcaccagatctgcagcggccaggtggtgctgagcctgagcacagctgtgaaggagctggtggagaacagcctggatgctggggccaccaacatcgacctgaagctgaaggactatggagtggacctgattgaggtgtctgacaatggctgcggcgtggaggaggagaactttgagggcctgaccctgaagcaccacaccagcaagatccaggagtttgctgacctgacccaggtggagaccttcggcttccggggggaggccctgagcagcctgtgtgccctgagtgatgtgaccatcagcacctgccacgccagcgccaaggtgggcacccggctgatgtttgaccacaacgggaagatcatccagaagaccccctacccccggccccggggcaccaccgtgtctgtgcagcagctgttcagcaccctgcctgtgcgccacaaggagttccagaggaacatcaagaaggagtatgccaagatggtgcaggtgctgcacgcctactgcatcatctctgctggcatccgggtgtcctgcaccaaccagctgggccagggcaagaggcagcctgtggtgtgcacaggaggcagccccagcatcaaggaaaatattggctctgtgtttggccagaagcagctgcagagcctcatcccctttgtgcagctgccccccagcgacagcgtgtgtgaggagtatggcctgagctgcagtgatgccctgcacaacctcttctacaagaccatgtttgctgagatggagatcatcggccagttcaacctgggcttcatcatcaccaagctgaatgaagacatcttcatcgtggaccagcacgccacagatgagaagtacaactttgagatgctgcagcagcacacagtgctgcagggccagaggctgattgccccccagaccctgaacctgacagctgtgaatgaggccgtgctgattgagaacctggagatcttcaggaagaatggatttgattttgtgattgatgaaaatgcccctgtgacagagcgggccaagctgatcagcctgcccaccagcaagaactggaccttcggcccccaggatgtggatgagctgatcttcatgctgagtgacagccctggggtgatgtgccggcccagccgggtgaagcagatgtttgccagccgggcctgcaggaagtctgtgatgattggaacagccctgaacaccagcgagatgaagaagctgatcacccacatgggagagatggaccacccctggaactgcccccacggccggcccaccatgaggcacatcgccaacctgggcgtcatcagccagaactag

SEQ ID NO: 21210 - DNA, 2448 bp, Artificial Sequence
  Description of Artificial Sequence: Synthetic coding sequence
atggagcgggcagagagcagccgcagcaagctgaaggactatggagtggacctgattgaggtgtctgacaatggctgcggcgtggaggaggagaactttgagggcctgaccctgaagcaccacaccagcaagatccaggagtttgctgacctgacccaggtggagaccttcggcttccggggggaggccctgagcagcctgtgtgccctgagtgatgtgaccatcagcacctgccacgccagcgccaaggtgggcacccggctgatgtttgaccacaacgggaagatcatccagaagaccccctacccccggccccggggcaccaccgtgtctgtgcagcagctgttcagcaccctgcctgtgcgccacaaggagttccagaggaacatcaagaaggagtatgccaagatggtgcaggtgctgcacgcctactgcatcatctctgctggcatccgggtgtcctgcaccaaccagctgggccagggcaagaggcagcctgtggtgtgcaccggcggcagccccagcatcaaggagaacatcggctctgtgtttggccagaagcagctgcagagcctcatcccctttgtgcagctgcccccaagtgacagcgtgtgtgaggagtatggcctgagctgcagtgatgccctgcacaacctcttctacatcagcggcttcatcagccagtgcacccatggagtgggccgcagcagcacagaccggcagttcttcttcatcaacagaagaccctgtgaccctgccaaggtgtgccgcctggtgaatgaggtgtaccacatgtacaacagacaccagtacccctttgtggtgctgaacatctctgtggacagtgaatgtgtggacatcaacgtgaccccagacaagaggcagatcctgctgcaggaggagaagctgctgctggccgtgctgaagaccagcctgattggcatgtttgacagtgatgtgaacaagctgaatgtgtcccagcagcccctgctggatgtggagggcaacctgatcaagatgcacgccgctgacctggagaagcccatggtggagaagcaggaccagagccccagcctgaggactggagaggagaagaaggatgtgtccatcagccggctgcgggaggccttcagcctgcggcacaccacagagaacaagccccacagccccaagaccccagagccccggcgcagccccctgggccagaagaggggcatgctgagcagcagcaccagcggggccatcagtgacaagggcgtgctgcggccccagaaggaggccgtgagcagcagccacggccccagcgaccccacagacagagctgaggtggagaaggacagcggccacggcagcacctctgtggacagcgagggcttcagcatcccagacaccggcagccactgcagcagtgaatatgctgccagcagccctggggaccggggcagccaggagcacgtggacagccaggagaaggcccccaagacagatgacagcttcagtgatgtggactgccacagcaaccaggaggacaccggctgcaagttccgggtgctgccccagcccaccaacctggccacccccaacaccaagcgcttcaagaaggaggagatcctgagcagcagtgacatctgccagaagctggtgaacacccaggacatgtctgccagccaggtggatgtggccgtgaagatcaacaagaaggtggtgcccctggacttctccatgagcagcctggccaagaggatcaagcagctgcaccacgaggcccagcagagcgagggggagcagaactacaggaagttccgggccaagatctgccctggagagaaccaggccgcagaagatgagctgaggaaggagatcagcaagaccatgtttgctgagatggagatcatcggccagttcaacctgggcttcatcatcaccaagctgaatgaagacatcttcatcgtggaccagcacgccacagatgagaagtacaactttgagatgctgcagcagcacacagtgctgcagggccagaggctgattgccccccagaccctgaacctgacagctgtgaatgaggccgtgctgattgagaacctggagatcttcaggaagaatggatttgattttgtgattgatgaaaatgcccctgtgacagagcgggccaagctgatcagcctgcccaccagcaagaactggaccttcggcccccaggatgtggatgagctgatcttcatgctgagtgacagccctggggtgatgtgccggcccagccgggtgaagcagatgtttgccagccgggcctgcaggaagtctgtgatgattggaacagccctgaacaccagcgagatgaagaagctgatcacccacatgggagagatggaccacccctggaactgcccccacggccggcccaccatgaggcacatcgccaacctgggcgtcatcagccagaactag

SEQ ID NO: 21211 - DNA, 1719 bp, Artificial Sequence
  Description of Artificial Sequence: Synthetic coding sequence
atggagcgggcagagagcagcagcacagagcccgccaaggccatcaagcccatcgacaggaagtctgtgcaccagatctgcagcggccaggtggtgctgagcctgagcacagctgtgaaggagctggtggagaacagcctggatgctggggccaccaacatcgacctgaagctgaaggactatggagtggacctgattgaggtgtctgacaatggctgcggcgtggaggaggagaactttgagggcctgaccctgaagcaccacaccagcaagatccaggagtttgctgacctgacccaggtggagaccttcggcttccggggggaggccctgagcagcctgtgtgccctgagtgatgtgaccatcagcacctgccacgccagcgccaaggtgggcacccggctgatgtttgaccacaacgggaagatcatccagaagaccccctacccccggccccggggcaccaccgtgtctgtgcagcagctgttcagcaccctgcctgtgcgccacaaggagttccagaggaacatcaagaaggagtatgccaagatggtgcaggtgctgcacgcctactgcatcatctctgctggcatccgggtgtcctgcaccaaccagctgggccagggcaagaggcagcctgtggtgtgcacaggaggcagccccagcatcaaggaaaatattggctctgtgtttggccagaagcagctgcagagcctcatcccctttgtgcagctgccccccagcgacagcgtgtgtgaggagtatggcctgagctgcagtgatgccctgcacaacctcttctacatcagcggcttcatcagccagtgcacccacggcgtgggccgcagcagcacagaccggcagttcttcttcatcaacagaagaccctgtgaccctgccaaggtgtgccgcctggtgaatgaggtgtaccacatgtacaacagacaccagtacccctttgtggtgctgaacatctctgtggacagtgaatgtgtggacatcaacgtgaccccagacaagaggcagatcctgctgcaggaggagaagctgctgctggccgtgctgaagaccagcctcatcggcatgtttgacagtgatgtgaacaagctgaatgtgtcccagcagcccctgctggatgtggagggcaacctgatcaagatgcatgctgctgacctggagaagcccatggtggagaagcaggaccagagccccagcctgaggactggagaggagaagaaggatgtgtccatcagccggctgcgggaggccttcagcctgcggcacaccacagagaacaagccccacagccccaagaccccagagcccaggaggagccccctgggccagaagaggggcatgctgagcagcagcaccagcggggccatcagtgacaagggcgtgctgcggccccagaaggaggccgtgagcagcagccacggccccagcgaccccacagacagagctgaggtggagaaggacagcggccacggcagcacctctgtggacagcgagggcttcagcatcccagacaccggcagccactgcagcagtgaatatgctgccagcagccctggggaccggggcagccaggagcacgtggacagccaggagaaggcccccaagacagatgacagcttcagtgatgtggactgccacagcaaccaggaggacaccggcctgaagacaggccccagcgaccccaggacctccatgaactag

SEQ ID NO: 21212 - DNA, 2271 bp, Artificial Sequence
  Description of Artificial Sequence: Synthetic coding sequence
atgtggggcagaagaaggaagctgcggcggctgaatgatgtgaccatcagcacctgccacgccagcgccaaggtgggcacccggctgatgtttgaccacaacgggaagatcatccagaagaccccctacccccggccccggggcaccaccgtgtctgtgcagcagctgttcagcaccctgcctgtgcgccacaaggagttccagaggaacatcaagaaggagtatgccaagatggtgcaggtgctgcacgcctactgcatcatctctgctggcatccgggtgtcctgcaccaaccagctgggccagggcaagaggcagcctgtggtgtgcacaggaggcagccccagcatcaaggaaaatattggctctgtgtttggccagaagcagctgcagagcctcatcccctttgtgcagctgccccccagcgacagcgtgtgtgaggagtatggcctgagctgcagtgatgccctgcacaacctcttctacatcagcggcttcatcagccagtgcacccacggcgtgggccgcagcagcacagaccggcagttcttcttcatcaacagaagaccctgtgaccctgccaaggtgtgccgcctggtgaatgaggtgtaccacatgtacaacagacaccagtacccctttgtggtgctgaacatctctgtggacagtgaatgtgtggacatcaacgtgaccccagacaagaggcagatcctgctgcaggaggagaagctgctgctggccgtgctgaagaccagcctcatcggcatgtttgacagtgatgtgaacaagctgaatgtgtcccagcagcccctgctggatgtggagggcaacctgatcaagatgcatgctgctgacctggagaagcccatggtggagaagcaggaccagagccccagcctgaggactggagaggagaagaaggatgtgtccatcagccggctgcgggaggccttcagcctgcggcacaccacagagaacaagccccacagccccaagaccccagagcccaggaggagccccctgggccagaagaggggcatgctgagcagcagcaccagcggggccatcagtgacaagggcgtgctgcggccccagaaggaggccgtgagcagcagccacggccccagcgaccccacagacagagctgaggtggagaaggacagcggccacggcagcacctctgtggacagcgagggcttcagcatcccagacaccggcagccactgcagcagtgaatatgctgccagcagccctggggaccggggcagccaggagcacgtggacagccaggagaaggcccccaagacagatgacagcttcagtgatgtggactgccacagcaaccaggaggacaccggctgcaagttccgggtgctgccccagcccaccaacctggccacccccaacaccaagcgcttcaagaaggaggagatcctgagcagcagtgacatctgccagaagctggtgaacacccaggacatgtctgccagccaggtggatgtggccgtgaagatcaacaagaaggtggtgcccctggacttctccatgagcagcctggccaagaggatcaagcagctgcaccacgaggcccagcagagcgagggggagcagaactacaggaagttccgggccaagatctgccctggagagaaccaggccgcagaagatgagctgaggaaggagatcagcaagaccatgtttgctgagatggagatcatcggccagttcaacctgggcttcatcatcaccaagctgaatgaagacatcttcatcgtggaccagcacgccacagatgagaagtacaactttgagatgctgcagcagcacacagtgctgcagggccagaggctcatcgccccccagaccctgaacctgacagctgtgaatgaagctgtgctgattgagaacctggagatcttcaggaagaatggatttgattttgtgattgatgaaaatgcccctgtgacagagcgggccaagctgatcagcctgcccaccagcaagaactggaccttcggcccccaggatgtggatgagctgatcttcatgctgagtgacagccctggggtgatgtgccggcccagccgggtgaagcagatgtttgccagccgggcctgcaggaagtctgtgatgattggaacagccctgaacaccagcgagatgaagaagctgatcacccacatgggagagatggaccacccctggaactgcccccacggccggcccaccatgaggcacatcgccaacctgggcgtcatcagccagaactag

SEQ ID NO: 21213 - DNA, 1812 bp, Artificial Sequence
  Description of Artificial Sequence: Synthetic coding sequence
atgtctgctgctgtgacagctgggaagctggcccgggccccagctgaccccgggaaggccggcgtgcctggggtggccgcccctggggccccagctgctgcccccccagccaaggagatccctgaggtgctggtggaccccaggagcagaagaagatatgtgcggggccgcttcctgggcaaaggaggctttgccaagtgctttgagatcagtgatgctgacaccaaggaggtgtttgctgggaagatcgtgcccaagagcctgctgctgaagccccaccagcgggagaagatgtccatggagatcagcatccacaggagcctggcccaccagcacgtggtgggcttccacggcttctttgaagataatgactttgtgtttgtggtgctggagctgtgcagaagaagaagcctgctggagctgcacaagaggaggaaggccctgacagagcctgaggcccgctactacctgcggcagatcgtgctgggctgccagtacctgcacaggaacagagtcatccaccgggacctgaagctgggcaacctcttcctgaatgaagacctggaggtgaagatcggggactttggcctggccaccaaggtggagtatgatggagagaggaagaagaccctgtgtggcacccccaactacatcgcccctgaggtgctgagcaagaagggccacagctttgaggtggatgtgtggagcatcggctgcatcatgtacaccctgctggtgggcaagcccccatttgagaccagctgcctgaaggagacctacctgcgcatcaagaagaatgagtacagcatccccaagcacatcaaccctgtggccgccagcctcatccagaagatgctgcagacagaccccacagcccggcccaccatcaatgagctgctgaatgatgagttcttcaccagcggctacatcccagcccggctgcccatcacctgcctgaccatccccccacgcttcagcatcgcccccagcagcctggaccccagcaacaggaagcccctgactgtgctgaacaagggcctggagaaccccctgcctgagcggccccgggagaaggaggagcctgtggtgcgggagaccggggaggtggtggactgccacctgagtgacatgctgcagcagctgcacagcgtgaatgccagcaagcccagcgagcggggcctggtgcggcaggaggaggctgaagatcctgcctgcatccccatcttctgggtgtccaagtgggtggactacagcgacaagtatggcctgggctaccagctgtgtgacaacagcgtgggcgtgctcttcaatgacagcaccaggctcatcctgtacaatgatggagacagcctgcagtacatcgagagagatggaacagagagctacctgactgtgagcagccaccccaacagcctgatgaagaagatcaccctgctgaagtacttcaggaactacatgtctgagcacctgctgaaggccggggccaacatcaccccccgggagggagatgagctggcccggctgccctacctgcggacctggttccgcaccaggtctgccatcatcctgcacctgagcaatggatctgtgcagatcaacttcttccaggaccacaccaagctgatcctgtgccccctgatggctgctgtgacctacattgatgagaagagggacttccgcacctaccgcctgagcctgctggaggagtatggctgctgcaaggagctggccagccggctgcgctatgcccggaccatggtggacaagctgctgagcagccgcagcgccagcaaccggctgaaggccagctag

SEQ ID NO: 21214 - DNA, 744 bp, Artificial Sequence
  Description of Artificial Sequence: Synthetic coding sequence
atgtctgctgctgtgacagctgggaagctggcccgggccccagctgaccccgggaaggccggcgtgcctggggtggccgcccctggggccccagctgctgcccccccagccaaggagatccctgaggtgctggtggaccccaggagcagaagaagatatgtgcggggccgcttcctgggcaaaggaggctttgccaagtgctttgagatcagtgatgctgacaccaaggaggtgtttgctgggaagatcgtgcccaagagcctgctgctgaagccccaccagcgggagaagatgtccatggagatcagcatccacaggagcctggcccaccagcacgtggtgggcttccacggcttctttgaagataatgactttgtgtttgtggtgctggagctgtgcagaagaagaagcctgctggagctgcacaagaggaggaaggccctgacagagcctgaggcccgctactacctgcggcagatcgtgctgggctgccagtacctgcacaggaacagagtcatccaccgggacctgaagctgggcaacctcttcctgaatgaagacctggaggtgaagatcggggactttggcctggccaccaaggtggagtatgatggagagaggaagaagaccctgtgtggcacccccaactacatcgccccagctgtgccctgcctgcagtgtgccccccagccccgctggctgggccgggccgccagcagcctgcaggtgggcgtggccgtgtag

SEQ ID NO: 21215 - DNA, 1521 bp, Artificial Sequence
  Description of Artificial Sequence: Synthetic coding sequence
atgtccatggagatcagcatccacaggagcctggcccaccagcacgtggtgggcttccacggcttctttgaggacaatgactttgtgtttgtggtgctggagctgtgcagaagaagaagcctgctggagctgcacaagaggaggaaggccctgacagagcctgaggcccgctactacctgcggcagatcgtgctgggctgccagtacctgcacaggaacagagtcatccaccgggacctgaagctgggcaacctcttcctgaatgaagacctggaggtgaagattggagactttggcctggccaccaaggtggagtatgatggagagaggaagaagaccctgtgtggcacccccaactacatcgcccctgaggtgctgagcaagaagggccacagctttgaggtggatgtgtggagcatcggctgcatcatgtacaccctgctggtgggcaagcccccatttgagaccagctgcctgaaggagacctacctgcgcatcaagaagaatgagtacagcatccccaagcacatcaaccctgtggccgccagcctcatccagaagatgctgcagacagaccccacagcccggcccaccatcaatgagctgctgaatgatgagttcttcaccagcggctacatcccagcccggctgcccatcacctgcctgaccatccccccacgcttcagcatcgcccccagcagcctggaccccagcaacaggaagcccctgactgtgctgaacaagggcctggagaaccccctgcctgagcggccccgggagaaggaggagcctgtggtgcgggagactggagaggtggtggactgccacctgagtgacatgctgcagcagctgcacagcgtgaatgccagcaagcccagcgagcggggcctggtgcggcaggaggaggccgaggaccctgcctgcatccccatcttctgggtgtccaagtgggtggactacagcgacaagtatggcctgggctaccagctgtgtgacaacagcgtgggcgtgctcttcaatgacagcaccaggctcatcctgtacaatgatggagacagcctgcagtacatcgagagagatggaacagagagctacctgactgtgagcagccaccccaacagcctgatgaagaagatcaccctgctgaagtacttcaggaactacatgtctgagcacctgctgaaggccggggccaacatcaccccccgggagggagatgagctggcccggctgccctacctgcggacctggttccgcaccaggtctgccatcatcctgcacctgagcaatggatctgtgcagatcaacttcttccaggaccacaccaagctgatcctgtgccccctgatggctgctgtgacctacattgatgagaagagggacttccgcacctaccgcctgagcctgctggaggagtatggctgctgcaaggagctggccagccggctgcgctatgcccggaccatggtggacaagctgctgagcagccgcagcgccagcaaccggctgaaggccagctag

SEQ ID NO: 21216 - DNA, 1941 bp, Artificial Sequence
  Description of Artificial Sequence: Synthetic coding sequence
atggagcctgctgctggcttcctgagcccccggcccttccagagagctgctgctgccccagcccccccagctggccctggccccccaccttctgccctgcggggccctgagctggagatgctggccggcctgcccaccagtgaccccggccgcctcatcacagaccccaggagcggccgcacctacctgaagggccgcctgctgggcaagggcggctttgcccgctgctatgaggccacagacacagagaccggcagcgcctatgctgtgaaggtgatcccccagagccgggtggccaagccccaccagcgggagaagatcctgaatgaaattgagctgcaccgggacctgcagcaccgccacatcgtgcgcttcagccaccactttgaagatgctgacaacatctacatcttcctggagctgtgcagcaggaagagcctggcccacatctggaaggcccggcacaccctgctggagcctgaggtgcgctactacctgcggcagatcctgagcggcctgaagtacctgcaccagaggggcatcctgcaccgggacctgaagctgggcaacttcttcatcacagagaacatggagctgaaggtgggggactttggcctggccgcccggctggagcccccagagcagaggaagaagaccatctgtggcacccccaactacgtggcccctgaggtgctgctgcggcagggccacggccctgaggctgatgtgtggagcctgggctgtgtgatgtacaccctgctgtgtggcagccccccatttgaaacagctgacctgaaggagacctaccgctgcatcaagcaggtgcactacaccctgcctgccagcctgagcctgcctgcccggcagctgctggccgccatcctgcgggccagcccccgggaccggcccagcattgaccagatcctgcggcatgacttcttcaccaagggctacaccccagaccggctgcccatcagcagctgtgtgacagtgcctgacctgaccccacccaacccagcccggagcctgtttgccaaggtgaccaagagcctgtttggaaggaagaagaagagcaagaaccacgcccaggagagagatgaggtgtctggcctggtgtctggcctgatgaggacctctgtgggccaccaggatgcccggcctgaggccccagctgccagcggccctgcccctgtgtccctggtggagacagcccctgaggacagcagcccccggggcaccctggccagcagtggagatggctttgaggagggcctgactgtggccaccgtggtggagagcgccctgtgtgccctgaggaactgcatcgccttcatgcccccagctgagcagaacccagcccccctggcccagcctgagcccctggtgtgggtgtccaagtgggtggactacagcaacaagtttggcttcggctaccagctgagcagcagaagagtggccgtgctcttcaatgatggcacccacatggccctgagcgccaacaggaagacagtgcactacaaccccaccagcaccaagcacttctccttctctgtgggcgctgtgccccgggccctgcagccccagctgggcatcctgcgctactttgccagctacatggagcagcacctgatgaagggcggggacctgcccagcgtggaggaggtggaggtgcctgccccacccctgctgctgcagtgggtgaagacagaccaggccctgctgatgctgttcagtgatggcaccgtgcaggtgaacttctatggagaccacaccaagctgatcctgagcggctgggagcccctgctggtgacctttgtggccaggaacagaagtgcctgcacctacctggccagccacctgcggcagctgggctgcagcccagacctgcggcagaggctgcgctatgccctgcggctgctgcgggacaggagccctgcctag

SEQ ID NO: 21217 - DNA, 1866 bp, Artificial Sequence
  Description of Artificial Sequence: Synthetic coding sequence
agccggcagagacatgcccggcccggccctgggggcacagagaagccaggcccccgctgtgatgccccagctgcctggagcctgccccctgtgtcctgcctgcggacctacctgaagggccgcctgctgggcaaaggaggctttgcccgctgctatgaggccacagacacagaaacaggcagcgcctatgctgtgaaggtgatcccccagagccgggtggccaagccccaccagcgggagaagatcctgaatgaaattgagctgcaccgggacctgcagcaccgccacatcgtgcgcttcagccaccactttgaagatgctgacaacatctacatcttcctggagctgtgcagcaggaagagcctggcccacatctggaaggcccggcacaccctgctggagcctgaggtgcgctactacctgcggcagatcctgagcggcctgaagtacctgcaccagaggggcatcctgcaccgggacctgaagctgggcaacttcttcatcacagagaacatggagctgaaggtgggggactttggcctggccgcccggctggagcccccagagcagaggaagaagaccatctgtggcacccccaactacgtggcccctgaggtgctgctgcggcagggccacggccctgaggctgatgtgtggagcctgggctgtgtgatgtacaccctgctgtgtggcagccccccatttgaaacagctgacctgaaggagacctaccgctgcatcaagcaggtgcactacaccctgcctgccagcctgagcctgcctgcccggcagctgctggccgccatcctgcgggccagcccccgggaccggcccagcattgaccagatcctgcggcatgacttcttcaccaagggctacaccccagaccggctgcccatcagcagctgtgtgacagtgcctgacctgaccccacccaacccagcccggagcctgtttgccaaggtgaccaagagcctgtttggaaggaagaagaagagcaagaaccacgcccaggagagagatgaggtgtctggcctggtgtctggcctgatgaggacctctgtgggccaccaggatgcccggcctgaggccccagctgccagcggccctgcccctgtgtccctggtggagacagcccctgaggacagcagcccccggggcaccctggccagcagtggagatggctttgaggagggcctgactgtggccaccgtggtggagagcgccctgtgtgccctgaggaactgcatcgccttcatgcctcctgctgagcagaacccagcccccctggcccagcctgagcccctggtgtgggtgtccaagtgggtggactacagcaacaagtttggatttggctaccagctgagcagccggcgggtggccgtgctcttcaatgatggcacccacatggccctgagcgccaacaggaagacagtgcactacaaccccaccagcaccaagcacttctccttctctgtgggcgctgtgccccgggccctgcagccccagctgggcatcctgcgctactttgccagctacatggagcagcacctgatgaagggcggggacctgcccagcgtggaggaggtggaggtgcctgccccacccctgctgctgcagtgggtgaagacagaccaggccctgctgatgctgttcagtgatggcaccgtgcaggtgaacttctacggggaccacaccaagctgatcctgagcggctgggagcccctgctggtgacctttgtggccaggaacagaagtgcctgcacctacctggccagccacctgcggcagctgggctgcagcccagacctgcggcagaggctgcgctatgccctgcggctgctgcgggacaggagccctgcctag

SEQ ID NO: 21218 - DNA, 2913 bp, Artificial Sequence
  Description of Artificial Sequence: Synthetic coding sequence
atggccacctgcattggagagaagattgaggacttcaaggtgggcaacctgctgggcaagggcagctttgctggggtgtacagagctgagagcatccacacaggcctggaggtggccatcaagatgattgacaagaaggccatgtacaaggccggcatggtgcagagggtgcagaatgaggtgaagatccactgccagctgaagcaccccagcatcctggagctgtacaactactttgaggacagcaactacgtgtacctggtgctggagatgtgccacaacggggagatgaaccgctacctgaagaacagagtgaagcccttctctgaaaatgaggcccggcacttcatgcaccagatcatcaccggcatgctgtacctgcacagccacggcatcctgcaccgggacctgaccctgagcaacctgctgctgaccaggaacatgaacatcaagattgctgactttggcctggccacccagctgaagatgcctcatgagaagcactacaccctgtgtggcacccccaactacatcagccctgagatcgccaccaggtctgcccacggcctggagagtgatgtgtggagcctgggctgcatgttctacaccctgctgattggccggcccccatttgacacagacacagtgaagaacaccctgaacaaggtggtgctggccgactatgagatgcccagcttcctgagcattgaggccaaggacctgatccaccagctgctgcggaggaacccagctgaccggctgagcctgagctctgtgctggaccaccccttcatgagcaggaacagcagcaccaagagcaaggacctgggcaccgtggaggacagcattgattctggccacgccaccatcagcacagccatcacagccagcagcagcaccagcatcagcggcagcctgtttgacaagaggcggctgctgattggccagcccctgcccaacaagatgacagtgttccccaagaacaagagcagcacagacttcagcagcagtggagatggcaacagcttctacacccagtggggcaaccaggagaccagcaacagcggccggggccgggtcatccaggatgctgaggagcggccccacagccgctacctgcggcgggcctacagcagtgacaggagcggcaccagcaacagccagagccaggccaagacctacaccatggagcgctgccacagcgctgagatgctgtctgtgtccaagaggtctggaggaggagaaaatgaggagcgctacagccccacagacaacaatgccaacatcttcaacttcttcaaggagaagaccagcagcagcagcggcagctttgagaggccagacaacaaccaggccctgagcaaccacctgtgccctgggaagacccccttcccctttgctgaccccaccccccagacagaaacagtgcagcagtggtttggaaacctgcagatcaatgcccacctgaggaagaccacagaatatgacagcatcagccccaacagagacttccagggccacccagacctgcagaaggacaccagcaagaatgcctggacagacaccaaggtgaagaagaacagtgatgccagtgacaatgcccacagcgtgaagcagcagaacaccatgaagtacatgacagccctgcacagcaagccagagatcatccagcaggagtgtgtgtttggaagtgaccccctgtctgagcagagcaagacccggggcatggagcccccctggggctaccagaacagaaccctgcggagcatcaccagccccctggtggcccaccggctgaagcccatccggcagaagaccaagaaggctgtggtgtccatcctggacagcgaggaggtgtgtgtggagctggtgaaggagtatgccagccaggagtatgtgaaggaggtgctgcagatcagcagtgatggcaacaccatcaccatctactaccccaacggcggccggggcttccccctggccgacaggcctcccagccccacagacaacatcagccgctacagctttgacaacctgcctgagaagtactggaggaagtaccagtatgccagcagatttgtgcagctggtgcgcagcaagagccccaagatcacctacttcaccaggtatgccaagtgcatcctgatggagaacagccctggagctgactttgaggtgtggttctatgatggagtgaagatccacaagacagaggacttcatccaggtgattgagaagacaggcaagagctacaccctgaagtctgagagcgaggtgaacagcctgaaggaggagatcaagatgtacatggaccacgccaatgaaggccaccgcatctgcctggccctggagagcatcatcagcgaggaggagaggaagaccaggtctgcccccttcttccccatcatcattggaaggaagccaggcagcaccagcagccccaaggccctgagccccccaccttctgtggacagcaactaccccacccgggagcgggccagcttcaacaggatggtgatgcacagcgctgccagccccacccaggcccccatcctgaaccccagcatggtgaccaatgaaggcctgggcctgaccaccacagccagcggcacagacatcagcagcaacagcctgaaggactgcctgcccaagagcgcccagctgctgaagtctgtgtttgtgaagaatgtgggctgggccacccagctgaccagcggggctgtgtgggtgcagttcaatgatggcagccagctggtggtgcaggccggcgtgagcagcatctcctacaccagccccaacggccagaccacccgctacggggagaatgagaagctgcctgactacatcaagcagaagctgcagtgcctgagcagcatcctgctgatgttcagcaaccccacccccaacttccactag

SEQ ID NO: 21219 - DNA, 2817 bp, Artificial Sequence
  Description of Artificial Sequence: Synthetic coding sequence
atggccacctgcattggagagaagattgaggacttcaaggtgggcaacctgctgggcaagggcagctttgctggggtgtacagagctgagagcatccacacaggcctggaggtggccatcaagatgctgtacaactactttgaggacagcaactacgtgtacctggtgctggagatgtgccacaacggggagatgaaccgctacctgaagaacagagtgaagcccttctctgaaaatgaggcccggcacttcatgcaccagatcatcaccggcatgctgtacctgcacagccacggcatcctgcaccgggacctgaccctgagcaacctgctgctgaccaggaacatgaacatcaagattgctgactttggcctggccacccagctgaagatgcctcatgagaagcactacaccctgtgtggcacccccaactacatcagccctgagatcgccaccaggtctgcccacggcctggagagtgatgtgtggagcctgggctgcatgttctacaccctgctgattggccggcccccatttgacacagacacagtgaagaacaccctgaacaaggtggtgctggccgactatgagatgcccagcttcctgagcattgaggccaaggacctgatccaccagctgctgcggaggaacccagctgaccggctgagcctgagctctgtgctggaccaccccttcatgagcaggaacagcagcaccaagagcaaggacctgggcaccgtggaggacagcattgattctggccacgccaccatcagcacagccatcacagccagcagcagcaccagcatcagcggcagcctgtttgacaagaggcggctgctgattggccagcccctgcccaacaagatgacagtgttccccaagaacaagagcagcacagacttcagcagcagtggagatggcaacagcttctacacccagtggggcaaccaggagaccagcaacagcggccggggccgggtcatccaggatgctgaggagcggccccacagccgctacctgcggcgggcctacagcagtgacaggagcggcaccagcaacagccagagccaggccaagacctacaccatggagcgctgccacagcgctgagatgctgtctgtgtccaagaggtctggaggaggagaaaatgaggagcgctacagccccacagacaacaatgccaacatcttcaacttcttcaaggagaagaccagcagcagcagcggcagctttgagaggccagacaacaaccaggccctgagcaaccacctgtgccctgggaagacccccttcccctttgctgaccccaccccccagacagaaacagtgcagcagtggtttggaaacctgcagatcaatgcccacctgaggaagaccacagaatatgacagcatcagccccaacagagacttccagggccacccagacctgcagaaggacaccagcaagaatgcctggacagacaccaaggtgaagaagaacagtgatgccagtgacaatgcccacagcgtgaagcagcagaacaccatgaagtacatgacagccctgcacagcaagccagagatcatccagcaggagtgtgtgtttggaagtgaccccctgtctgagcagagcaagacccggggcatggagcccccctggggctaccagaacagaaccctgcggagcatcaccagccccctggtggcccaccggctgaagcccatccggcagaagaccaagaaggctgtggtgtccatcctggacagcgaggaggtgtgtgtggagctggtgaaggagtatgccagccaggagtatgtgaaggaggtgctgcagatcagcagtgatggcaacaccatcaccatctactaccccaacggcggccggggcttccccctggccgacaggcctcccagccccacagacaacatcagccgctacagctttgacaacctgcctgagaagtactggaggaagtaccagtatgccagcagatttgtgcagctggtgcgcagcaagagccccaagatcacctacttcaccaggtatgccaagtgcatcctgatggagaacagccctggagctgactttgaggtgtggttctatgatggagtgaagatccacaagacagaggacttcatccaggtgattgagaagacaggcaagagctacaccctgaagtctgagagcgaggtgaacagcctgaaggaggagatcaagatgtacatggaccacgccaatgaaggccaccgcatctgcctggccctggagagcatcatcagcgaggaggagaggaagaccaggtctgcccccttcttccccatcatcattggaaggaagccaggcagcaccagcagccccaaggccctgagccccccaccttctgtggacagcaactaccccacccgggagcgggccagcttcaacaggatggtgatgcacagcgctgccagccccacccaggcccccatcctgaaccccagcatggtgaccaatgaaggcctgggcctgaccaccacagccagcggcacagacatcagcagcaacagcctgaaggactgcctgcccaagagcgcccagctgctgaagtctgtgtttgtgaagaatgtgggctgggccacccagctgaccagcggggctgtgtgggtgcagttcaatgatggcagccagctggtggtgcaggccggcgtgagcagcatctcctacaccagccccaacggccagaccacccgctacggggagaatgagaagctgcctgactacatcaagcagaagctgcagtgcctgagcagcatcctgctgatgttcagcaaccccacccccaacttccactag

SEQ ID NO: 21220 - DNA, 2790 bp, Artificial Sequence
  Description of Artificial Sequence: Synthetic coding sequence
atgattgacaagaaggccatgtacaaggccggcatggtgcagagggtgcagaatgaggtgaagatccactgccagctgaagcaccccagcatcctggagctgtacaactactttgaggacagcaactacgtgtacctggtgctggagatgtgccacaatggagagatgaaccgctacctgaagaacagagtgaagcccttctctgaaaatgaggcccggcacttcatgcaccagatcatcaccggcatgctgtacctgcacagccacggcatcctgcaccgggacctgaccctgagcaacctgctgctgaccaggaacatgaacatcaagattgctgactttggcctggccacccagctgaagatgcctcatgagaagcactacaccctgtgtggcacccccaactacatcagccctgagatcgccaccaggtctgcccacggcctggagagtgatgtgtggagcctgggctgcatgttctacaccctgctgattggccggcccccatttgacacagacacagtgaagaacaccctgaacaaggtggtgctggccgactatgagatgcccagcttcctgagcattgaggccaaggacctgatccaccagctgctgcggagaaatcctgctgaccggctgagcctgagctctgtgctggaccaccccttcatgagcaggaacagcagcaccaagagcaaggacctgggcaccgtggaggacagcattgacagcggccacgccaccatcagcacagccatcacagccagcagcagcaccagcatcagcggcagcctgtttgacaagaggcggctgctgattggccagcccctgcccaacaagatgaccgtcttccccaagaacaagagcagcacagacttcagcagcagtggagatggcaacagcttctacacccagtggggcaaccaggagaccagcaacagcggccggggccgggtcatccaggatgctgaggagcggccccacagccgctacctgcggcgggcctacagcagtgacagaagtggcaccagcaacagccagagccaggccaagacctacaccatggagcgctgccacagcgctgagatgctgtctgtgtccaagaggtctgggggcggggagaatgaggagcgctacagccccacagacaacaatgccaacatcttcaacttcttcaaggagaagaccagcagcagcagcggcagctttgagaggccagacaacaaccaggccctgagcaaccacctgtgccctgggaagacccccttcccctttgctgaccccaccccccagacagagaccgtgcagcagtggtttggaaacctgcagatcaatgcccacctgaggaagaccacagaatatgacagcatcagccccaacagagacttccagggccacccagacctgcagaaggacaccagcaagaatgcctggacagacaccaaggtgaagaagaacagtgatgccagtgacaatgcccacagcgtgaagcagcagaacaccatgaagtacatgacagccctgcacagcaagccagagatcatccagcaggagtgtgtgtttggaagtgaccccctgtctgagcagagcaagacccggggcatggagcccccctggggctaccagaacagaaccctgcggagcatcaccagccccctggtggcccaccggctgaagcccatccggcagaagaccaagaaggctgtggtgtccatcctggacagcgaggaggtgtgtgtggagctggtgaaggagtatgccagccaggagtatgtgaaggaggtgctgcagatcagcagtgatggcaacaccatcaccatctactacccaaatggaggccggggcttccccctggccgaccggccccccagccccacagacaacatcagccgctacagctttgacaacctgcctgagaagtactggaggaagtaccagtatgccagcagatttgtgcagctggtgcgcagcaagagccccaagatcacctacttcaccaggtatgccaagtgcatcctgatggagaacagccctggagctgactttgaggtgtggttctatgatggagtgaagatccacaagacagaggacttcatccaggtgattgagaagacaggcaagagctacaccctgaagtctgagagcgaggtgaacagcctgaaggaggagatcaagatgtacatggaccacgccaatgaaggccaccgcatctgcctggccctggagagcatcatcagcgaggaggagaggaagaccaggtctgcccccttcttccccatcatcatcggcaggaagccaggcagcaccagcagccccaaggccctgagccccccacccagcgtggacagcaactaccccacccgggagcgggccagcttcaacaggatggtgatgcacagcgctgccagccccacccaggcccccatcctgaaccccagcatggtgaccaatgaaggcctgggcctgaccaccacagccagcggcacagacatcagcagcaacagcctgaaggactgcctgcccaagagcgcccagctgctgaagtctgtgtttgtgaagaatgtgggctgggccacccagctgaccagcggggctgtgtgggtgcagttcaatgatggcagccagctggtggtgcaggccggcgtgagcagcatctcctacaccagccccaacggccagaccaccaggtatggagaaaatgagaagctgcctgactacatcaagcagaagctgcagtgcctgagcagcatcctgctgatgttcagcaaccccacccccaacttccactag

SEQ ID NO: 21221 - DNA, 1752 bp, Artificial Sequence
  Description of Artificial Sequence: Synthetic coding sequence
atggccgccaggagaagaagaagcactggaggcggccgggcccgggccctgaatgaaagcaagagggtgaacaatggaaacacagcccctgaggacagcagccctgccaagaagacccggcgctgccagaggcaggagagcaagaagatgcctgtggccggcggcaaggccaacaaggacagaacagaggacaagcaggacggcatgcctggccgctcctgggccagcaagagggtgtctgagagcgtgaaggccctgctgctgaagggcaaggcccctgtggaccctgaatgtacagccaaggtgggcaaggcccacgtgtactgtgagggcaatgatgtgtatgatgtgatgctgaaccagaccaacctgcagttcaacaacaacaagtactacctgatccagctgctggaggatgatgcccagaggaacttctctgtgtggatgcgctggggccgggtgggcaagatgggccagcacagcctggtggcctgcagcggcaacctgaacaaggccaaggagatcttccagaagaagttcctggacaagaccaagaacaactgggaggaccgggagaagtttgagaaggtgcctgggaagtatgacatgctgcagatggactatgccaccaacacccaggatgaggaggagaccaagaaggaggagagcctgaagagccccctgaagccagagagccagctggacctgcgggtgcaggagctgatcaagctgatctgcaatgtgcaggccatggaggagatgatgatggagatgaagtacaacaccaagaaggcccccctgggcaagctgactgtggcccagatcaaggccggctaccagagcctgaagaagattgaggactgcatccgggccggccagcacggccgggccctgatggaggcctgcaatgagttctacacccgcatcccccatgactttggcctgcggaccccacccctcatccgcacccagaaggagctgtctgagaagatccagctgctggaggccctgggggacatcgagatcgccatcaagctggtgaagacagagctgcagagccctgagcaccccctggaccagcactacagaaacctgcactgtgccctgcggcccctggaccacgagagctatgagttcaaggtgatcagccagtacctgcagagcacccacgcccccacccacagcgactacaccatgaccctgctggacctgtttgaggtggagaaggatggagagaaggaggccttccgggaggacctgcacaacaggatgctgctgtggcacggcagcaggatgagcaactgggtgggcatcctgagccacggcctgagaattgcccctcctgaggcccccatcaccggctacatgtttgggaagggcatctactttgctgacatgagcagcaagagcgccaactactgctttgccagccggctgaagaacacaggcctgctgctgctgtctgaggtggccctgggccagtgcaatgagctgctggaggccaaccccaaggccgagggcctgctgcagggcaagcacagcaccaagggcctgggcaagatggcccccagcagcgcccactttgtgaccctgaatggcagcacagtgcccctgggccctgccagtgacaccggcatcctgaacccagatggctacaccctgaactacaatgagtacatcgtgtacaaccccaaccaggtgaggatgagatacctgctgaaggtgcagttcaacttcctgcagctgtggtag

SEQ ID NO: 21222 - DNA, 1713 bp, Artificial Sequence
  Description of Artificial Sequence: Synthetic coding sequence
atggccgccaggagaagaagaagcactggaggcggccgggcccgggccctgaatgaaagcaagagggtgaacaatggaaacacagcccctgaggacagcagccctgccaagaagacccggcgctgccagaggcaggagagcaagaagatgcctgtggccggcggcaaggccaacaaggacagaacagaggacaagcaggatgaatctgtgaaggccctgctgctgaagggcaaggcccctgtggaccctgagtgcacagccaaggtgggcaaggcccacgtgtactgtgagggcaatgatgtgtatgatgtgatgctgaaccagaccaacctgcagttcaacaacaacaagtactacctgatccagctgctggaggatgatgcccagaggaacttctctgtgtggatgcgctggggccgggtgggcaagatgggccagcacagcctggtggcctgcagcggcaacctgaacaaggccaaggagatcttccagaagaagttcctggacaagaccaagaacaactgggaggaccgggagaagtttgagaaggtgcctgggaagtatgacatgctgcagatggactatgccaccaacacccaggatgaggaggagaccaagaaggaggagagcctgaagagccccctgaagccagagagccagctggacctgcgggtgcaggagctgatcaagctgatctgcaatgtgcaggccatggaggagatgatgatggagatgaagtacaacaccaagaaggcccccctgggcaagctgactgtggcccagatcaaggccggctaccagagcctgaagaagattgaggactgcatccgggccggccagcacggccgggccctgatggaggcctgcaatgagttctacacccgcatcccccatgactttggcctgcggaccccacccctcatccgcacccagaaggagctgtctgagaagatccagctgctggaggccctgggggacattgaaattgccatcaagctggtgaagacagagctgcagagccctgagcaccccctggaccagcactacagaaacctgcactgtgccctgcggcccctggaccacgagagctatgagttcaaggtgatcagccagtacctgcagagcacccacgcccccacccacagcgactacaccatgaccctgctggacctgtttgaggtggagaaggatggagagaaggaggccttccgggaggacctgcacaacaggatgctgctgtggcacggcagcaggatgagcaactgggtgggcatcctgagccacggcctgcgcatcgcccctcctgaggcccccatcaccggctacatgtttgggaagggcatctactttgctgacatgagcagcaagagcgccaactactgctttgccagccggctgaagaacacaggcctgctgctgctgtctgaggtggccctgggccagtgcaatgagctgctggaggccaaccccaaggccgagggcctgctgcagggcaagcacagcaccaagggcctgggcaagatggcccccagcagcgcccactttgtgaccctgaatggcagcacagtgcccctgggccctgccagtgacaccggcatcctgaacccagatggctacaccctgaactacaatgagtacatcgtgtacaaccccaaccaggtgaggatgagatacctgctgaaggtgcagttcaacttcctgcagctgtggtag

SEQ ID NO: 21223 - DNA, 1623 bp, Artificial Sequence
  Description of Artificial Sequence: Synthetic coding sequence
atgagcctgctcttcctggccatggcccccaagcccaagccctgggtgcagacagagggccctgagaagaagaagggccggcaggccggccgggaggaggaccccttccgcagcacagctgaggccctgaaggccatcccagctgagaagaggatcatccgggtggaccccacctgccccctgagcagcaaccctggcacccaggtgtatgaggactacaactgcaccctgaaccagaccaacatcgagaacaacaacaacaagttctacatcatccagctgctgcaggacagcaaccgcttcttcacctgctggaaccactggggccgggtgggggaggtgggccagagcaagatcaaccacttcacccggctggaggatgccaagaaggactttgagaagaagttccgggagaagaccaagaacaactgggccgagcgggaccactttgtgagccaccctgggaagtacaccctcatcgaggtgcaggctgaagatgaggcccaggaggccgtggtgaaggtggaccggggccctgtgaggacagtgaccaagagggtgcagccctgcagcctggaccctgccacccagaagctgatcaccaacatcttcagcaaggagatgttcaagaacaccatggccctgatggacctggatgtgaagaagatgcccctgggcaagctgagcaagcagcagatcgcccggggctttgaggccctggaggccctggaggaggccctgaagggccccacagatggcggccagagcctggaggagctgagcagccacttctacaccgtcatcccccacaactttggccacagccagcccccacccatcaacagccctgagctgctgcaggccaagaaggacatgctgctggtgctggccgacatcgagctggcccaggccctgcaggccgtgtctgagcaggagaagacagtggaggaggtgccccaccccctggaccgggactaccagctgctgaagtgccagctgcagctgctggacagcggggcccctgagtacaaggtgatccagacctacctggagcagacaggcagcaaccaccgctgccccaccctgcagcacatctggaaggtgaaccaggagggggaggaggaccgcttccaggcccacagcaagctgggcaacaggaagctgctgtggcacggcaccaacatggctgtggtggccgccatcctgaccagcggcctgcgcatcatgccccacagcggcggccgggtgggcaagggcatctactttgccagcgagaacagcaagtctgctggctacgtgattggcatgaagtgtggggcccaccacgtgggctacatgttcctgggggaggtggccctgggccgggagcaccacatcaacacagacaaccccagcctgaagagccccccacctggctttgattctgtgattgcccggggccacacagagccagaccccacccaggacacagagctggagctggatggccagcaggtggtggtgccccagggccagcctgtgccctgcccagagttcagcagcagcaccttcagccagagcgagtacctgatctaccaggagagccagtgccgcctgcgctacctgctggaggtgcacctgtag

SEQ ID NO: 21224 - DNA, 1602 bp, Artificial Sequence
  Description of Artificial Sequence: Synthetic coding sequence
atggcccccaagcccaagccctgggtgcagacagagggccctgagaagaagaagggccggcaggccggccgggaggaggaccccttccgcagcacagctgaggccctgaaggccatcccagctgagaagaggatcatccgggtggaccccacctgccccctgagcagcaaccctggcacccaggtgtatgaggactacaactgcaccctgaaccagaccaacatcgagaacaacaacaacaagttctacatcatccagctgctgcaggacagcaaccgcttcttcacctgctggaaccactggggccgggtgggggaggtgggccagagcaagatcaaccacttcacccggctggaggatgccaagaaggactttgagaagaagttccgggagaagaccaagaacaactgggccgagcgggaccactttgtgagccaccctgggaagtacaccctgattgaggtgcaggccgaggatgaggcccaggaggccgtggtgaaggtggaccggggccctgtgaggacagtgaccaagagggtgcagccctgcagcctggaccctgccacccagaagctgatcaccaacatcttcagcaaggagatgttcaagaacaccatggccctgatggacctggatgtgaagaagatgcccctgggcaagctgagcaagcagcagatcgcccggggctttgaggccctggaggccctggaggaggccctgaagggccccacagatggcggccagagcctggaggagctgagcagccacttctacaccgtcatcccccacaactttggccacagccagcccccacccatcaacagccctgagctgctgcaggccaagaaggacatgctgctggtgctggccgacatcgagctggcccaggccctgcaggccgtgtctgagcaggagaagacagtggaggaggtgccccaccccctggaccgggactaccagctgctgaagtgccagctgcagctgctggacagcggggcccctgagtacaaggtgatccagacctacctggagcagacaggcagcaaccaccgctgccccaccctgcagcacatctggaaggtgaaccaggagggggaggaggaccgcttccaggcccacagcaagctgggcaacaggaagctgctgtggcacggcaccaacatggctgtggtggccgccatcctgaccagcggcctgcgcatcatgccccacagcggcggccgggtgggcaagggcatctactttgccagcgagaacagcaagtctgctggctacgtgattggcatgaagtgtggggcccaccacgtgggctacatgttcctgggggaggtggccctgggccgggagcaccacatcaacacagacaaccccagcctgaagagccccccacctggctttgacagcgtcatcgcccggggccacacagagccagaccccacccaggacacagagctggagctggatggccagcaggtggtggtgccccagggccagcctgtgccctgcccagagttcagcagcagcaccttcagccagagcgagtacctgatctaccaggagagccagtgccgcctgcgctacctgctggaggtgcacctgtag

SEQ ID NO: 21225 - DNA, 1602 bp, Artificial Sequence; identical to SEQ ID NO: 21224
  Description of Artificial Sequence: Synthetic coding sequence

SEQ ID NO: 21226 - DNA, 999 bp, Artificial Sequence
  Description of Artificial Sequence: Synthetic coding sequence
atggcccccaagcccaagccctgggtgcagacagagggccctgagaagaagaagggccggcaggccggccgggaggaggaccccttccgcagcacagctgaggccctgaaggccatcccagctgagaagaggatcatccgggtggaccccacctgccccctgagcagcaaccctggcacccaggtgtatgaggactacaactgcaccctgaaccagaccaacatcgagaacaacaacaacaagttctacatcatccagctgctgcaggacagcaaccgcttcttcacctgctggaaccactggggccgggtgggggaggtgggccagagcaagatcaaccacttcacccggctggaggatgccaagaaggactttgagaagaagttccgggagaagaccaagaacaactgggccgagcgggaccactttgtgagccaccctgggaagtacaccctgattgaggtgcaggccgaggatgaggcccaggaggccgtggtgaaggtggaccggggccctgtgaggacagtgaccaagagggtgcagccctgcagcctggaccctgccacccagaagctgatcaccaacatcttcagcaaggagatgttcaagaacaccatggccctgatggacctggatgtgaagaagatgcccctgggcaagctgagcaagcagcagatcgcccggggctttgaggccctggaggccctggaggaggccctgaagggccccacagatggcggccagagcctggaggagctgagcagccacttctacaccgtcatcccccacaactttggccacagccagcccccacccatcaacagccctgagctgctgcaggccaagaaggacatgctgctggtgctggccgacatcgagctggcccaggccctgcaggccgtgtctgagcaggagaagacagtggaggaggtgccccaccccctggaccgggactaccagctgctgaagtgccagctgcagctgctggacagcggctag

SEQ ID NO: 21227 - DNA, 5175 bp, Artificial Sequence
  Description of Artificial Sequence: Synthetic coding sequence
atggtgatgggcatctttgccaactgcatcttctgcctgaaggtgaagtacctgccccagcagcagaagaagaagctgcagacagacatcaaggaaaatggaggcaagttctccttcagcctgaacccccagtgcacccacatcatcctggacaatgctgatgtgctgagccagtaccagctgaacagcatccagaagaaccacgtgcacatcgccaacccagacttcatctggaagagcatccgggagaagaggctgctggatgtgaagaactatgacccctacaagcccctggacatcaccccacctccagaccagaaggccagcagcagcgaggtgaagacagagggcctgtgcccagacagcgccacagaggaggaggacacagtggagctgacagaatttggcatgcagaatgtggagatcccccacctgccccaggactttgaggtggccaagtacaacaccctggagaaggtgggcatggagggcggccaggaggccgtggtggtggagctgcagtgcagccgggacagccgggactgccccttcctgatcagcagccacttcctgctggatgatggcatggagacccggcggcagtttgccatcaagaagaccagtgaagatgccagcgagtactttgagaactacatcgaggagctgaagaagcagggcttcctgctgcgggagcacttcaccccagaggccacccagctggccagcgagcagctgcaggccctgctgctggaggaggtgatgaacagcagcaccctgagccaggaggtgtctgacctggtggagatgatctgggccgaggccctgggccacctggagcacatgctgctgaagcctgtgaaccgcatcagcctgaatgatgtgtccaaggccgagggcatcctgctgctggtgaaggccgccctgaagaatggagaaacagctgagcagctgcagaagatgatgacagagttctaccgcctcatcccccacaagggcaccatgcccaaggaggtgaacctgggcctgctggccaagaaggctgacctgtgccagctgatccgggacatggtgaatgtgtgtgagaccaacctgagcaagcccaacccccccagcctggccaagtaccgggccctgcgctgcaagattgagcacgtggagcagaacacagaggagttcctgcgggtgaggaaggaggtgctgcagaaccaccacagcaagagccctgtggatgtgctgcagatcttccgggtgggccgggtgaatgagaccacagagttcctgagcaagctgggcaatgtgcggcccctgctgcacggcagccctgtgcagaacatcgtgggcatcctgtgccggggcctgctgctgcccaaggtggtggaggacagaggagtgcagaggacagatgtgggcaacctgggcagcggcatctacttcagtgacagcctgagcaccagcatcaagtacagccaccctggagaaacagatggcacccggctgctgctgatctgtgatgtggccctgggcaagtgcatggacctgcacgagaaggacttcagcctgacagaggcccctcctggctatgattctgtgcatggagtgtcccagacagcctctgtgaccacagactttgaagatgatgaatttgtggtgtacaagaccaaccaggtgaagatgaagtacatcatcaagttctccatgcctggggaccagatcaaggacttccaccccagcgaccacacagagctggaggagtacagacctgagttcagcaacttcagcaaggtggaggactaccagctgcctgatgccaagaccagcagcagcaccaaggccggcctgcaggatgccagcggcaacctggtgcccctggaggatgtgcacatcaagggccgcatcatcgacacagtggcccaggtgattgtgttccagacctacaccaacaagagccacgtgcccatcgaggccaagtacatcttccccctggatgacaaggctgctgtgtgtggctttgaggccttcatcaatggcaagcacatcgtgggggagatcaaggagaaggaggaggcccagcaggagtacctggaggccgtgacccagggccatggagcctacctgatgagccaggatgccccagatgtgttcaccgtgtctgtgggcaacctgccccccaaggccaaggtgctgatcaagatcacctacatcacagagctgagcatcctgggcaccgtgggcgtcttcttcatgcctgccaccgtggccccctggcagcaggacaaggccctgaatgaaaacctgcaggacacagtggagaagatctgcatcaaggagatcggcaccaagcagagcttcagcctgaccatgagcattgagatgccctacgtgattgagttcatcttcagtgacacccatgagctgaagcagaagaggacagactgcaaggccgtcatcagcaccatggagggcagcagcctggacagcagcggcttcagcctgcacatcggcctgtctgctgcctacctgcccaggatgtgggtggagaagcaccctgagaaggagagcgaggcctgcatgctggtgttccagcctgacctggatgtggacctgcctgacctggccagcgagagcgaggtgatcatctgcctggactgcagcagctccatggagggcgtgaccttcctgcaggccaagcagatcgccctgcacgccctgagcctggtgggggagaagcagaaggtgaacatcatccagtttggaacaggctacaaggagctgttctcctaccccaagcacatcaccagcaacaccatggctgctgagttcatcatgtctgccacccccaccatgggcaacacagacttctggaagaccctgcgctacctgagcctgctgtacccagcccggggcagcaggaacatcctgctggtgtctgatggccacctgcaggatgagagcctgaccctgcagctggtgaagaggagccggccccacacccggctgtttgcctgtggcatcggcagcacagccaacagacatgtgctgcgcatcctgagccagtgtggggccggcgtgtttgagtacttcaatgccaagagcaagcacagctggaggaagcagatcgaggaccagatgacccggctgtgcagccccagctgccacagcgtgtctgtgaagtggcagcagctgaacccagatgtgcctgaggccctgcaggccccagcccaggtgcccagcctcttcctgaatgaccggctgctggtgtatggcttcatcccccactgcacccaggccaccctgtgtgccctgatccaggagaaggagttccgcaccatggtgtccaccacagagctgcagaagaccaccggcaccatgatccacaagctggccgcccgggccctgatccgggactatgaagatggcatcctgcatgaaaatgagaccagccatgagatgaagaagcagaccctgaagagcctcatcatcaagctgagcaaagaaaacagcctcatcacccagttcaccagctttgtggccgtggagaagagagatgaaaatgaaagccccttcccagacatccccaaggtgtctgagctgattgccaaggaggatgtggacttcctgccctacatgtcctggcagggcgagccccaggaggccgtgaggaaccagagcctgctggccagcagcgagtggccagagctgcggctgagcaagaggaagcacaggaagatccccttcagcaagaggaagatggagctgagccagcctgaggtgtctgaagattttgaagaagatggcctgggcgtgctgcctgccttcaccagcaacctggagcggggcggcgtggagaagctgctggacctgtcctggacagagagctgcaagcccacagccacagagcccctcttcaagaaggtgagcccctgggagaccagcaccagcagcttcttccccatcctggccccagctgtgggcagctacctgcccccaacagcccgggcccacagccctgccagcctgagctttgccagctaccggcaggtggccagctttggcagcgctgccccaccccggcagtttgatgccagccagttcagccagggccctgtgcccggcacctgtgccgactggatcccccagagcgccagctgccccactggaccaccccagaacccccccagcagcccctactgcggcatcgtgttcagcggcagcagcctgagcagcgcccagagcgcccccctgcagcaccctgggggcttcaccacccggcccagcgctggcaccttccctgagctggacagcccccagctgcacttcagcctgcccacagatcctgaccccatccggggcttcggcagctaccaccccagcgccagcagccccttccacttccagcccagcgctgccagcctgacagccaacctgcggctgcccatggccagcgccctgcctgaggccctgtgcagccagagcaggaccacccctgtggacctgtgcctgctggaggagagcgtgggcagcctggagggcagccgctgccctgtgtttgccttccagagcagtgacacagaaagtgatgagctgtctgaggtgctgcaggacagctgcttcctgcagatcaagtgtgacaccaaggatgacagcatcctgtgcttcctggaggtgaaggaggaggatgaaattgtgtgcatccagcactggcaggatgctgtgccctggacagagctgctgagcctgcagacagaagatggcttctggaagctgaccccagagctgggcctcatcctgaacctgaacaccaacggcctgcacagcttcctgaagcagaagggcatccagagcctgggcgtgaagggcagagaatgtctgctggacctgattgccaccatgctggtgctgcagttcatccgcacccggctggagaaggagggcatcgtgttcaagagcctgatgaagatggatgatgccagcatcagcaggaacatcccctgggcctttgaggccatcaagcaggccagcgagtgggtgagaagaacagagggccagtaccccagcatctgcccccggctggagctgggcaatgactgggacagcgccaccaagcagctgctgggcctgcagcccatcagcacagtgagccccctgcaccgggtgctgcactacagccagggctag

SEQ ID NO: 21228 - DNA, 1911 bp, Artificial Sequence
  Description of Artificial Sequence: Synthetic coding sequence
atgaaccccagcgcccccagctaccccatggccagcctgtatgtgggggacctgcacccagatgtgacagaggccatgctgtatgagaagttctccccagctggccccatcctgagcatccgggtgtgccgggacatgatcaccaggaggagcctgggctacgcctacgtgaacttccagcagcctgcagatgctgagcgggccctggacaccatgaactttgatgtgatcaagggcaagcctgtgcgcatcatgtggagccagagggaccccagcctgaggaagagcggcgtgggcaacatcttcatcaagaacctggacaagagcattgacaacaaggccctgtatgacaccttcagcgccttcggcaacatcctgagctgcaaggtggtgtgtgatgaaaatggcagcaagggctacggctttgtgcactttgagacccaggaggccgctgagcgggccatcgagaagatgaatggcatgctgctgaatgacaggaaggtgtttgtgggccgcttcaagagcaggaaggagcgggaggccgagctgggcgcccgggccaaggagttcaccaacgtgtacatcaagaactttggagaggacatggatgatgagcggctgaaggacctgtttgggaagtttggacctgccctgtctgtgaaggtgatgacagatgaaagtggcaagagcaaaggatttggatttgtgtcctttgaaagacatgaagatgcccagaaggctgtggatgagatgaatggcaaggagctgaatggcaagcagatctacgtgggccgggcccagaagaaggtggagcggcagacagagctgaagaggaagtttgagcagatgaagcaggaccgcatcacccgctaccagggcgtgaacctgtatgtgaagaacctggatgatggcattgatgatgagcggctgaggaaggagttcagccccttcggcaccatcaccagcgccaaggtgatgatggagggcggccgcagcaaaggatttggatttgtgtgcttcagcagccctgaggaggccaccaaggctgtgacagagatgaatggaagaattgtggccaccaagcccctgtatgtggccctggcccagaggaaggaggagcggcaggcccacctgaccaaccagtacatgcagaggatggcctctgtgcgggctgtgcccaaccctgtgatcaacccctaccagcctgccccacccagcggctacttcatggccgccatcccccagacccagaacagagctgcctactacccacccagccagatcgcccagctgcggcccagcccccgctggacagcccagggcgcccggccccaccccttccagaacatgcctggggccatccggcctgctgcccccaggcctcccttcagcaccatgaggcctgccagcagccaggtgccccgggtgatgagcacccagagggtggccaacaccagcacccagaccatgggccccaggcctgctgctgctgctgctgctgccaccccagctgtgaggacagtgccccagtacaagtatgctgctggggtgaggaacccccagcagcacctgaatgcccagccccaggtgaccatgcagcagcctgctgtgcacgtgcagggccaggagcccctgacagcctccatgctggccagcgccccaccccaggagcagaagcagatgctgggggagcggctcttccccctcatccaggccatgcaccccaccctggccggcaagatcaccggcatgctgctggagattgacaacagcgagctgctgcacatgctggagagccctgagagcctgcggagcaaggtggatgaggccgtggccgtgctgcaggcccaccaggccaaggaggccgcccagaaggctgtgaacagcgccactggagtgcccaccgtgtag

SEQ ID NO: 21229 - DNA, 1644 bp, Artificial Sequence
  Description of Artificial Sequence: Synthetic coding sequence
atgaaccccagcgcccccagctaccccatggccagcctgtatgtgggggacctgcacccagatgtgacagaggccatgctgtatgagaagttctccccagctggccccatcctgagcatccgggtgtgccgggacatgatcaccaggaggagcctgggctacgcctacgtgaacttccagcagcctgcagatgctgagcgggccctggacaccatgaactttgatgtgatcaagggcaagcctgtgcgcatcatgtggagccagagggaccccagcctgaggaagagcggcgtgggcaacatcttcatcaagaacctggacaagagcattgacaacaaggccctgtatgacaccttcagcgccttcggcaacatcctgagctgcaaggtggtgtgtgatgaaaatggcagcaagggctacggctttgtgcactttgagacccaggaggccgctgagcgggccatcgagaagatgaatggcatgctgctgaatgacaggaaggtgtttgtgggccgcttcaagagcaggaaggagcgggaggccgagctgggcgcccgggccaaggagttcaccaacgtgtacatcaagaactttggagaggacatggatgatgagcggctgaaggacctgtttgggaagtttggacctgccctgtctgtgaaggtgatgacagatgaaagtggcaagagcaaaggatttggatttgtgtcctttgaaagacatgaagatgcccagaaggctgtggatgagatgaatggcaaggagctgaatggcaagcagatctacgtgggccgggcccagaagaaggtggagcggcagacagagctgaagaggaagtttgagcagatgaagcaggaccgcatcacccgctaccagggcgtgaacctgtatgtgaagaacctggatgatggcattgatgatgagcggctgaggaaggagttcagccccttcggcaccatcaccagcgccaaggtgatgatggagggcggccgcagcaaaggatttggatttgtgtgcttcagcagccctgaggaggccaccaaggctgtgacagagatgaatggaagaattgtggccaccaagcccctgtatgtggccctggcccagaggaaggaggagcggcaggcccacctgaccaaccagtacatgcagaggatggcctctgtgcgggctgtgcccaaccctgtgatcaacccctaccagcctgccccacccagcggctacttcatggccgccatcccccagacccagaacagagctgcctactacccacccagccagatcgcccagctgcggcccagcccccgctggacagcccagggcgcccggccccaccctgctgtgcacgtgcagggccaggagcccctgacagcctccatgctggccagcgccccaccccaggagcagaagcagatgctgggggagcggctcttccccctcatccaggccatgcaccccaccctggccggcaagatcaccggcatgctgctggagattgacaacagcgagctgctgcacatgctggagagccctgagagcctgcggagcaaggtggatgaagctgtggccgtgctgcaggcccaccaggccaaggaggccgcccagaaggctgtgaacagcgccaccggggtgcccaccgtgtag

SEQ ID NO: 21230 - DNA, 129 bp, Artificial Sequence
  Description of Artificial Sequence: Synthetic coding sequence
tgaatgctggagagccctgagagcctgcggagcaaggtggatgaggccgtggccgtgctgcaggcccaccaggccaaggaggccgcccagaaggctgtgaacagcgccactggagtgcccaccgtgtag

SEQ ID NO: 21231 - DNA, 117 bp, Artificial Sequence
  Description of Artificial Sequence: Synthetic coding sequence
atgaaccccagcgcccccagctaccccatggccagcctgtatgtgggggacctgcacccagatgtgacagaggccatgctgtatgagaagttctccccagctggccccatcctgtag

SEQ ID NO: 21232 - DNA, 357 bp, Artificial Sequence
  Description of Artificial Sequence: Synthetic coding sequence
atgaaccccagcgcccccagctaccccatggccagcctgtatgtgggggacctgcacccagatgtgacagaggccatgctgtatgagaagttctccccagctggccccatcctgagcatccgggtgtgccgggacatgatcaccaggaggagcctgggctacgcctacgtgaacttccagcagcctgcagatgctgagcgggccctggacaccatgaactttgatgtgatcaagggcaagcctgtgcgcatcatgtggagccagagggaccccagcctgaggaagagcggcgtgggcaacatcttcatcaagaacctggacaagagcattgacaacaaggccctgtatgacacctag

SEQ ID NO: 21233 - DNA, 132 bp, Artificial Sequence
  Description of Artificial Sequence: Synthetic coding sequence
atgaaccccagcgcccccagctaccccatggccagcctgtatgtgggggacctgcacccagatgtgacagaggccatgctgtatgagaagttctccccagctggccccatcctgagcatccgggtgtgctag

SEQ ID NO: 21234 - DNA, 510 bp, Artificial Sequence
  Description of Artificial Sequence: Synthetic coding sequence
tgagccagcagccaggtgccccgggtgatgagcacccagagggtggccaacaccagcacccagaccatgggccccaggcctgctgctgctgctgctgctgccaccccagctgtgaggacagtgccccagtacaagtatgctgctggggtgaggaacccccagcagcacctgaatgcccagccccaggtgaccatgcagcagcctgctgtgcacgtgcagggccaggagcccctgacagcctccatgctggccagcgccccaccccaggagcagaagcagatgctgggggagcggctcttccccctcatccaggccatgcaccccaccctggccggcaagatcaccggcatgctgctggagattgacaacagcgagctgctgcacatgctggagagccctgagagcctgcggagcaaggtggatgaagctgtggccgtgctgcaggcccaccaggccaaggaggccgcccagaaggctgtgaacagcgccaccggggtgcccaccgtgtag

SEQ ID NO: 21235 - DNA, 186 bp, Artificial Sequence
  Description of Artificial Sequence: Synthetic coding sequence
atgaaccccagcgcccccagctaccccatggccagcctgtatgtgggggacctgcacccagatgtgacagaggccatgctgtatgagaagttctccccagctggccccatcctgagcatccgggtgtgccgggacatgatcaccaggaggagcctgggctacgcctacgtgaacttccagcagtag

SEQ ID NO: 21236 - DNA, 390 bp, Artificial Sequence
  Description of Artificial Sequence: Synthetic coding sequence
atgaaccccagcgcccccagctaccccatggccagcctgtatgtgggggacctgcacccagatgtgacagaggccatgctgtatgagaagttctccccagctggccccatcctgagcatccgggtgtgccgggacatgatcaccaggaggagcctgggctacgcctacgtgaacttccagcagcctgcagatgctgagcgggccctggacaccatgaactttgatgtgatcaagggcaagcctgtgcgcatcatgtggagccagagggaccccagcctgaggaagagcggcgtgggcaacatcttcatcaagaacctggacaagagcattgacaacaaggccctgtatgacaccttcagcgccttcggcaacatcctgagctgcaagtag

SEQ ID NO: 21237 - DNA, 552 bp, Artificial Sequence
  Description of Artificial Sequence: Synthetic coding sequence
atccggcctgctgccccccggccccccttcagcaccatgaggcctgccagcagccaggtgccccgggtgatgagcacccagagggtggccaacaccagcacccagaccatgggccccaggcctgctgctgctgctgctgctgccaccccagctgtgaggacagtgccccagtacaagtatgctgctggggtgaggaacccccagcagcacctgaatgcccagccccaggtgaccatgcagcagcctgctgtgcacgtgcagggccaggagcccctgacagcctccatgctggccagcgccccaccccaggagcagaagcagatgctgggggagcggctcttccccctcatccaggccatgcaccccaccctggccggcaagatcaccggcatgctgctggagattgacaacagcgagctgctgcacatgctggagagccctgagagcctgcggagcaaggtggatgaagctgtggccgtgctgcaggcccaccaggccaaggaggccgcccagaaggctgtgaacagcgccaccggggtgcccaccgtgtag

SEQ ID NO: 21238 - DNA, 228 bp, Artificial Sequence
  Description of Artificial Sequence: Synthetic coding sequence
atgaaccccagcgcccccagctaccccatggccagcctgtatgtgggggacctgcacccagatgtgacagaggccatgctgtatgagaagttctccccagctggccccatcctgagcatccgggtgtgccgggacatgatcaccaggaggagcctgggctacgcctacgtgaacttccagcagcctgcagatgctgagcgggccctggacaccatgaactttgattag

SEQ ID NO: 21239 - DNA, 1008 bp, Artificial Sequence
  Description of Artificial Sequence: Synthetic coding sequence
atgagcaagaggaaggccccccaggagaccctgaatggaggcatcacagacatgctgacagagctggccaactttgagaagaatgtgtcccaggccatccacaagtacaatgcctacaggaaggccgccagcgtcatcgccaagtacccccacaagatcaagtctggagctgaggccaagaagctgcccggggtgggcaccaagattgctgagaagattgatgagttcctggccaccgggaagctgaggaagctggagaagatccggcaggatgacaccagcagcagcatcaacttcctgaccagggtgtctggcatcggccccagcgctgccaggaagtttgtggatgagggcatcaagaccctggaggacctgaggaagaatgaagacaagctgaaccaccaccagagaattggcctgaagtactttggagactttgagaagaggatcccccgggaggagatgctgcagatgcaggacatcgtgctgaatgaggtgaagaaggtggacagcgagtacatcgccaccgtgtgtggcagcttcagaagaggagctgagagcagcggggacatggatgtgctgctgacccaccccagcttcaccagcgagagcaccaagcagcccaagctgctgcaccaggtggtggagcagctgcagaaggtgcacttcatcacagacaccctgagcaagggggagaccaagttcatgggcgtgtgccagctgcccagcaagaatgatgagaaggagtacccccacagaagaattgacatccgcctcatccccaaggaccagtactactgcggcgtgctgtacttcaccggcagtgacatcttcaacaagaacatgagggcccacgccctggagaagggcttcaccatcaatgagtacaccatccggcccctgggcgtgactggagtggccggggagcccctgcctgtggacagcgagaaggacatctttgactacatccagtggaagtaccgggagcccaaggacagaagtgaatag

SEQ ID NO: 21240 - DNA, 720 bp, Artificial Sequence
  Description of Artificial Sequence: Synthetic coding sequence
tgaggagactttgagaagaggatcccccgggaggagatgctgcagatgcaggacatcgtgctgaatgaggtgaagaaggtggacagcgagtacatcgccaccgtgtgtggcagcttcagaagaggagctgagagcagcggggacatggatgtgctgctgacccaccccagcttcaccagcgagagcaccaagcagcccaagctgctgcaccaggtggtggagcagctgcagaaggtgcacttcatcacagacaccctgagcaagggggagaccaagttcatgggcgtgtgccagctgcccagcaagaatgatgagaaggagtacccccacagaagaattgacatccgcctcatccccaaggaccagtactactgcggcgtgctgtacttcaccggcagtgacatcttcaacaagaacatgagggcccacgccctggagaagggcttcaccatcaatgagtacaccatccggcccctgggcgtgacagtgctgcaggccacccgggaggacctgatgcacaacatgctgctgggcccccagctgaaggccatcaaggagctgcaggagaacccctgccagtggatcgtgaagaagaccagcctcatcaccagcagcggcaacacaggcaaccccaggactggagccaatgaggcctgcatcctgcccggccgccacaaccccatcggcgtgctgatctacttcctgacctttgccatgtag

SEQ ID NO: 21241 - DNA, 843 bp, Artificial Sequence
  Description of Artificial Sequence: Synthetic coding sequence
atgagcaagaggaaggccccccaggagaccctgaatggaggcatcacagacatgctgacagagctggccaactttgagaagaatgtgtcccaggccatccacaagtacaatgcctacaggaaggccgccagcgtcatcgccaagtacccccacaagatcaagtctggagctgaggccaagaagctgcccggggtgggcaccaagattgctgagaagattgatgagttcctggccaccgggaagctgaggaagctggagaagatccggcaggatgacaccagcagcagcatcaacttcctgaccagggtgtctggcatcggccccagcgctgccaggaagtttgtggatgagggcatcaagaccctggagggcagccagctggacagctgccctgtgaagggccacctgaatggaacagagagcctgctggacctgatctgggatgtgatgaccatcctgaagctgaagaatgctgacctgaggaagaatgaagacaagctgaaccaccaccagagaattggcctgaagtactttggagactttgagaagaggatcccccgggaggagatgctgcagatgcaggacatcgtgctgaatgaggtgaagaaggtggacagcgagtacatcgccaccgtgtgtggcagcttcagaagaggagctgagagcagcggggacatggatgtgctgctgacccaccccagcttcaccagcgagagcaccaagcagcccaagctgctgcaccaggtggtggagcagctgcagaaggtgcacttcatcacagacaccctgagcaaaggagagaccaagttcatgggcgtgtgccagctgcccagcaagaactag

SEQ ID NO: 21242 - DNA, 714 bp, Artificial Sequence
  Description of Artificial Sequence: Synthetic coding sequence
tgagagaagattgatgagttcctggccaccgggaagctgaggaagctggagaagatccggcaggatgacaccagcagcagcatcaacttcctgaccagggtgtctggaattggccccagcgctgccaggaagtttgtggatgagggcatcaagaccctggaggacctgaggaagaatgaagacaagctgaaccaccaccagagaattggcctgaagtactttggagactttgagaagaggatcccccgggaggagatgctgcagatgcaggacatcgtgctgaatgaggtgaagaaggtggacagcgagtacatcgccaccgtgtgtggcagcttcagaagaggagctgagagcagcggggacatggatgtgctgctgacccaccccagcttcaccagcgagagcaccaagcagggcgtgtgccagctgcccagcaagaatgatgagaaggagtacccccacagaagaattgacatccgcctcatccccaaggaccagtactactgcggcgtgctgtacttcaccggcagtgacatcttcaacaagaacatgagggcccacgccctggagaagggcttcaccatcaatgagtacaccatccggcccctgggcgtgactggagtggccggggagcccctgcctgtggacagcgagaaggacatctttgactacatccagtggaagtaccgggagcccaaggacagaagtgaatag

SEQ ID NO: 21243 - DNA, 546 bp, Artificial Sequence
  Description of Artificial Sequence: Synthetic coding sequence
atgctgcagatgcaggacatcgtgctgaatgaggtgaagaaggtggacagcgagtacatcgccaccgtgtgtggcagcttcagaagaggagctgagagcagcggggacatggatgtgctgctgacccaccccagcttcaccagcgagagcaccaagcagcccaagctgctgcaccaggtggtggagcagctgcagaaggtgcacttcatcacagacaccctgagcaagggggagaccaagttcatgggcgtgtgccagctgcccagcaagaatgatgagaaggagtacccccacagaagaattgacatccgcctcatccccaaggaccagtactactgcggcgtgctgtacttcaccggcagtgacatcttcaacaagaacatgagggcccacgccctggagaagggcttcaccatcaatgagtacaccatccggcccctgggcgtgactggagtggccggggagcccctgcctgtggacagcgagaaggacatctttgactacatccagtggaagtaccgggagcccaaggacagaagtgaatag

SEQ ID NO: 21244 - DNA, 1728 bp, Artificial Sequence
  Description of Artificial Sequence: Synthetic coding sequence
atggacccccggggcatcctgaaggccttccccaagaggcagaagatccacgcagatgccagcagcaaggtgctggccaagatcccccggcgggaggagggggaggaggccgaggagtggctgagcagcctgcgggcccacgtggtgaggactggaattggccgggcccgggcagagctgtttgagaagcagatcgtgcagcacggcggccagctgtgcccagcccagggccctggggtgacccacatcgtggtggatgagggcatggactatgagcgggccctgcggctgctgcggctgccccagctgcccccaggggcccagctggtgaagagcgcctggctgagcctgtgcctgcaggagcggcggctggtggatgtggccggcttcagcatcttcatccccagccgctacctggaccacccccagcccagcaaggccgagcaggatgccagcatccccccaggcacccatgaggccctgctgcagacagccctgagccccccacctccacccaccaggcctgtgagccccccccagaaggccaaggaggcccccaacacccaggcccagcccatcagtgatgatgaggccagtgatggagaggagacccaggtgtctgctgctgacctggaggccctgatcagcggccactaccccaccagcctggagggggactgtgagcccagccctgccccagctgtgctggacaagtgggtgtgtgcccagcccagcagccagaaggccaccaaccacaacctgcacatcacagagaagctggaggtgctggccaaggcctacagcgtgcagggcgacaagtggagggccctgggctacgccaaggccatcaatgccctgaagagcttccacaagcctgtgaccagctaccaggaggcctgcagcatccctggcatcggcaagaggatggccgagaagatcatcgagatcctggagagcggccacctgaggaagctggaccacatcagcgagagcgtgcctgtgctggagctgttcagcaacatctggggcgccggcaccaagacagcccagatgtggtaccagcagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctacagaagaggcaaggccacctgtggagatgtggatgtgctgatcacccacccagatggccgcagccaccggggcatcttcagccggctgctggacagcctgcggcaggagggcttcctgacagatgacctggtgtcccaggaggagaatggccagcagcagaagtacctgggcgtgtgccgcctgcccggccctggccgccgccaccggcggctggacatcatcgtggtgccctacagcgagtttgcctgtgccctgctgtacttcaccggcagcgcccacttcaacagatccatgagggccctggccaagaccaagggcatgagcctgtctgagcacgccctgagcacagctgtggtgaggaacacccacggctgcaaggtgggccctggccgggtgctgcccacccccacagagaaggatgtgttccggctgctgggcctgccctaccgggagcctgctgagcgggactggtag

SEQ ID NO: 21245 - DNA, 897 bp, Artificial Sequence
  Description of Artificial Sequence: Synthetic coding sequence
atgcaccaccagaagtacctgcagcgcttcctgggcggcaagcgggagaagaagcagaaggaggcctgcagcatccctggcatcggcaagaggatggccgagaagatcatcgagatcctggagagcggccacctgaggaagctggaccacatcagcgagagcgtgcctgtgctggagctgttcagcaacatctggggcgccggcaccaagacagcccagatgtggtaccagcagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctaccgccggggcaaggccacctgtggagatgtggatgtgctgatcacccacccagatggccgcagccaccggggcatcttcagccggctgctggacagcctgcggcaggagggcttcctgacagatgacctggtgtcccaggaggagaatggccagcagcagaagtacctgggcgtgtgccgcctgcccggccctggaagaagacaccggcggctggacatcatcgtggtgccctacagcgagtttgcctgtgccctgctgtacttcaccggcagcgcccacttcaacagatccatgagggccctggccaagaccaagggcatgagcctgtctgaacatgccctgagcacagctgtggtgaggaacacccacggctgcaaggtgggccctggccgggtgctgcccacccccacagagaaggatgtgttccggctgctgggcctgccctaccgggagcctgctgagcgggactggtag

SEQ ID NO: 21246 - DNA, 1548 bp, Artificial Sequence
  Description of Artificial Sequence: Synthetic coding sequence
atggacccccggggcatcctgaaggccttccccaagaggcagaagatccacgcagatgccagcagcaaggtgctggccaagatcccccggcgggaggagggggaggaggccgaggagtggctgagcagcctgcgggcccacgtggtgaggactggaattggccgggcccgggcagagctgtttgagaagcagatcgtgcagcacggcggccagctgtgcccagcccagggccctggggtgacccacatcgtggtggatgagggcatggactatgagcgggccctgcggctgctgcggctgccccagctgcccccaggggcccagctggtgaagagcgcctggctgagcctgtgcctgcaggagcggcggctggtggatgtggccggcttcagcatcttcatccccagccgctacctggaccacccccagcccagcaaggccgagcaggatgccagcatccccccaggcacccatgaggccctgctgcagacagccctgagccccccacctccacccaccaggcctgtgagccccccccagaaggccaaggaggcccccaacacccaggcccagcccatcagtgatgatgaggccagtgatggagaggagacccaggtgtctgctgctgacctggaggccctgatcagcggccactaccccaccagcctggagggggactgtgagcccagccctgccccagctgtgctggacaagtgggtgtgtgcccagcccagcagccagaaggccaccaaccacaacctgcacatcacagagaagctggaggtgctggccaaggcctacagcgtgcagggcgacaagtggagggccctgggctacgccaaggccatcaatgccctgaagagcttccacaagcctgtgaccagctaccaggaggcctgcagcatccctggcatcggcaagaggatggccgagaagatcatcgagatcctggagagcggccacctgaggaagctggaccacatcagcgagagcgtgcctgtgctggagctgttcagcaacatctggggcgccggcaccaagacagcccagatgtggtaccagcagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctacagaagaggcaaggccacctgtggagatgtggatgtgctgatcacccacccagatggccgcagccaccggggcatcttcagccggctgctggacagcctgcggcaggagggcttcctgacagatgacctggtgtcccaggaggagaatggccagcagcagaagtacctgggcgtgtgccgcctgcccggccctggccgccgccaccggcggctggacatcatcgtggtgccctacagcgagtttgcctgtgccctgcagggcggggcctggcccagcgctgcccacagccactag

SEQ ID NO: 21247 - DNA, 903 bp, Artificial Sequence
  Description of Artificial Sequence: Synthetic coding sequence
atgctgatgcaccaccagaagtacctgcagcgcttcctgggcggcaagcgggagaagaagcagaaggaggcctgcagcatccctggcatcggcaagaggatggccgagaagatcatcgagatcctggagagcggccacctgaggaagctggaccacatcagcgagagcgtgcctgtgctggagctgttcagcaacatctggggcgccggcaccaagacagcccagatgtggtaccagcagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctaccgccggggcaaggccacctgtggagatgtggatgtgctgatcacccacccagatggccgcagccaccggggcatcttcagccggctgctggacagcctgcggcaggagggcttcctgacagatgacctggtgtcccaggaggagaatggccagcagcagaagtacctgggcgtgtgccgcctgcccggccctggaagaagacaccggcggctggacatcatcgtggtgccctacagcgagtttgcctgtgccctgctgtacttcaccggcagcgcccacttcaacagatccatgagggccctggccaagaccaagggcatgagcctgtctgaacatgccctgagcacagctgtggtgaggaacacccacggctgcaaggtgggccctggccgggtgctgcccacccccacagagaaggatgtgttccggctgctgggcctgccctaccgggagcctgctgagcgggactggtag

SEQ ID NO: 21248 - DNA, 1728 bp, Artificial Sequence; identical to SEQ ID NO: 21244
  Description of Artificial Sequence: Synthetic coding sequence

SEQ ID NO: 21249 - DNA, 516 bp, Artificial Sequence
  Description of Artificial Sequence: Synthetic coding sequence
atggactatgagcgggccctgcggctgctgcggctgccccagctgcccccaggggcccagctggtgaagagcgcctggctgagcctgtgcctgcaggagcggcggctggtggatgtggccggcttcagcatcttcatccccagcagccccagcctgatgatgaagcctgtgatgggcaagaagccccggctggtgcagctgatctggaagcccagctctgtggccaccaccccaccacccctgcgggagatcgtgtccctggcccagcccctgctgtcctggatcagcggctctgtgcacagcccccaggcccggcggcggcccatcaccaccagcatcagccagaggtcctggaagttctggcccaagcccaccgtcttccgggagaccagcggcggcccctgggccatgccccggcccagcatgcccagccgggccagcatcagcctgagccccaggaccaggaggcctgctgtgtccctgggcctgggcagcggctggctgaggaagagctag

SEQ ID NO: 21250 - DNA, 747 bp, Artificial Sequence
  Description of Artificial Sequence: Synthetic coding sequence
atggaggccctgtgtgtgtgcagcctgatgcccctgcactggagctggatcctgacagccagccacctggccgccttcttccagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctaccgccggggcaaggccacctgtggagatgtggatgtgctgatcacccacccagatggccgcagccaccggggcatcttcagccggctgctggacagcctgcggcaggagggcttcctgacagatgacctggtgtcccaggaggagaatggccagcagcagaagtacctgggcgtgtgccgcctgcccggccctggaagaagacaccggcggctggacatcatcgtggtgccctacagcgagtttgcctgtgccctgctgtacttcaccggcagcgcccacttcaacagatccatgagggccctggccaagaccaagggcatgagcctgtctgaacatgccctgagcacagctgtggtgaggaacacccacggctgcaaggtgggccctggccgggtgctgcccacccccacagagaaggatgtgttccggctgctgggcctgccctaccgggagcctgctgagcgggactggtag

SEQ ID NO: 21251 - DNA, 1728 bp, Artificial Sequence; identical to SEQ ID NO: 21244
  Description of Artificial Sequence: Synthetic coding sequence

SEQ ID NO: 21252 - DNA, 1464 bp, Artificial Sequence
  Description of Artificial Sequence: Synthetic coding sequence
atggactatgagcgggccctgcggctgctgcggctgccccagctgcccccaggggcccagctggtgaagagcgcctggctgagcctgtgcctgcaggagcggcggctggtggatgtggccggcttcagcatcttcatccccagccgctacctggaccacccccagcccagcaaggccgagcaggatgccagcatccccccaggcacccatgaggccctgctgcagacagccctgagccccccacctccacccaccaggcctgtgagccccccccagaaggccaaggaggcccccaacacccaggcccagcccatcagtgatgatgaggccagtgatggagaggagacccaggtgtctgctgctgacctggaggccctgatcagcggccactaccccaccagcctggagggggactgtgagcccagccctgccccagctgtgctggacaagtgggtgtgtgcccagcccagcagccagaaggccaccaaccacaacctgcacatcacagagaagctggaggtgctggccaaggcctacagcgtgcagggcgacaagtggagggccctgggctacgccaaggccatcaatgccctgaagagcttccacaagcctgtgaccagctaccaggaggcctgcagcatccctggcatcggcaagaggatggccgagaagatcatcgagatcctggagagcggccacctgaggaagctggaccacatcagcgagagcgtgcctgtgctggagctgttcagcaacatctggggcgccggcaccaagacagcccagatgtggtaccagcagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctacagaagaggcaaggccacctgtggagatgtggatgtgctgatcacccacccagatggccgcagccaccggggcatcttcagccggctgctggacagcctgcggcaggagggcttcctgacagatgacctggtgtcccaggaggagaatggccagcagcagaagtacctgggcgtgtgccgcctgcccggccctggccgccgccaccggcggctggacatcatcgtggtgccctacagcgagtttgcctgtgccctgctgtacttcaccggcagcgcccacttcaacagatccatgagggccctggccaagaccaagggcatgagcctgtctgagcacgccctgagcacagctgtggtgaggaacacccacggctgcaaggtgggccctggccgggtgctgcccacccccacagagaaggatgtgttccggctgctgggcctgccctaccgggagcctgctgagcgggactggtag

SEQ ID NO: 21253 - DNA, 1548 bp, Artificial Sequence; identical to SEQ ID NO: 21246
  Description of Artificial Sequence: Synthetic coding sequence

SEQ ID NO: 21254 - DNA, 810 bp, Artificial Sequence
  Description of Artificial Sequence: Synthetic coding sequence
atggacccccggggcatcctgaaggccttccccaagaggcagaagatccacgcagatgccagcagcaaggtgctggccaagatcccccggcgggaggagggggaggaggccgaggagtggctgagcagcctgcgggcccacgtggtgaggactggaattggccgggcccgggcagagctgtttgagaagcagatcgtgcagcacggcggccagctgtgcccagcccagggccctggggtgacccacatcgtggtggatgagggcatggactatgagcgggccctgcggctgctgcggctgccccagctgcccccaggggcccagctggtgaagagcgcctggctgagcctgtgcctgcaggagcggcggctggtggatgtggccggcttcagcatcttcatccccagccgctacctggaccacccccagcccagcaaggccgagcaggatgccagcatccccccaggcacccatgaggccctgctgcagacagccctgagccccccacctccacccaccaggcctgtgagccccccccagaaggccaaggaggcccccaacacccaggcccagcccatcagtgatgatgaggccagtgatggagaggagacccaggtgtctgctgctgacctggaggccctgatcagcggccactaccccaccagcctggagggggactgtgagcccagccctgccccagctgtgctggacaagtgggtgtgtgcccagcccagcagccagaaggccaccaaccacaacctgcacatcacagagaagctggaggtgctggccaaggcctacagcgtgtag

SEQ ID NO: 21255 - DNA, 1413 bp, Artificial Sequence
  Description of Artificial Sequence: Synthetic coding sequence
atggacccccggggcatcctgaaggccttccccaagaggcagaagatccacgcagatgccagcagcaaggtgctggccaagatcccccggcgggaggagggggaggaggccgaggagtggctgagcagcctgcgggcccacgtggtgaggactggaattggccgggcccgggcagagctgtttgagaagcagatcgtgcagcacggcggccagctgtgcccagcccagggccctggggtgacccacatcgtggtggatgagggcatggactatgagcgggccctgcggctgctgcggctgccccagctgcccccaggggcccagctggtgaagagcgcctggctgagcctgtgcctgcaggagcggcggctggtggatgtggccggcttcagcatcttcatccccagccgctacctggaccacccccagcccagcaaggccgagcaggatgccagcatccccccaggcacccatgaggccctgctgcagacagccctgagccccccacctccacccaccaggcctgtgagccccccccagaaggccaaggaggcccccaacacccaggcccagcccatcagtgatgatgaggccagtgatggagaggagacccaggaggcctgcagcatccctggcatcggcaagaggatggccgagaagatcatcgagatcctggagagcggccacctgaggaagctggaccacatcagcgagagcgtgcctgtgctggagctgttcagcaacatctggggcgccggcaccaagacagcccagatgtggtaccagcagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctacagaagaggcaaggccacctgtggagatgtggatgtgctgatcacccacccagatggccgcagccaccggggcatcttcagccggctgctggacagcctgcggcaggaggccgtgcccagcgtgggccctggcttcctgacagatgacctggtgtcccaggaggagaatggccagcagcagaagtacctgggcgtgtgccgcctgcccggccctggaagaagacaccggcggctggacatcatcgtggtgccctacagcgagtttgcctgtgccctgctgtacttcaccggcagcgcccacttcaacagatccatgagggccctggccaagaccaagggcatgagcctgtctgaacatgccctgagcacagctgtggtgaggaacacccacggctgcaaggtgggccctggccgggtgctgcccacccccacctag

SEQ ID NO: 21256 - DNA, 1005 bp, Artificial Sequence
  Description of Artificial Sequence: Synthetic coding sequence
atggacccccggggcatcctgaaggccttccccaagaggcagaagatccacgcagatgccagcagcaagcccagctgtgccagcgccctgcgctgcctgtgcccagagagtgacattggagctgacagcgcctgccccggccctgctgagtggctgagcagcctgcgggcccacgtggtgaggacaggcatcggccgggcccgggcagagctgtttgagaagcagatcgtgcagcacggcggccagctgtgcccagcccagggccctggggtgacccacatcgtggtggatgagggcatggactatgaaagagccctgcggctgctgcggctgccccagctgcccccaggggcccagctggtgaagagcgcctggctgagcctgtgcctgcaggagcggcggctggtggatgtggccggcttcagcatcttcatccccagccgctacctggaccacccccagcccagcaaggccgagcaggatgccagcatccccccaggcacccatgaggccctgctgcagacagccctgagccccccacctccacccaccaggcctgtgtccccaccccagaaggccaaggaggcccccaacacccaggcccagcccatcagtgatgatgaggccagtgatggagaggagacccaggtgtctgctgctgacctggaggccctgatcagcggccactaccccaccagcctggagggggactgtgagcccagccctgccccagctgtgctggacaagtgggtgtgtgcccagcccagcagccagaaggccaccaaccacaacctgcacatcacagagaagctggaggtgctggccaaggcctacagcgtgcagggcgacaagtggagggccctgggctacgccaaggccatcaatgccctgaagagcttccacaagcctgtgaccagctaccaggaggcctgcagcatccctggcatcggcaagaggatggccgagaagatcatcgagatcctggagagcggccacctgaggtag

SEQ ID NO: 21257 - DNA, 657 bp, Artificial Sequence
  Description of Artificial Sequence: Synthetic coding sequence
atgcaccaccagaagtacctgcagcgcttcctgggcggcaagcgggagaagaagcagaaggaggcctgcagcatccctggcatcggcaagaggatggccgagaagatcatcgagatcctggagagcggccacctgaggaagctggaccacatcagcgagagcgtgcctgtgctggagctgttcagcaacatctggggcgccggcaccaagacagcccagatgtggtaccagcagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctaccgccggggcaaggccacctgtggagatgtggatgtgctgatcacccacccagatggccgcagccaccggggcatcttcagccggctgctggacagcctgcggcaggagggcttcctgacagatgacctggtgtcccaggaggagaatggccagcagcagaagtacctgggcgtgtgccgcctgcccggccctggaagaagacaccggcggctggacatcatcgtggtgccctag

SEQ ID NO: 21258 - DNA, 567 bp, Artificial Sequence
  Description of Artificial Sequence: Synthetic coding sequence
atggacccccggggcatcctgaaggccttccccaagaggcagaagatccacgcagatgccagcagcaaggtgctggccaagatcccccggcgggaggagggggaggaggccgaggagtggctgagcagcctgcgggcccacgtggtgaggactggaattggccgggcccgggcagagctgtttgagaagcagatcgtgcagcacggcggccagctgtgcccagcccagggccctggggtgacccacatcgtggtggatgagggcatggactatgagcgggccctgcggctgctgcggctgccccagctgcccccaggggcccagctggtgaagagcgcctggctgagcctgtgcctgcaggagcggcggctggtggatgtggccggcttcagcatcttcatccccagccgctacctggaccacccccagcccagcaaggccgagcaggatgccagcatccccccaggcacccatgaggccctgctgcagacagccctgagccccccacctccacccaccaggcctgtgagccccccccagaaggccaaggaggcccccaacacctag

SEQ ID NO: 21259 - DNA, 516 bp, Artificial Sequence; identical to SEQ ID NO: 21249
  Description of Artificial Sequence: Synthetic coding sequence

SEQ ID NO: 21260 - DNA, 459 bp, Artificial Sequence
  Description of Artificial Sequence: Synthetic coding sequence
atggactatgagcgggccctgcggctgctgcggctgccccagctgcccccaggggcccagctggtgaagagcgcctggctgagcctgtgcctgcaggagcggcggctggtggatgtggccggcttcagcatcttcatccccagcagccccagcctgatgatgaagcctgtgatgggcaagaagccccggctggtgcagctgatctggaagcccagctctgtggccaccaccccaccacccctgcgggagatcgtgtccctggcccagcccctgctgtcctggatcagcggctctgtgcacagcccccaggcccggcggcggcccatcaccaccagcatcagccagaggtcctggaagttctggcccaagcccaccgtcttccgggagaccagcggcggcccctgggccatgccccggcccagcatgcccagccgggccagcatcagcctgagcccctag

SEQ ID NO: 21261 - DNA, 939 bp, Artificial Sequence
  Description of Artificial Sequence: Synthetic coding sequence
atgcaccaccagaagtacctgcagcgcttcctgggcggcaagcgggagaagaagcagaagcccatcagtgatgatgaggccagtgatggagaggagacccaggaggcctgcagcatccctggcatcggcaagaggatggccgagaagatcatcgagatcctggagagcggccacctgaggaagctggaccacatcagcgagagcgtgcctgtgctggagctgttcagcaacatctggggcgccggcaccaagacagcccagatgtggtaccagcagggcttccgcagcctggaggacatccgcagccaggccagcctgaccacccagcaggccatcggcctgaagcactacagcgacttcctggagaggatgccccgggaggaggccacagaaattgagcagacagtgcagaaggccgcccaggccttcaacagcggcctgctgtgtgtggcctgtggcagctaccgccggggcaaggccacctgtggagatgtggatgtgctgatcacccacccagatggccgcagccaccggggcatcttcagccggctgctggacagcctgcggcaggagggcttcctgacagatgacctggtgtcccaggaggagaatggccagcagcagaagtacctgggcgtgtgccgcctgcccggccctggaagaagacaccggcggctggacatcatcgtggtgccctacagcgagtttgcctgtgccctgctgtacttcaccggcagcgcccacttcaacagatccatgagggccctggccaagaccaagggcatgagcctgtctgaacatgccctgagcacagctgtggtgaggaacacccacggctgcaaggtgggccctggccgggtgctgcccacccccacagagaaggatgtgttccggctgctgggcctgccctaccgggagcctgctgagcgggactggtag

SEQ ID NO: 21262 - DNA, 1401 bp, Artificial Sequence
  Description of Artificial Sequence: Synthetic coding sequence
atggctgaccagctgtacctggagaacattgatgaatttgtgacagaccagaacaagatcgtgacctacaagtggctgagctacaccctgggcgtgcacgtgaaccaggccaagcagatgctgtatgactatgtggagaggaagaggaaagaaaattctggggcccagctgcacgtgacctacctggtgtctggcagcctcatccagaatggccacagctgccacaaggtggccgtggtgcgggaggacaagctggaggccgtgaagagcaagctggccgtgacagccagcatccacgtgtacagcatccagaaggccatgctgaaggacagcggccccctcttcaacacagattatgacatcctgaagagcaacctgcagaactgcagcaagttcagcgccatccagtgtgccgctgctgtgccccgggccccagctgagagcagcagcagcagcaagaagtttgagcagagccacctgcacatgagcagcgagacccaggccaacaatgagctgaccaccaatggacatggccccccagccagcaagcaggtgtcccagcagcccaagggcatcatgggcatgtttgccagcaaggctgctgccaagacccaggagaccaacaaggagaccaagacagaggccaaggaggtgaccaatgccagcgctgctggcaacaaggcccctggaaaaggaaacatgatgagcaacttcttcggcaaggccgccatgaacaagttcaaggtgaacctggacagcgagcaggccgtgaaggaggagaagatcgtggagcagcccaccgtgtctgtgacagagcccaagctggccaccccagctggcctgaagaagagcagcaagaaggccgagcctgtgaaggtgctgcagaaggagaagaagaggggcaagagggtggccctgagtgatgatgagaccaaggagacagagaacatgaggaagaagagaagacgcatcaagctgcctgagagtgacagcagtgaagatgaggtgtttcctgacagccctggggcctatgaggccgagagccccagccccccacctccacccagcccccccctggagcctgtgcccaagacagagcctgagcccccatctgtgaagagcagcagcggggagaacaagaggaagaggaagagggtgctgaagagcaagacctacctggatggagagggctgcatcgtgacagagaaggtgtatgaaagtgagagctgcacagattctgaggaggagctgaacatgaagaccagctctgtgcaccggcccccagccatgacagtgaagaaggagccccgggaggagaggaagggccccaagaagggcacagctgccctgggcaaggccaaccggcaggtgtccatcaccggcttcttccagaggaagtag

SEQ ID NO: 21263 - DNA, 1284 bp, Artificial Sequence
  Description of Artificial Sequence: Synthetic coding sequence
atgctgtatgactatgtggagaggaagaggaaggagaacagcggggcccagctgcacgtgacctacctggtgtctggcagcctcatccagaatggccacagctgccacaaggtggccgtggtgcgggaggacaagctggaggccgtgaagagcaagctggccgtgacagccagcatccacgtgtacagcatccagaaggccatgctgaaggacagcggccccctcttcaacacagattatgacatcctgaagagcaacctgcagaactgcagcaagttcagcgccatccagtgtgccgctgctgtgccccgggccccagctgagagcagcagcagcagcaagaagtttgagcagagccacctgcacatgagcagcgagacccaggccaacaatgagctgaccaccaacggccacggccccccagccagcaagcaggtgtcccagcagcccaagggcatcatgggcatgtttgccagcaaggccgccgccaagacccaggagaccaacaaggagaccaagacagaggccaaggaggtgaccaatgccagcgctgctggcaacaaggcccctgggaagggcaacatgatgagcaacttcttcggcaaggccgccatgaacaagttcaaggtgaacctggacagcgagcaggccgtgaaggaggagaagatcgtggagcagcccaccgtgtctgtgacagagcccaagctggccaccccagctggcctgaagaagagcagcaagaaggccgagcctgtgaaggtgctgcagaaggagaagaagaggggcaagagggtggccctgagtgatgatgagaccaaggagacagagaacatgaggaagaagagaagacgcatcaagctgcctgagagtgacagcagtgaagatgaggtgtttcctgacagccctggggcctatgaagctgagagccccagccccccacctccacccagcccccccctggagcctgtgcccaagacagagcctgagccccccagcgtgaagagcagcagtggagagaacaagaggaagaggaagagggtgctgaagagcaagacctacctggatggagagggctgcatcgtgacagagaaggtgtatgagagcgagagctgcacagacagcgaggaggagctgaacatgaagaccagctctgtgcaccggcccccagccatgacagtgaagaaggagccccgggaggagaggaagggccccaagaagggcacagctgccctgggcaaggccaaccggcaggtgtccatcaccggcttcttccagaggaagtag

SEQ ID NO: 21264 - DNA, 1083 bp, Artificial Sequence
  Description of Artificial Sequence: Synthetic coding sequence
atgctgaaggacagcggccccctcttcaacacagattatgacatcctgaagagcaacctgcagaactgcagcaagttcagcgccatccagtgtgccgctgctgtgccccgggccccagctgagagcagcagcagcagcaagaagtttgagcagagccacctgcacatgagcagcgagacccaggccaacaatgagctgaccaccaatggacatggccccccagccagcaagcaggtgtcccagcagcccaagggcatcatgggcatgtttgccagcaaggctgctgccaagacccaggagaccaacaaggagaccaagacagaggccaaggaggtgaccaatgccagcgctgctggcaacaaggcccctggaaaaggaaacatgatgagcaacttcttcggcaaggccgccatgaacaagttcaaggtgaacctggacagcgagcaggccgtgaaggaggagaagatcgtggagcagcccaccgtgtctgtgacagagcccaagctggccaccccagctggcctgaagaagagcagcaagaaggccgagcctgtgaaggtgctgcagaaggagaagaagaggggcaagagggtggccctgagtgatgatgagaccaaggagacagagaacatgaggaagaagagaagacgcatcaagctgcctgagagtgacagcagtgaagatgaggtgtttcctgacagccctggggcctatgaggccgagagccccagccccccacctccacccagcccccccctggagcctgtgcccaagacagagcctgagcccccatctgtgaagagcagcagcggggagaacaagaggaagaggaagagggtgctgaagagcaagacctacctggatggagagggctgcatcgtgacagagaaggtgtatgaaagtgagagctgcacagattctgaggaggagctgaacatgaagaccagctctgtgcaccggcccccagccatgacagtgaagaaggagccccgggaggagaggaagggccccaagaagggcacagctgccctgggcaaggccaaccggcaggtgtccatcaccggcttcttccagaggaagtag

SEQ ID NO: 21265 - DNA, 804 bp, Artificial Sequence
  Description of Artificial Sequence: Synthetic coding sequence
atggctgaccagctgtacctggagaacattgatgaatttgtgacagaccagaacaagatcgtgacctacaagtggctgagctacaccctgggcgtgcacgtgaaccaggccaagcagatgctgtatgactatgtggagaggaagaggaaagaaaattctggggcccagctgcacgtgacctacctggtgtctggcagcctcatccagaatggccacagctgccacaaggtggccgtggtgcgggaggacaagctggaggccgtgaagagcaagctggccgtgacagccagcatccacgtgtacagcatccagaaggccatgctgaaggacagcggccccctcttcaacacagattatgacatcctgaagagcaacctgcagaactgcagcaagttcagcgccatccagtgtgccgctgctgtgccccgggccccagctgagagcagcagcagcagcaagaagtttgagcagagccacctgcacatgagcagcgagacccaggccaacaatgagctgaccaccaatggacatggccccccagccagcaagcaggtgtcccagcagcccaagggcatcatgggcatgtttgccagcaaggctgctgccaagacccaggagaccaacaaggagaccaagacagaggccaaggaggtgaccaatgccagcgctgctggcaacaaggcccctggaaaaggaaacatgatgagcaacttcttcggcaaggccgccatgaacaagttcaaggtgaacctggacagcgagcaggccgtgaaggaggagaagatcaaggagaagaagaggtag

SEQ ID NO: 21266 - DNA, 1566 bp, Artificial Sequence
  Description of Artificial Sequence: Synthetic coding sequence
atgggagaggtggaggcccctggccgcctgtggctggagagccccccaggaggagccccacccatcttcctgcccagtgatggccaggccctggtgctgggccggggccccctgacccaggtgacagacaggaagtgcagcaggacccaggtggagctggtggccgaccctgagaccaggacagtggccgtgaagcagctgggcgtgaaccccagcaccaccggcacccaggagctgaagccaggcctggagggcagcctgggcgtgggggacaccctgtacctggtgaatggcctgcaccccctgaccctgcgctgggaggagaccaggaccccagagagccagcctgacaccccacctggcacccccctggtgtcccaggatgagaagagagatgctgagctgcccaagaagaggatgaggaagagcaaccctggctgggagaacctggagaagctgctggtgttcaccgctgctggggtgaagccccagggcaaggtggccggctttgacctggatggcaccctcatcaccaccaggtctgggaaggtgttccccaccggccccagcgactggaggatcctgtacccagagatccccaggaagctgcgggagctggaggccgagggctacaagctggtgatcttcaccaaccagatgagcatcggccggggcaagctgcctgctgaggagttcaaggccaaggtggaggccgtggtggagaagctgggcgtgcccttccaggtgctggtggccacccatgctggcctgtacaggaagcctgtgacaggcatgtgggaccacctgcaggagcaggccaatgatggcacccccatcagcattggagacagcatctttgtgggagatgctgctggccggcctgccaactgggcccctggcaggaagaagaaggacttcagctgtgccgaccggctgtttgccctgaacctgggcctgccctttgccaccccagaggagttcttcctgaagtggccagctgctggctttgagctgcctgcctttgaccccaggacagtgagccgcagcggccccctgtgcctgcctgagagccgggccctgctgagcgccagccctgaggtggtggtggccgtgggcttccctggggccggcaagagcaccttcctgaagaagcacctggtgtctgctggctacgtgcacgtgaacagagacaccctgggctcctggcagagatgtgtgaccacctgtgaaacagccctgaagcagggcaagagggtggccatcgacaacaccaacccagatgctgccagccgggcccgctacgtgcagtgtgcccgggctgctggggtgccctgccgctgcttcctgttcaccgccaccctggagcaggcccggcacaacaaccgcttccgggagatgacagacagcagccacatccctgtgtctgacatggtgatgtatggctacaggaagcagtttgaggcccccaccctggccgagggcttcagcgccatcctggagatccccttccggctgtgggtggagccccggctgggccgcctgtactgccagttcagcgagggctag

SEQ ID NO: 21267 - DNA, 699 bp, Artificial Sequence
  Description of Artificial Sequence: Synthetic coding sequence
atgctgggcgccatgttccgggccggcacccccatgccacccaacctgaacagccagggcggcggccactacttcatcgacagagatggcaaggccttccgccacatcctgaacttcctgcggctgggccgcctggacctgccccggggctatggagaaacagccctgctgcgggcagaggccgacttctaccagatccggcccctgctggatgccctgcgggagctggaggccagccagggcaccccagcccccacagctgccctgctgcacgcagatgtggatgtgagcccccggctggtgcacttcagcgcccggcggggcccccaccactatgagctgagctctgtgcaggtggacaccttccgggccaacctcttctgcacagattctgagtgcctgggcgccctgcgggccaggtttggagtggccagcggggacagagctgagggcagcccccacttccacctggagtgggcccccaggcctgtggagctgcctgaggtggagtatggccgcctgggcctgcagcccctgtggacaggaggccctggagagcggcgggaggtggtgggcacccccagcttcctggaggaggtgctgcgggtggccctggagcacggcttccggctggacagcgtcttcccagaccctgaggacctgctgaacagccgcagcctgcgctttgtgcgccactag

SEQ ID NO: 21268 - DNA, 5157 bp, Artificial Sequence
  Description of Artificial Sequence: Synthetic coding sequence
atgaaccagaacaccacagagcctgtggccgccacagagaccctggccgaggtgcctgagcacgtgctgcggggcctgcctgaggaggtgcggctcttccccagcgctgtggacaagacccgcatcggcgtgtgggccaccaagcccatcctgaagggcaagaagtttggcccctttgtgggggacaagaagaagaggagccaggtgaagaacaacgtgtacatgtgggaggtgtactaccccaacctgggctggatgtgcattgatgccacagatcctgagaagggcaactggctgcgctacgtgaactgggcctgcagcggggaggagcagaacctcttccccctggagatcaacagagccatctactacaagaccctgaagcccatcgcccctggagaggagctgctggtgtggtacaatggagaggacaaccctgagattgctgctgccatcgaggaggagcgggccagcgcccggagcaagaggagcagccccaagagcaggaagggcaagaagaagagccaggagaacaagaacaagggcaacaagatccaggacatccagctgaagaccagcgagccagacttcaccagcgccaacatgagggacagcgctgagggccccaaggaggatgaggagaagcccagcgccagcgccctggagcagcctgccaccctgcaggaggtggccagccaggaggtgcccccagagctggccaccccagccccagcctgggagccccagcctgagccagatgagcggctggaggccgccgcctgtgaggtgaatgacctgggggaggaggaggaggaggaggaggaggaggatgaggaggaggaggaggatgatgatgatgatgagctggaggatgaaggagaggaggaggcctccatgcccaatgaaaacagcgtgaaggagcctgagatccgctgtgatgagaagccagaggacctgctggaggagcccaagaccaccagcgaggagaccctggaggactgcagcgaggtgaccccagccatgcagatccccaggaccaaggaggaggccaatggagatgtgtttgagaccttcatgttcccctgccagcactgtgagaggaagttcaccaccaagcagggcctggagcggcacatgcacatccacatcagcacagtgaaccacgccttcaagtgcaagtactgcggcaaggccttcggcacccagatcaacagaagaagacatgagaggagacatgaggccggcctgaagaggaagcccagccagaccctgcagcccagcgaggacctggctgatggcaaggccagcggggagaatgtggccagcaaggatgacagcagcccccccagcctgggccctgactgcctgatcatgaacagcgagaaggccagccaggacaccatcaacagctctgtggtggaggagaatggagaggtgaaggagctgcacccctgcaagtactgcaagaaggtgtttggcacccacaccaacatgagaagacaccagaggagagtgcatgagcggcacctgatccccaagggcgtgcggaggaagggcggcctggaggagccccagcccccagctgagcaggcccaggccacccagaatgtgtatgtgcccagcacagagcctgaggaggagggggaggctgatgatgtgtacatcatggacatcagcagcaacatcagcgagaacctgaactactacattgatggcaagatccagaccaacaacaacaccagcaactgtgatgtgattgagatggagagcgccagcgctgacctgtatggcatcaactgcctgctgacccctgtgacagtggagatcacccagaacatcaagaccacccaggtgcctgtgacagaggacctgcccaaggagcccctgggcagcaccaacagcgaggccaagaagagaagaacagccagccccccagccctgcccaagatcaaggccgagacagacagcgaccccatggtgcccagctgcagcctgagcctgcccctgagcatcagcaccacagaggccgtgtccttccacaaggagaagtctgtgtacctgagcagcaagctgaagcagctgctgcagacccaggacaagctgaccccagctggcatcagcgccacagaaattgccaagctgggccctgtgtgtgtgtctgccccagcctccatgctgcctgtgaccagcagccgcttcaagaggaggaccagcagcccccccagcagcccccagcacagccctgccctgcgggactttgggaagcccagtgatggcaaggccgcctggacagatgctggcctgaccagcaagaagagcaagctggagagccacagcgacagccctgcctggagcctgagcggcagagatgagcgggagaccgtgtccccaccctgctttgatgagtacaagatgagcaaggagtggacagccagcagcgccttcagctctgtgtgcaaccagcagcccctggacctgagcagcggcgtgaagcagaaggccgagggcaccgggaagacccctgtgcagtgggagagcgtgctggacctgtctgtgcacaagaagcactgcagcgacagcgagggcaaggagttcaaggagagccacagcgtgcagcccacctgcagcgctgtgaagaagaggaagcccaccacctgcatgctgcagaaggtgctgctgaatgagtacaatggaattgacctgcctgtggagaacccagcagatggcaccaggagccccagcccctgcaagagcctggaggcccagcctgaccctgacctgggccctggcagcggcttccctgcccccaccgtggagagcaccccagatgtgtgccccagcagccctgccctgcagacccccagcctgagcagcggccagctgccccccctgctgatccccacagaccccagcagccccccaccctgcccccctgtgctgactgtggccaccccacctccacccctgctgcccaccgtgcccctgcctgcccccagcagcagcgccagcccccacccctgccccagccccctgagcaatgccacagcccagagccccctgcccatcctgagccccaccgtgagccccagccccagccccatcccccctgtggagcccctgatgtctgctgccagccctggcccccccaccctgagcagcagcagcagcagcagcagcagcagcagcagcttcagcagcagcagcagcagcagcagccccagccccccacccctgagcgccatcagctctgtggtgtcctctggggacaacctggaggccagcctgcccatgatctccttcaagcaggaggagctggagaatgaaggcctgaagccccgggaggagccccagagcgctgctgagcaggatgtggtggtgcaggagaccttcaacaagaactttgtgtgcaatgtgtgtgagagccccttcctgagcatcaaggacctgaccaagcacctgagcatccatgctgaggagtggcccttcaagtgtgagttctgtgtgcagctgttcaaggacaagacagacctgtctgagcaccgcttcctgctgcatggagtgggcaacatctttgtgtgcagcgtgtgcaagaaggagtttgccttcctgtgcaacctgcagcagcaccagagggacctgcacccagacaaggtgtgcacccaccacgagtttgagagcggcaccctgcggccccagaacttcacagaccccagcaaggcccacgtggagcacatgcagagcctgcctgaggaccccctggagaccagcaaggaggaggaggagctgaatgacagcagcgaggagctgtacaccaccatcaagatcatggccagcggcatcaagaccaaggaccctgatgtgcggctgggcctgaaccagcactaccccagcttcaagcccccacccttccagtaccaccacaggaaccccatgggcattggagtgacagccaccaacttcaccacccacaacatcccccagaccttcaccacagccatccgctgcaccaagtgtgggaagggcgtggacaacatgcctgagctgcacaagcacatcctggcctgtgccagcgccagtgacaagaagcgctacacccccaagaagaaccctgtgcccctgaagcagacagtgcagcccaagaatggagtggtggtgctggacaacagcggcaagaatgccttccggaggatgggccagcccaagaggctgaacttctctgtggagctgagcaagatgagcagcaacaagctgaagctgaatgccctgaagaagaagaaccagctggtgcagaaggccatcctgcagaagaacaagagcgccaagcagaaggctgacctgaagaatgcctgtgagagcagcagccacatctgcccctactgcaaccgggagttcacctacatcggcagcctgaacaagcacgccgccttcagctgccccaagaagcccctgagcccccccaagaagaaggtgagccacagcagcaagaagggcggccacagcagccctgccagcagtgacaagaacagcaacagcaaccacagaagaagaacagcagatgctgagatcaagatgcagagcatgcagacccccctgggcaagacccgggcccggagcagcggccccacccaggtgcccctgcccagcagcagcttccgcagcaagcagaatgtgaagtttgctgcctctgtgaagagcaagaagcccagcagcagcagcctgaggaacagcagccccatccgcatggccaagatcacccacgtggagggcaagaagcccaaggctgtggccaagaaccacagcgcccagctgagcagcaagaccagccgcagcctgcacgtgcgggtgcagaagagcaaggctgtgctgcagagcaagagcaccctggccagcaagaagaggacagaccgcttcaacatcaagagccgggagaggtctgggggccctgtgaccaggagcctgcagctggccgctgctgctgacctgtctgagaacaagagagaagatggcagcgccaagcaggagctgaaggacttctcctacagcctgcggctggccagccgctgcagccccccagctgccccctacatcacccggcagtacaggaaggtgaaggccccagctgctgcccagttccagggccccttcttcaaggagtag

SEQ ID NO: 21269 - DNA, 5049 bp, Artificial Sequence
  Description of Artificial Sequence: Synthetic coding sequence
atgaaccagaacaccacagagcctgtggccgccacagagaccctggccgaggtgcctgagcacgtgctgcggggcctgcctgaggaggtgcggctcttccccagcgctgtggacaagacccgcatcggcgtgtgggccaccaagcccatcctgaagggcaagaagtttggcccctttgtgggggacaagaagaagaggagccaggtgaagaacaacgtgtacatgtgggaggtgtactaccccaacctgggctggatgtgcattgatgccacagatcctgagaagggcaactggctgcgctacgtgaactgggcctgcagcggggaggagcagaacctcttccccctggagatcaacagagccatctactacaagaccctgaagcccatcgcccctggagaggagctgctggtgtggtacaatggagaggacaaccctgagattgctgctgccatcgaggaggagcgggccagcgcccggagcaagaggagcagccccaagagcaggaagggcaagaagaagagccaggagaacaagaacaagggcaacaagatccaggacatccagctgaagaccagcgagccagacttcaccagcgccaacatgagggacagcgctgagggccccaaggaggatgaggagaagcccagcgccagcgccctggagcagcctgccaccctgcaggaggtggccagccaggaggtgcccccagagctggccaccccagccccagcctgggagccccagcctgagccagatgagcggctggaggccgccgcctgtgaggtgaatgacctgggggaggaggaggaggaggaggaggaggaggatgaggaggaggaggaggatgatgatgatgatgagctggaggatgaaggagaggaggaggcctccatgcccaatgaaaacagcgtgaaggagcctgagatccgctgtgatgagaagccagaggacctgctggaggagcccaagaccaccagcgaggagaccctggaggactgcagcgaggtgaccccagccatgcagatccccaggaccaaggaggaggccaatggagatgtgtttgagaccttcatgttcccctgccagcactgtgagaggaagttcaccaccaagcagggcctggagcggcacatgcacatccacatcagcacagtgaaccacgccttcaagtgcaagtactgcggcaaggccttcggcacccagatcaacagaagaagacatgagaggagacatgaggccggcctgaagaggaagcccagccagaccctgcagcccagcgaggacctggctgatggcaaggccagcggggagaatgtggccagcaaggatgacagcagcccccccagcctgggccctgactgcctgatcatgaacagcgagaaggccagccaggacaccatcaacagctctgtggtggaggagaatggagaggtgaaggagctgcacccctgcaagtactgcaagaaggtgtttggcacccacaccaacatgagaagacaccagaggagagtgcatgagcggcacctgatccccaagggcgtgcggaggaagggcggcctggaggagccccagcccccagctgagcaggcccaggccacccagaatgtgtatgtgcccagcacagagcctgaggaggagggggaggctgatgatgtgtacatcatggacatcagcagcaacatcagcgagaacctgaactactacattgatggcaagatccagaccaacaacaacaccagcaactgtgatgtgattgagatggagagcgccagcgctgacctgtatggcatcaactgcctgctgacccctgtgacagtggagatcacccagaacatcaagaccacccaggtgcctgtgacagaggacctgcccaaggagcccctgggcagcaccaacagcgaggccaagaagagaagaacagccagccccccagccctgcccaagatcaaggccgagacagacagcgaccccatggtgcccagctgcagcctgagcctgcccctgagcatcagcaccacagaggccgtgtccttccacaaggagaagtctgtgtacctgagcagcaagctgaagcagctgctgcagacccaggacaagctgaccccagctggcatcagcgccacagaaattgccaagctgggccctgtgtgtgtgtctgccccagcctccatgctgcctgtgaccagcagccgcttcaagaggaggaccagcagcccccccagcagcccccagcacagccctgccctgcgggactttgggaagcccagtgatggcaaggccgcctggacagatgctggcctgaccagcaagaagagcaagctggagagccacagcgacagccctgcctggagcctgagcggcagagatgagcgggagaccgtgtccccaccctgctttgatgagtacaagatgagcaaggagtggacagccagcagcgccttcagctctgtgtgcaaccagcagcccctggacctgagcagcggcgtgaagcagaaggccgagggcaccgggaagacccctgtgcagtgggagagcgtgctggacctgtctgtgcacaagaagcactgcagcgacagcgagggcaaggagttcaaggagagccacagcgtgcagcccacctgcagcgctgtgaagaagaggaagcccaccacctgcatgctgcagaaggtgctgctgaatgagtacaatggaattgacctgcctgtggagaacccagcagatggcaccaggagccccagcccctgcaagagcctggaggcccagcctgaccctgacctgggccctggcagcggcttccctgcccccaccgtggagagcaccccagatgtgtgccccagcagccctgccctgcagacccccagcctgagcagcggccagctgccccccctgctgatccccacagaccccagcagccccccaccctgcccccctgtgctgactgtggccaccccacctccacccctgctgcccaccgtgcccctgcctgcccccagcagcagcgccagcccccacccctgccccagccccctgagcaatgccacagcccagagccccctgcccatcctgagccccaccgtgagccccagccccagccccatcccccctgtggagcccctgatgtctgctgccagccctggcccccccaccctgagcagcagcagcagcagcagcagcagcagcagcagcttcagcagcagcagcagcagcagcagccccagccccccacccctgagcgccatcagctctgtggtgtcctctggggacaacctggaggccagcctgcccatgatctccttcaagcaggaggagctggagaatgaaggcctgaagccccgggaggagccccagagcgctgctgagcaggatgtggtggtgcaggagaccttcaacaagaactttgtgtgcaatgtgtgtgagagccccttcctgagcatcaaggacctgaccaagcacctgagcatccatgctgaggagtggcccttcaagtgtgagttctgtgtgcagctgttcaaggacaagacagacctgtctgagcaccgcttcctgctgcatggagtgggcaacatctttgtgtgcagcgtgtgcaagaaggagtttgccttcctgtgcaacctgcagcagcaccagagggacctgcacccagacaaggtgtgcacccaccacgagtttgagagcggcaccctgcggccccagaacttcacagaccccagcaaggcccacgtggagcacatgcagagcctgcctgaggaccccctggagaccagcaaggaggaggaggagctgaatgacagcagcgaggagctgtacaccaccatcaagatcatggccagcggcatcaagaccaaggaccctgatgtgcggctgggcctgaaccagcactaccccagcttcaagcccccacccttccagtaccaccacaggaaccccatgggcattggagtgacagccaccaacttcaccacccacaacatcccccagaccttcaccacagccatccgctgcaccaagtgtgggaagggcgtggacaacatgcctgagctgcacaagcacatcctggcctgtgccagcgccagtgacaagaagcgctacacccccaagaagaaccctgtgcccctgaagcagacagtgcagcccaagaatggagtggtggtgctggacaacagcggcaagaatgccttccggaggatgggccagcccaagaggctgaacttctctgtggagctgagcaagatgagcagcaacaagctgaagctgaatgccctgaagaagaagaaccagctggtgcagaaggccatcctgcagaagaacaagagcgccaagcagaaggctgacctgaagaatgcctgtgagagcagcagccacatctgcccctactgcaaccgggagttcacctacatcggcagcctgaacaagcacgccgccttcagctgccccaagaagcccctgagcccccccaagaagaaggtgagccacagcagcaagaagggcggccacagcagccctgccagcagtgacaagaacagcaacagcaaccacagaagaagaacagcagatgctgagatcaagatgcagagcatgcagacccccctgggcaagacccgggcccggagcagcggccccacccaggtgcccctgcccagcagcagcttccgcagcaagcagaatgtgaagtttgctgcctctgtgaagagcaagaagcccagcagcagcagcctgaggaacagcagccccatccgcatggccaagatcacccacgtggagggcaagaagcccaaggctgtggccaagaaccacagcgcccagctgagcagcaagaccagccgcagcctgcacgtgcgggtgcagaagagcaaggctgtgctgcagagcaagagcaccctggccagcaagaagaggacagaccgcttcaacatcaagagccgggagaggtctgggggccctgtgaccaggagcctgcagctggccgctgctgctgacctgtctgagaacaagagagaagatggcagcgccaagcaggagctgaaggacttcaggaacttcctgtag

SEQ ID NO: 21270 - DNA, 4446 bp, Artificial Sequence
  Description of Artificial Sequence: Synthetic coding sequence
atgagggacagcgctgagggccccaaggaggatgaggagaagcccagcgccagcgccctggagcagcctgccaccctgcaggaggtggccagccaggaggtgcccccagagctggccaccccagccccagcctgggagccccagcctgagccagatgagcggctggaggccgccgcctgtgaggtgaatgacctgggggaggaggaggaggaggaggaggaggaggatgaggaggaggaggaggatgatgatgatgatgagctggaggatgaaggagaggaggaggcctccatgcccaatgaaaattctgtgaaggagcctgagatccgctgtgatgagaagccagaggacctgctggaggagcccaagaccaccagcgaggagaccctggaggactgcagcgaggtgaccccagccatgcagatccccaggaccaaggaggaggccaatggagatgtgtttgagaccttcatgttcccctgccagcactgtgagaggaagttcaccaccaagcagggcctggagcggcacatgcacatccacatcagcacagtgaaccacgccttcaagtgcaagtactgtgggaaggccttcggcacccagatcaacagaagaagacatgaaagaagacatgaagctggcctgaagaggaagcccagccagaccctgcagcccagcgaggacctggctgatggcaaggccagcggagaaaatgtggccagcaaggatgacagcagcccccccagcctgggccctgactgcctgatcatgaacagcgagaaggccagccaggacaccatcaacagctctgtggtggaggagaatggagaggtgaaggagctgcacccctgcaagtactgcaagaaggtgtttggcacccacaccaacatgaggaggcaccagaggagagtgcatgagcggcacctgatccccaagggcgtgagaagaaaaggaggcctggaggagccccagcccccagctgagcaggcccaggccacccagaatgtgtatgtgcccagcacagagcctgaggaggagggggaggctgatgatgtgtacatcatggacatcagcagcaacatcagcgagaacctgaactactacattgatggcaagatccagaccaacaacaacaccagcaactgtgatgtgattgagatggagagcgccagcgctgacctgtatggcatcaactgcctgctgacccctgtgacagtggagatcacccagaacatcaagaccacccaggtgcctgtgacagaggacctgcccaaggagcccctgggcagcaccaacagcgaggccaagaagagaagaacagccagccccccagccctgcccaagatcaaggccgagacagacagcgaccccatggtgcccagctgcagcctgagcctgcccctgagcatcagcaccacagaagctgtgtccttccacaaggagaagtctgtgtacctgagcagcaagctgaagcagctgctgcagacccaggacaagctgaccccagctggcatcagcgccacagagatcgccaagctgggccctgtgtgtgtgtctgccccagcctccatgctgcctgtgaccagcagccgcttcaagaggaggaccagcagcccccccagcagcccccagcacagccctgccctgcgggactttgggaagcccagtgatggcaaggccgcctggacagatgctggcctgaccagcaagaagagcaagctggagagccacagcgacagccctgcctggagcctgagcggcagagatgagcgggagaccgtgagccccccctgctttgatgagtacaagatgagcaaggagtggacagccagcagcgccttcagctctgtgtgcaaccagcagcccctggacctgagcagtggagtgaagcagaaggccgagggcaccgggaagacccctgtgcagtgggagagcgtgctggacctgtctgtgcacaagaagcactgcagcgacagcgagggcaaggagttcaaggagagccacagcgtgcagcccacctgcagcgctgtgaagaagaggaagcccaccacctgcatgctgcagaaggtgctgctgaatgagtacaacggcatcgacctgcctgtggagaacccagcagatggcaccaggagccccagcccctgcaagagcctggaggcccagcctgaccctgacctgggccctggcagcggcttccctgcccccaccgtggagagcaccccagatgtgtgccccagcagccctgccctgcagacccccagcctgagcagcggccagctgccccccctgctgatccccacagaccccagcagccccccaccctgcccccctgtgctgactgtggccaccccacctccacccctgctgcccaccgtgcccctgcctgcccccagcagcagcgccagcccccacccctgccccagccccctgagcaatgccacagcccagagccccctgcccatcctgagccccaccgtgagccccagccccagccccatcccccctgtggagcccctgatgtctgctgccagccctggcccccccaccctgagcagcagcagcagcagcagcagcagcagcagcagcttcagcagcagcagcagcagcagcagccccagccccccacccctgagcgccatcagctctgtggtgagcagcggggacaacctggaggccagcctgcccatgatctccttcaagcaggaggagctggagaatgaaggcctgaagccccgggaggagccccagagcgctgctgagcaggatgtggtggtgcaggagaccttcaacaagaactttgtgtgcaatgtgtgtgagagccccttcctgagcatcaaggacctgaccaagcacctgagcatccacgccgaggagtggcccttcaagtgtgagttctgtgtgcagctgttcaaggacaagacagacctgtctgagcaccgcttcctgctgcacggcgtgggcaacatctttgtgtgcagcgtgtgcaagaaggagtttgccttcctgtgcaacctgcagcagcaccagagggacctgcacccagacaaggtgtgcacccaccatgaatttgaaagtggcaccctgcggccccagaacttcacagaccccagcaaggcccacgtggagcacatgcagagcctgcctgaggaccccctggagaccagcaaggaggaggaggagctgaatgacagcagcgaggagctgtacaccaccatcaagatcatggccagcggcatcaagaccaaggaccctgatgtgcggctgggcctgaaccagcactaccccagcttcaagcccccacccttccagtaccaccacaggaaccccatgggcatcggcgtgacagccaccaacttcaccacccacaacatcccccagaccttcaccacagccatccgctgcaccaagtgtgggaaaggagtggacaacatgcctgagctgcacaagcacatcctggcctgtgccagcgccagtgacaagaagcgctacacccccaagaagaaccctgtgcccctgaagcagacagtgcagcccaagaatggagtggtggtgctggacaacagcggcaagaatgccttccggaggatgggccagcccaagaggctgaacttctctgtggagctgagcaagatgagcagcaacaagctgaagctgaatgccctgaagaagaagaaccagctggtgcagaaggccatcctgcagaagaacaagagcgccaagcagaaggctgacctgaagaatgcctgtgagagcagcagccacatctgcccctactgcaaccgggagttcacctacatcggcagcctgaacaagcatgctgccttcagctgccccaagaagcccctgagcccccccaagaagaaggtgagccacagcagcaagaagggcggccacagcagccctgccagcagtgacaagaacagcaacagcaaccacagaagaagaacagcagatgctgagatcaagatgcagagcatgcagacccccctgggcaagacccgggcccggagcagcggccccacccaggtgcccctgcccagcagcagcttccgcagcaagcagaatgtgaagtttgctgcctctgtgaagagcaagaagcccagcagcagcagcctgaggaacagcagccccatccgcatggccaagatcacccacgtggagggcaagaagcccaaggctgtggccaagaaccacagcgcccagctgagcagcaagaccagccgcagcctgcacgtgcgggtgcagaagagcaaggctgtgctgcagagcaagagcaccctggccagcaagaagaggacagaccgcttcaacatcaagagccgggagaggtctgggggccctgtgaccaggagcctgcagctggccgctgctgctgacctgtctgagaacaagcgggaggatggcagcgccaagcaggagctgaaggacttcaggaacttcctgtag

SEQ ID NO: 21271 - DNA, 681 bp, Artificial Sequence
  Description of Artificial Sequence: Synthetic coding sequence
atgaaccagaacaccacagagcctgtggccgccacagagaccctggccgaggtgcctgagcacgtgctgcggggcctgcctgaggaggtgcggctcttccccagcgctgtggacaagacccgcatcggcgtgtgggccaccaagcccatcctgaagggcaagaagtttggcccctttgtgggggacaagaagaagaggagccaggtgaagaacaacgtgtacatgtgggaggtgtactaccccaacctgggctggatgtgcattgatgccacagatcctgagaagggcaactggctgcgctacgtgaactgggcctgcagcggggaggagcagaacctcttccccctggagatcaacagagccatctactacaagaccctgaagcccatcgcccctggagaggagctgctggtgtggtacaatggagaggacaaccctgagattgctgctgccatcgaggaggagcgggccagcgcccggagcaagaggagcagccccaagagcaggaaggccacagccagcgcctggaggccagatgccctgcaccagaggcccaggaccagccctggcagcatcggccgcagcaagctgcagctgcagcccagcagccgggaccacagcagcaagagccgccacagcggctgcagcctgacagcccctgaggtgacctggaaccagtag

SEQ ID NO: 21272 - DNA, 5049 bp, Artificial Sequence
  Description of Artificial Sequence: Synthetic coding sequence
atgaaccagaacaccacagagcctgtggccgccacagagaccctggccgaggtgcctgagcacgtgctgcggggcctgcctgaggaggtgcggctcttccccagcgctgtggacaagacccgcatcggcgtgtgggccaccaagcccatcctgaagggcaagaagtttggcccctttgtgggggacaagaagaagaggagccaggtgaagaacaacgtgtacatgtgggaggtgtactaccccaacctgggctggatgtgcattgatgccacagatcctgagaagggcaactggctgcgctacgtgaactgggcctgcagcggggaggagcagaacctcttccccctggagatcaacagagccatctactacaagaccctgaagcccatcgcccctggagaggagctgctggtgtggtacaatggagaggacaaccctgagattgctgctgccatcgaggaggagcgggccagcgcccggagcaagaggagcagccccaagagcaggaagggcaagaagaagagccaggagaacaagaacaagggcaacaagatccaggacatccagctgaagaccagcgagccagacttcaccagcgccaacatgagggacagcgctgagggccccaaggaggatgaggagaagcccagcgccagcgccctggagcagcctgccaccctgcaggaggtggccagccaggaggtgcccccagagctggccaccccagccccagcctgggagccccagcctgagccagatgagcggctggaggccgccgcctgtgaggtgaatgacctgggggaggaggaggaggaggaggaggaggaggatgaggaggaggaggaggatgatgatgatgatgagctggaggatgaaggagaggaggaggcctccatgcccaatgaaaacagcgtgaaggagcctgagatccgctgtgatgagaagccagaggacctgctggaggagcccaagaccaccagcgaggagaccctggaggactgcagcgaggtgaccccagccatgcagatccccaggaccaaggaggaggccaatggagatgtgtttgagaccttcatgttcccctgccagcactgtgagaggaagttcaccaccaagcagggcctggagcggcacatgcacatccacatcagcacagtgaaccacgccttcaagtgcaagtactgcggcaaggccttcggcacccagatcaacagaagaagacatgagaggagacatgaggccggcctgaagaggaagcccagccagaccctgcagcccagcgaggacctggctgatggcaaggccagcggggagaatgtggccagcaaggatgacagcagcccccccagcctgggccctgactgcctgatcatgaacagcgagaaggccagccaggacaccatcaacagctctgtggtggaggagaatggagaggtgaaggagctgcacccctgcaagtactgcaagaaggtgtttggcacccacaccaacatgagaagacaccagaggagagtgcatgagcggcacctgatccccaagggcgtgcggaggaagggcggcctggaggagccccagcccccagctgagcaggcccaggccacccagaatgtgtatgtgcccagcacagagcctgaggaggagggggaggctgatgatgtgtacatcatggacatcagcagcaacatcagcgagaacctgaactactacattgatggcaagatccagaccaacaacaacaccagcaactgtgatgtgattgagatggagagcgccagcgctgacctgtatggcatcaactgcctgctgacccctgtgacagtggagatcacccagaacatcaagaccacccaggtgcctgtgacagaggacctgcccaaggagcccctgggcagcaccaacagcgaggccaagaagagaagaacagccagccccccagccctgcccaagatcaaggccgagacagacagcgaccccatggtgcccagctgcagcctgagcctgcccctgagcatcagcaccacagaggccgtgtccttccacaaggagaagtctgtgtacctgagcagcaagctgaagcagctgctgcagacccaggacaagctgaccccagctggcatcagcgccacagaaattgccaagctgggccctgtgtgtgtgtctgccccagcctccatgctgcctgtgaccagcagccgcttcaagaggaggaccagcagcccccccagcagcccccagcacagccctgccctgcgggactttgggaagcccagtgatggcaaggccgcctggacagatgctggcctgaccagcaagaagagcaagctggagagccacagcgacagccctgcctggagcctgagcggcagagatgagcgggagaccgtgtccccaccctgctttgatgagtacaagatgagcaaggagtggacagccagcagcgccttcagctctgtgtgcaaccagcagcccctggacctgagcagcggcgtgaagcagaaggccgagggcaccgggaagacccctgtgcagtgggagagcgtgctggacctgtctgtgcacaagaagcactgcagcgacagcgagggcaaggagttcaaggagagccacagcgtgcagcccacctgcagcgctgtgaagaagaggaagcccaccacctgcatgctgcagaaggtgctgctgaatgagtacaatggaattgacctgcctgtggagaacccagcagatggcaccaggagccccagcccctgcaagagcctggaggcccagcctgaccctgacctgggccctggcagcggcttccctgcccccaccgtggagagcaccccagatgtgtgccccagcagccctgccctgcagacccccagcctgagcagcggccagctgccccccctgctgatccccacagaccccagcagccccccaccctgcccccctgtgctgactgtggccaccccacctccacccctgctgcccaccgtgcccctgcctgcccccagcagcagcgccagcccccacccctgccccagccccctgagcaatgccacagcccagagccccctgcccatcctgagccccaccgtgagccccagccccagccccatcccccctgtggagcccctgatgtctgctgccagccctggcccccccaccctgagcagcagcagcagcagcagcagcagcagcagcagcttcagcagcagcagcagcagcagcagccccagccccccacccctgagcgccatcagctctgtggtgtcctctggggacaacctggaggccagcctgcccatgatctccttcaagcaggaggagctggagaatgaaggcctgaagccccgggaggagccccagagcgctgctgagcaggatgtggtggtgcaggagaccttcaacaagaactttgtgtgcaatgtgtgtgagagccccttcctgagcatcaaggacctgaccaagcacctgagcatccatgctgaggagtggcccttcaagtgtgagttctgtgtgcagctgttcaaggacaagacagacctgtctgagcaccgcttcctgctgcatggagtgggcaacatctttgtgtgcagcgtgtgcaagaaggagtttgccttcctgtgcaacctgcagcagcaccagagggacctgcacccagacaaggtgtgcacccaccacgagtttgagagcggcaccctgcggccccagaacttcacagaccccagcaaggcccacgtggagcacatgcagagcctgcctgaggaccccctggagaccagcaaggaggaggaggagctgaatgacagcagcgaggagctgtacaccaccatcaagatcatggccagcggcatcaagaccaaggaccctgatgtgcggctgggcctgaaccagcactaccccagcttcaagcccccacccttccagtaccaccacaggaaccccatgggcattggagtgacagccaccaacttcaccacccacaacatcccccagaccttcaccacagccatccgctgcaccaagtgtgggaagggcgtggacaacatgcctgagctgcacaagcacatcctggcctgtgccagcgccagtgacaagaagcgctacacccccaagaagaaccctgtgcccctgaagcagacagtgcagcccaagaatggagtggtggtgctggacaacagcggcaagaatgccttccggaggatgggccagcccaagaggctgaacttctctgtggagctgagcaagatgagcagcaacaagctgaagctgaatgccctgaagaagaagaaccagctggtgcagaaggccatcctgcagaagaacaagagcgccaagcagaaggctgacctgaagaatgcctgtgagagcagcagccacatctgcccctactgcaaccgggagttcacctacatcggcagcctgaacaagcacgccgccttcagctgccccaagaagcccctgagcccccccaagaagaaggtgagccacagcagcaagaagggcggccacagcagccctgccagcagtgacaagaacagcaacagcaaccacagaagaagaacagcagatgctgagatcaagatgcagagcatgcagacccccctgggcaagacccgggcccggagcagcggccccacccaggtgcccctgcccagcagcagcttccgcagcaagcagaatgtgaagtttgctgcctctgtgaagagcaagaagcccagcagcagcagcctgaggaacagcagccccatccgcatggccaagatcacccacgtggagggcaagaagcccaaggctgtggccaagaaccacagcgcccagctgagcagcaagaccagccgcagcctgcacgtgcgggtgcagaagagcaaggctgtgctgcagagcaagagcaccctggccagcaagaagaggacagaccgcttcaacatcaagagccgggagaggtctgggggccctgtgaccaggagcctgcagctggccgctgctgctgacctgtctgagaacaagagagaagatggcagcgccaagcaggagctgaaggacttccgctgcttcctgtag

SEQ ID NO: 21273 - DNA, 237 bp, Artificial Sequence
  Description of Artificial Sequence: Synthetic coding sequence
atgagggacagcgctgagggccccaaggaggatgaggagaagcccagcgccagcgccctggagcagcctgccaccctgcaggaggtggccagccaggaggtgcccccagagctggccaccccagccccagcctgggagccccagcctgagccagatgagcggctggaggccgccgcctgtgaggtgaatgacctgggggaggaggaggaggaggaggaggaggaggatgaggagtag

SEQ ID NO: 21274 - DNA, 4446 bp, Artificial Sequence; identical to SEQ ID NO: 21270
  Description of Artificial Sequence: Synthetic coding sequence

SEQ ID NO: 21275 - DNA, 675 bp, Artificial Sequence
  Description of Artificial Sequence: Synthetic coding sequence
atgagcagctactttgtgaacagcaccttccctgtgaccctggccagcggccaggagagcttcctgggccagctgcccctgtacagcagcggctatgctgaccccctgcggcactacccagccccctacggccctggccctggccaggacaagggctttgccaccagcagctactaccccccagctgggggcggctacggccgggccgccccctgtgactatggccctgccccagccttctaccgggagaaggagagcgcctgtgccctgtctggagcagatgagcagccccccttccaccctgagcccaggaagagtgactgtgcccaggacaagtctgtgtttggagaaacagaggagcagaagtgcagcacccctgtgtacccctggatgcagaggatgaacagctgcaacagcagcagctttggccccagcggcagaagaggccggcagacctacacccgctaccagaccctggagctggagaaggagttccactacaaccgctacctgaccaggagaagaagaattgaaattgcccacgccctgtgcctgacagagcggcagatcaagatctggttccagaacagaaggatgaagtggaagaaggagagcaagctgctgagcgccagccagctgtctgctgaggaggaggaggagaagcaggccgagtag

SEQ ID NO: 21276 - DNA, 2496 bp, Artificial Sequence
  Description of Artificial Sequence: Synthetic coding sequence
atgacagagctgaaggccaagggcccccgggcccctcatgtggccggcggcccccccagccctgaggtgggcagccccctgctgtgcaggcctgctgctggccccttccctggcagccagaccagtgacaccctgcctgaggtgtctgccatccccatcagcctggatggcctgctcttcccccggccctgccagggccaggaccccagtgatgagaagacccaggaccagcagagcctgagtgatgtggagggcgcctacagcagagctgaggccaccaggggggccggcggcagcagcagcagccccccagagaaggacagcggcctgctggacagcgtgctggacaccctgctggcccccagcggccctggccagagccagcccagccccccagcctgtgaggtgaccagctcctggtgcctgtttggacctgagctgcctgaagatcctcctgctgccccagccacccagagggtgctgagccccctgatgagccgcagcggctgcaaggtgggggacagcagcggcacagctgctgcccacaaggtgctgccccggggcctgagccctgcccggcagctgctgctgcctgccagcgagagcccccactggagcggggcccctgtgaagcccagcccccaggccgctgctgtggaggtggaggaggaggatggcagcgagagcgaggagagcgctggccccctgctgaagggcaagccccgggccctgggcggcgctgctgctgggggcggcgctgctgctgtgcccccaggagctgctgctgggggcgtggccctggtgcccaaggaggacagccgcttcagcgccccccgggtggccctggtggagcaggatgcccccatggcccctggccgcagccccctggccaccaccgtgatggacttcatccacgtgcccatcctgcccctgaaccacgccctgctggccgcccggacccggcagctgctggaggatgagagctatgatggaggagctggggccgccagcgcctttgccccacccaggagcagcccctgtgccagcagcacccctgtggccgtgggggacttcccagactgtgcctaccccccagatgctgagcccaaggatgatgcctaccccctgtacagcgacttccagcccccagccctgaagatcaaggaggaggaggagggcgctgaggccagcgcccggagccccaggagctacctggtggccggggccaacccagctgccttcccagacttccccctgggccccccaccacccctgcccccccgggccacccccagcaggcctggagaggccgctgtgacagctgccccagccagcgcctctgtgagcagcgccagcagcagcggcagcaccctggagtgcatcctgtacaaggccgagggcgccccaccccagcagggcccctttgcccccccaccctgcaaggcccctggggccagcggctgcctgctgcccagagatggcctgcccagcaccagcgccagcgctgctgctgctggagctgccccagccctgtacccagccctgggcctgaatggcctgccccagctgggctaccaggccgctgtgctgaaggagggcctgccccaggtgtacccaccctacctgaactacctgcggccagattctgaggccagccagagcccccagtacagctttgagagcctgccccagaagatctgcctgatctgtggagatgaggccagcggctgccactatggagtgctgacctgtggcagctgcaaggtgttcttcaagagggccatggagggccagcacaactacctgtgtgccggcagaaatgactgcatcgtggacaagatccggaggaagaactgcccagcctgccgcctgaggaagtgctgccaggccggcatggtgctgggcggcttcaggaacctgcacattgatgaccagatcaccctcatccagtacagctggatgagcctgatggtgtttggcctgggctggaggagctacaagcacgtgtctggccagatgctgtactttgccccagacctgatcctgaatgagcagaggatgaaggagagcagcttctacagcctgtgcctgaccatgtggcagatcccccaggagtttgtgaagctgcaggtgtcccaggaggagttcctgtgcatgaaggtgctgctgctgctgaacaccatccccctggagggcctgcggagccagacccagtttgaggagatgaggagcagctacatccgggagctgatcaaggccatcggcctgcggcagaagggcgtggtgagcagcagccagcgcttctaccagctgaccaagctgctggacaacctgcatgacctggtgaagcagctgcacctgtactgcctgaacaccttcatccagagccgggccctgtctgtggagttccctgagatgatgtctgaggtgattgctgcccagctgcccaagatcctggccggcatggtgaagcccctgctcttccacaagaagtag

SEQ ID NO: 21277 - DNA, 2802 bp, Artificial Sequence
  Description of Artificial Sequence: Synthetic coding sequence
atgacagagctgaaggccaagggcccccgggcccctcatgtggccggcggcccccccagccctgaggtgggcagccccctgctgtgcaggcctgctgctggccccttccctggcagccagaccagtgacaccctgcctgaggtgtctgccatccccatcagcctggatggcctgctcttcccccggccctgccagggccaggaccccagtgatgagaagacccaggaccagcagagcctgagtgatgtggagggcgcctacagcagagctgaggccaccaggggggccggcggcagcagcagcagccccccagagaaggacagcggcctgctggacagcgtgctggacaccctgctggcccccagcggccctggccagagccagcccagccccccagcctgtgaggtgaccagctcctggtgcctgtttggacctgagctgcctgaagatcctcctgctgccccagccacccagagggtgctgagccccctgatgagccgcagcggctgcaaggtgggggacagcagcggcacagctgctgcccacaaggtgctgccccggggcctgagccctgcccggcagctgctgctgcctgccagcgagagcccccactggagcggggcccctgtgaagcccagcccccaggccgctgctgtggaggtggaggaggaggatggcagcgagagcgaggagagcgctggccccctgctgaagggcaagccccgggccctgggcggcgctgctgctgggggcggcgctgctgctgtgcccccaggagctgctgctgggggcgtggccctggtgcccaaggaggacagccgcttcagcgccccccgggtggccctggtggagcaggatgcccccatggcccctggccgcagccccctggccaccaccgtgatggacttcatccacgtgcccatcctgcccctgaaccacgccctgctggccgcccggacccggcagctgctggaggatgagagctatgatggaggagctggggccgccagcgcctttgccccacccaggagcagcccctgtgccagcagcacccctgtggccgtgggggacttcccagactgtgcctaccccccagatgctgagcccaaggatgatgcctaccccctgtacagcgacttccagcccccagccctgaagatcaaggaggaggaggagggcgctgaggccagcgcccggagccccaggagctacctggtggccggggccaacccagctgccttcccagacttccccctgggccccccaccacccctgcccccccgggccacccccagcaggcctggagaggccgctgtgacagctgccccagccagcgcctctgtgagcagcgccagcagcagcggcagcaccctggagtgcatcctgtacaaggccgagggcgccccaccccagcagggcccctttgcccccccaccctgcaaggcccctggggccagcggctgcctgctgcccagagatggcctgcccagcaccagcgccagcgctgctgctgctggagctgccccagccctgtacccagccctgggcctgaatggcctgccccagctgggctaccaggccgctgtgctgaaggagggcctgccccaggtgtacccaccctacctgaactacctgcggccagattctgaggccagccagagcccccagtacagctttgagagcctgccccagaagatctgcctgatctgtggagatgaggccagcggctgccactatggagtgctgacctgtggcagctgcaaggtgttcttcaagagggccatggagggccagcacaactacctgtgtgccggcagaaatgactgcatcgtggacaagatccggaggaagaactgcccagcctgccgcctgaggaagtgctgccaggccggcatggtgctgggcggcaggaagttcaagaagttcaacaaggtgcgggtggtgcgggccctggatgctgtggccctgccccagcctgtgggcgtgcccaatgaaagccaggccctgagccagcgcttcaccttcagccctggccaggacatccagctgatccccccactcatcaacctgctgatgagcattgaaccagatgtgatctatgccggccatgacaacaccaagccagacaccagcagcagcctgctgaccagcctgaaccagctgggggagcggcagctgctgtctgtggtgaagtggagcaagagcctgcccggcttcaggaacctgcacattgatgaccagatcaccctcatccagtacagctggatgagcctgatggtgtttggcctgggctggaggagctacaagcacgtgtctggccagatgctgtactttgccccagacctgatcctgaatgagcagaggatgaaggagagcagcttctacagcctgtgcctgaccatgtggcagatcccccaggagtttgtgaagctgcaggtgtcccaggaggagttcctgtgcatgaaggtgctgctgctgctgaacaccatccccctggagggcctgcggagccagacccagtttgaggagatgaggagcagctacatccgggagctgatcaaggccatcggcctgcggcagaagggcgtggtgagcagcagccagcgcttctaccagctgaccaagctgctggacaacctgcatgacctggtgaagcagctgcacctgtactgcctgaacaccttcatccagagccgggccctgtctgtggagttccctgagatgatgtctgaggtgattgctgcccagctgcccaagatcctggccggcatggtgaagcccctgctcttccacaagaagtag

SEQ ID NO: 21278 - DNA, 2088 bp, Artificial Sequence
  Description of Artificial Sequence: Synthetic coding sequence
atgacagagctgaaggccaagggcccccgggcccctcatgtggccggcggcccccccagccctgaggtgggcagccccctgctgtgcaggcctgctgctggccccttccctggcagccagaccagtgacaccctgcctgaggtgtctgccatccccatcagcctggatggcctgctcttcccccggccctgccagggccaggaccccagtgatgagaagacccaggaccagcagagcctgagtgatgtggagggcgcctacagcagagctgaggccaccaggggggccggcggcagcagcagcagccccccagagaaggacagcggcctgctggacagcgtgctggacaccctgctggcccccagcggccctggccagagccagcccagccccccagcctgtgaggtgaccagctcctggtgcctgtttggacctgagctgcctgaagatcctcctgctgccccagccacccagagggtgctgagccccctgatgagccgcagcggctgcaaggtgggggacagcagcggcacagctgctgcccacaaggtgctgccccggggcctgagccctgcccggcagctgctgctgcctgccagcgagagcccccactggagcggggcccctgtgaagcccagcccccaggccgctgctgtggaggtggaggaggaggatggcagcgagagcgaggagagcgctggccccctgctgaagggcaagccccgggccctgggcggcgctgctgctgggggcggcgctgctgctgtgcccccaggagctgctgctgggggcgtggccctggtgcccaaggaggacagccgcttcagcgccccccgggtggccctggtggagcaggatgcccccatggcccctggccgcagccccctggccaccaccgtgatggacttcatccacgtgcccatcctgcccctgaaccacgccctgctggccgcccggacccggcagctgctggaggatgagagctatgatggaggagctggggccgccagcgcctttgccccacccaggagcagcccctgtgccagcagcacccctgtggccgtgggggacttcccagactgtgcctaccccccagatgctgagcccaaggatgatgcctaccccctgtacagcgacttccagcccccagccctgaagatcaaggaggaggaggagggcgctgaggccagcgcccggagccccaggagctacctggtggccggggccaacccagctgccttcccagacttccccctgggccccccaccacccctgcccccccgggccacccccagcaggcctggagaggccgctgtgacagctgccccagccagcgcctctgtgagcagcgccagcagcagcggcagcaccctggagtgcatcctgtacaaggccgagggcgccccaccccagcagggcccctttgcccccccaccctgcaaggcccctggggccagcggctgcctgctgcccagagatggcctgcccagcaccagcgccagcgctgctgctgctggagctgccccagccctgtacccagccctgggcctgaatggcctgccccagctgggctaccaggccgctgtgctgaaggagggcctgccccaggtgtacccaccctacctgaactacctgcggccagattctgaggccagccagagcccccagtacagctttgagagcctgccccagaagatctgcctgatctgtggagatgaggccagcggctgccactatggagtgctgacctgtggcagctgcaaggtgttcttcaagagggccatggagggccagcacaactacctgtgtgccggcagaaatgactgcatcgtggacaagatccggaggaagaactgcccagcctgccgcctgaggaagtgctgccaggccggcatggtgctgggcggcttcaggaacctgcacattgatgaccagatcaccctcatccagtacagctggatgagcctgatggtgtttggcctgggctggaggagctacaagcacgtgtctggccagatgctgtactttgccccagacctgatcctgaatgacagctttggccgggccaccaagagcaaccctgtgtag

SEQ ID NO: 21279 - DNA, 2295 bp, Artificial Sequence
  Description of Artificial Sequence: Synthetic coding sequence
atgacagagctgaaggccaagggcccccgggcccctcatgtggccggcggcccccccagccctgaggtgggcagccccctgctgtgcaggcctgctgctggccccttccctggcagccagaccagtgacaccctgcctgaggtgtctgccatccccatcagcctggatggcctgctcttcccccggccctgccagggccaggaccccagtgatgagaagacccaggaccagcagagcctgagtgatgtggagggcgcctacagcagagctgaggccaccaggggggccggcggcagcagcagcagccccccagagaaggacagcggcctgctggacagcgtgctggacaccctgctggcccccagcggccctggccagagccagcccagccccccagcctgtgaggtgaccagctcctggtgcctgtttggacctgagctgcctgaagatcctcctgctgccccagccacccagagggtgctgagccccctgatgagccgcagcggctgcaaggtgggggacagcagcggcacagctgctgcccacaaggtgctgccccggggcctgagccctgcccggcagctgctgctgcctgccagcgagagcccccactggagcggggcccctgtgaagcccagcccccaggccgctgctgtggaggtggaggaggaggatggcagcgagagcgaggagagcgctggccccctgctgaagggcaagccccgggccctgggcggcgctgctgctgggggcggcgctgctgctgtgcccccaggagctgctgctgggggcgtggccctggtgcccaaggaggacagccgcttcagcgccccccgggtggccctggtggagcaggatgcccccatggcccctggccgcagccccctggccaccaccgtgatggacttcatccacgtgcccatcctgcccctgaaccacgccctgctggccgcccggacccggcagctgctggaggatgagagctatgatggaggagctggggccgccagcgcctttgccccacccaggagcagcccctgtgccagcagcacccctgtggccgtgggggacttcccagactgtgcctaccccccagatgctgagcccaaggatgatgcctaccccctgtacagcgacttccagcccccagccctgaagatcaaggaggaggaggagggcgctgaggccagcgcccggagccccaggagctacctggtggccggggccaacccagctgccttcccagacttccccctgggccccccaccacccctgcccccccgggccacccccagcaggcctggagaggccgctgtgacagctgccccagccagcgcctctgtgagcagcgccagcagcagcggcagcaccctggagtgcatcctgtacaaggccgagggcgccccaccccagcagggcccctttgcccccccaccctgcaaggcccctggggccagcggctgcctgctgcccagagatggcctgcccagcaccagcgccagcgctgctgctgctggagctgccccagccctgtacccagccctgggcctgaatggcctgccccagctgggctaccaggccgctgtgctgaaggagggcctgccccaggtgtacccaccctacctgaactacctgcggccagattctgaggccagccagagcccccagtacagctttgagagcctgccccagaagatctgcctgatctgtggagatgaggccagcggctgccactatggagtgctgacctgtggcagctgcaaggtgttcttcaagagggccatggagggcaggaagttcaagaagttcaacaaggtgcgggtggtgcgggccctggatgctgtggccctgccccagcctgtgggcgtgcccaatgaaagccaggccctgagccagcgcttcaccttcagccctggccaggacatccagctgatccccccactcatcaacctgctgatgagcattgaaccagatgtgatctatgccggccatgacaacaccaagccagacaccagcagcagcctgctgaccagcctgaaccagctgggggagcggcagctgctgtctgtggtgaagtggagcaagagcctgcccggcttcaggaacctgcacattgatgaccagatcaccctcatccagtacagctggatgagcctgatggtgtttggcctgggctggaggagctacaagcacgtgtctggccagatgctgtactttgccccagacctgatcctgaatgaaagccacaggagcctgagcagcttcaagctggccaagaagagcagctctgtgtag

SEQ ID NO: 21280 - DNA, 1020 bp, Artificial Sequence
  Description of Artificial Sequence: Synthetic coding sequence
atggagggccagcacaactacctgtgtgccggcagaaatgactgcatcgtggacaagatccggaggaagaactgcccagcctgccgcctgaggaagtgctgccaggccggcatggtgctgggcggcaggaagttcaagaagttcaacaaggtgcgggtggtgcgggccctggatgctgtggccctgccccagcctgtgggcgtgcccaatgaaagccaggccctgagccagcgcttcaccttcagccctggccaggacatccagctgatccccccactcatcaacctgctgatgagcattgaaccagatgtgatctatgccggccatgacaacaccaagccagacaccagcagcagcctgctgaccagcctgaaccagctgggggagcggcagctgctgtctgtggtgaagtggagcaagagcctgcccggcttcaggaacctgcacattgatgaccagatcaccctcatccagtacagctggatgagcctgatggtgtttggcctgggctggaggagctacaagcacgtgtctggccagatgctgtactttgccccagacctgatcctgaatgagcagaggatgaaggagagcagcttctacagcctgtgcctgaccatgtggcagatcccccaggagtttgtgaagctgcaggtgtcccaggaggagttcctgtgcatgaaggtgctgctgctgctgaacaccatccccctggagggcctgcggagccagacccagtttgaggagatgaggagcagctacatccgggagctgatcaaggccatcggcctgcggcagaagggcgtggtgagcagcagccagcgcttctaccagctgaccaagctgctggacaacctgcatgacctggtgaagcagctgcacctgtactgcctgaacaccttcatccagagccgggccctgtctgtggagttccctgagatgatgtctgaggtgattgctgcccagctgcccaagatcctggccggcatggtgaagcccctgctcttccacaagaagtag

SEQ ID NO: 21281 - DNA, 2412 bp, Artificial Sequence
  Description of Artificial Sequence: Synthetic coding sequence
atgacagagctgaaggccaagggcccccgggcccctcatgtggccggcggcccccccagccctgaggtgggcagccccctgctgtgcaggcctgctgctggccccttccctggcagccagaccagtgacaccctgcctgaggtgtctgccatccccatcagcctggatggcctgctcttcccccggccctgccagggccaggaccccagtgatgagaagacccaggaccagcagagcctgagtgatgtggagggcgcctacagcagagctgaggccaccaggggggccggcggcagcagcagcagccccccagagaaggacagcggcctgctggacagcgtgctggacaccctgctggcccccagcggccctggccagagccagcccagccccccagcctgtgaggtgaccagctcctggtgcctgtttggacctgagctgcctgaagatcctcctgctgccccagccacccagagggtgctgagccccctgatgagccgcagcggctgcaaggtgggggacagcagcggcacagctgctgcccacaaggtgctgccccggggcctgagccctgcccggcagctgctgctgcctgccagcgagagcccccactggagcggggcccctgtgaagcccagcccccaggccgctgctgtggaggtggaggaggaggatggcagcgagagcgaggagagcgctggccccctgctgaagggcaagccccgggccctgggcggcgctgctgctgggggcggcgctgctgctgtgcccccaggagctgctgctgggggcgtggccctggtgcccaaggaggacagccgcttcagcgccccccgggtggccctggtggagcaggatgcccccatggcccctggccgcagccccctggccaccaccgtgatggacttcatccacgtgcccatcctgcccctgaaccacgccctgctggccgcccggacccggcagctgctggaggatgagagctatgatggaggagctggggccgccagcgcctttgccccacccaggagcagcccctgtgccagcagcacccctgtggccgtgggggacttcccagactgtgcctaccccccagatgctgagcccaaggatgatgcctaccccctgtacagcgacttccagcccccagccctgaagatcaaggaggaggaggagggcgctgaggccagcgcccggagccccaggagctacctggtggccggggccaacccagctgccttcccagacttccccctgggccccccaccacccctgcccccccgggccacccccagcaggcctggagaggccgctgtgacagctgccccagccagcgcctctgtgagcagcgccagcagcagcggcagcaccctggagtgcatcctgtacaaggccgagggcgccccaccccagcagggcccctttgcccccccaccctgcaaggcccctggggccagcggctgcctgctgcccagagatggcctgcccagcaccagcgccagcgctgctgctgctggagctgccccagccctgtacccagccctgggcctgaatggcctgccccagctgggctaccaggccgctgtgctgaaggagggcctgccccaggtgtacccaccctacctgaactacctgcggccagattctgaggccagccagagcccccagtacagctttgagagcctgccccagaagatctgcctgatctgtggagatgaggccagcggctgccactatggagtgctgacctgtggcagctgcaaggtgttcttcaagagggccatggagggccagcacaactacctgtgtgccggcagaaatgactgcatcgtggacaagatccggaggaagaactgcccagcctgccgcctgaggaagtgctgccaggccggcatggtgctgggcggcaggaagttcaagaagttcaacaaggtgcgggtggtgcgggccctggatgctgtggccctgccccagcctgtgggcgtgcccaatgaaagccaggccctgagccagcgcttcaccttcagccctggccaggacatccagctgatccccccactcatcaacctgctgatgagcattgaaccagatgtgatctatgccggccatgacaacaccaagccagacaccagcagcagcctgctgaccagcctgaaccagctgggggagcggcagctgctgtctgtggtgaagtggagcaagagcctgcccggcttcaggaacctgcacattgatgaccagatcaccctcatccagtacagctggatgagcctgatggtgtttggcctgggctggaggagctacaagcacgtgtctggccagatgctgtactttgccccagacctgatcctgaatgaaagccacaggagcctgagcagcttcaagctggccaagaagagcagctctgtgtag

SEQ ID NO: 21282 - DNA, 2073 bp, Artificial Sequence
  Description of Artificial Sequence: Synthetic coding sequence
atgacagagctgaaggccaagggcccccgggcccctcatgtggccggcggcccccccagccctgaggtgggcagccccctgctgtgcaggcctgctgctggccccttccctggcagccagaccagtgacaccctgcctgaggtgtctgccatccccatcagcctggatggcctgctcttcccccggccctgccagggccaggaccccagtgatgagaagacccaggaccagcagagcctgagtgatgtggagggcgcctacagcagagctgaggccaccaggggggccggcggcagcagcagcagccccccagagaaggacagcggcctgctggacagcgtgctggacaccctgctggcccccagcggccctggccagagccagcccagccccccagcctgtgaggtgaccagctcctggtgcctgtttggacctgagctgcctgaagatcctcctgctgccccagccacccagagggtgctgagccccctgatgagccgcagcggctgcaaggtgggggacagcagcggcacagctgctgcccacaaggtgctgccccggggcctgagccctgcccggcagctgctgctgcctgccagcgagagcccccactggagcggggcccctgtgaagcccagcccccaggccgctgctgtggaggtggaggaggaggatggcagcgagagcgaggagagcgctggccccctgctgaagggcaagccccgggccctgggcggcgctgctgctgggggcggcgctgctgctgtgcccccaggagctgctgctgggggcgtggccctggtgcccaaggaggacagccgcttcagcgccccccgggtggccctggtggagcaggatgcccccatggcccctggccgcagccccctggccaccaccgtgatggacttcatccacgtgcccatcctgcccctgaaccacgccctgctggccgcccggacccggcagctgctggaggatgagagctatgatggaggagctggggccgccagcgcctttgccccacccaggagcagcccctgtgccagcagcacccctgtggccgtgggggacttcccagactgtgcctaccccccagatgctgagcccaaggatgatgcctaccccctgtacagcgacttccagcccccagccctgaagatcaaggaggaggaggagggcgctgaggccagcgcccggagccccaggagctacctggtggccggggccaacccagctgccttcccagacttccccctgggccccccaccacccctgcccccccgggccacccccagcaggcctggagaggccgctgtgacagctgccccagccagcgcctctgtgagcagcgccagcagcagcggcagcaccctggagtgcatcctgtacaaggccgagggcgccccaccccagcagggcccctttgcccccccaccctgcaaggcccctggggccagcggctgcctgctgcccagagatggcctgcccagcaccagcgccagcgctgctgctgctggagctgccccagccctgtacccagccctgggcctgaatggcctgccccagctgggctaccaggccgctgtgctgaaggagggcctgccccaggtgtacccaccctacctgaactacctgcggccagattctgaggccagccagagcccccagtacagctttgagagcctgccccagaagatctgcctgatctgtggagatgaggccagcggctgccactatggagtgctgacctgtggcagctgcaaggtgttcttcaagagggccatggagggccagcacaactacctgtgtgccggcagaaatgactgcatcgtggacaagatccggaggaagaactgcccagcctgccgcctgaggaagtgctgccaggccggcatggtgctgggcggcttcaggaacctgcacattgatgaccagatcaccctcatccagtacagctggatgagcctgatggtgtttggcctgggctggaggagctacaagcacgtgtctggccagatgctgtactttgccccagacctgatcctgaatgaggagagcatcgtgaccagctag

SEQ ID NO: 21283 - DNA, 1410 bp, Artificial Sequence
  Description of Artificial Sequence: Synthetic coding sequence
atggatgtggagaatgagcagatcctgaatgtgaacccagctgaccctgacaacctgagtgacagcctcttctctggagatgaagaaaatgccggcacagaggagatcaagaatgagatcaatggaaactggatcagcgccagcagcatcaatgaggcccgcatcaatgccaaggccaagaggcggctgaggaagaacagcagccgggacagcggccgcggggacagcgtgtctgacagcggcagtgatgccctgcggagcggcctgactgtgcccaccagccccaagggccgcctgctggaccggcgcagccgcagcggcaagggccggggcctgcccaagaagggcggggccggcggcaaaggagtgtggggcaccccaggccaggtgtatgatgtggaggaggtggatgtgaaggaccccaactatgatgatgaccaggagaactgtgtgtatgagaccgtggtgctgcccctggatgagcgggcctttgagaagaccctgacccccatcatccaggagtactttgagcacggggacaccaatgaggtggccgagatgctgcgggacctgaacctgggggagatgaagagcggcgtgcctgtgctggccgtgtccctggccctggagggcaaggccagccaccgggagatgaccagcaagctgctgagtgacctgtgtggcaccgtgatgagcaccacagatgtggagaagagctttgacaagctgctgaaggacctgcctgagctggccctggacaccccccgggccccccagctggtgggccagttcatcgcccgggctgtgggagatggcatcctgtgcaacacctacatcgacagctacaagggcaccgtggactgtgtgcaggcccgggccgccctggacaaggccaccgtgctgctgtccatgagcaagggcggcaagaggaaggacagcgtgtggggcagcggcggcggccagcagagcgtgaaccacctggtgaaggagattgacatgctgctgaaggagtacctgctgagcggggacatcagcgaggccgagcactgcctgaaggagctggaggtgccccacttccaccacgagctggtgtatgaggccatcatcatggtgctggagagcactggagagagcaccttcaagatgatcctggacctgctgaagagcctgtggaagagcagcaccatcaccgtggaccagatgaagaggggctatgagcgcatctacaatgagatcccagacatcaacctggatgtgccccacagctacagcgtgctggagagatttgtggaggagtgcttccaggccggcatcatcagcaagcagctgcgggacctgtgccccagccggggcaggaagagatttgtgtctgaaggagatggcggccgcctgaagccagagagctactag

SEQ ID NO: 21284 - DNA, 1377 bp, Artificial Sequence
  Description of Artificial Sequence: Synthetic coding sequence
atgaccaagtacccagacaacctgagtgacagcctcttctctggagatgaggagaatgccggcacagaggagatcaagaatgagatcaatggaaactggatcagcgccagcagcatcaatgaggcccgcatcaatgccaaggccaagaggcggctgaggaagaacagcagccgggacagcggccgcggggacagcgtgtctgattctggcagtgatgccctgcggagcggcctgactgtgcccaccagccccaagggccgcctgctggacagaagaagccgcagcggcaagggccggggcctgcccaagaagggcggggccggcggcaagggcgtgtggggcaccccaggccaggtgtatgatgtggaggaggtggatgtgaaggaccccaactatgatgatgaccaggagaactgtgtgtatgaaacagtggtgctgcccctggatgagcgggcctttgagaagaccctgacccccatcatccaggagtactttgaacatggagacaccaatgaggtggccgagatgctgcgggacctgaacctgggggagatgaagtctggagtgcctgtgctggccgtgtccctggccctggagggcaaggccagccaccgggagatgaccagcaagctgctgagtgacctgtgtggcaccgtgatgagcaccacagatgtggagaagagctttgacaagctgctgaaggacctgcctgagctggccctggacaccccccgggccccccagctggtgggccagttcatcgcccgggctgtgggagatggcatcctgtgcaacacctacatcgacagctacaagggcaccgtggactgtgtgcaggcccgggccgccctggacaaggccaccgtgctgctgtccatgagcaaaggaggcaagaggaaggacagcgtgtggggcagcggcggcggccagcagagcgtgaaccacctggtgaaggagattgacatgctgctgaaggagtacctgctgagcggggacatcagcgaggccgagcactgcctgaaggagctggaggtgccccacttccaccacgagctggtgtatgaggccatcatcatggtgctggagagcactggagagagcaccttcaagatgatcctggacctgctgaagagcctgtggaagagcagcaccatcaccgtggaccagatgaagaggggctatgaaagaatctacaatgagatcccagacatcaacctggatgtgccccacagctacagcgtgctggagagatttgtggaggagtgcttccaggccggcatcatcagcaagcagctgcgggacctgtgccccagccggggcaggaagagatttgtgtctgaaggagatggcggccgcctgaagccagagagctactag

SEQ ID NO: 21285 - DNA, 696 bp, Artificial Sequence
  Description of Artificial Sequence: Synthetic coding sequence
atggatgtggagaatgagcagatcctgaatgtgaacccagcagaaaatgccggcacagaggagatcaagaatgagatcaatggaaactggatcagcgccagcagcatcaatgaggcccgcatcaatgccaaggccaagaggcggctgaggaagaacagcagccgggacagcggccgcggggacagcgtgtctgacagcggcagtgatgccctgcggagcggcctgactgtgcccaccagccccaagggccgcctgctggaccggcgcagccgcagcggcaagggccggggcctgcccaagaagggcggggccggcggcaaaggagtgtggggcaccccaggccaggtgtatgatgtggaggaggtggatgtgaaggaccccaactatgatgatgaccaggagaactgtgtgtatgagaccgtggtgctgcccctggatgagcgggcctttgagaagaccctgacccccatcatccaggagtactttgagcacggggacaccaatgaggtggccgagatgctgcgggacctgaacctgggggagatgaagagcggcgtgcctgtgctggccgtgtccctggccctggagggcaaggccagccaccgggagatgaccagcaagctgctgagtgacctgtgtggcaccgtgatgagcaccacagatgtggagaagagctttgacaagctgctgaagtag

SEQ ID NO: 21286 - DNA, 786 bp, Artificial Sequence
  Description of Artificial Sequence: Synthetic coding sequence
atgtttgaggcccggctggtgcagggcagcatcctgaagaaggtgctggaggccctgaaggacctgatcaatgaggcctgctgggacatcagcagcagtggagtgaacctgcagagcatggacagcagccacgtgtccctggtgcagctgaccctgcggtctgagggctttgacacctaccgctgtgacaggaacctggccatgggcgtgaacctgacctccatgagcaagatcctgaagtgtgctggaaatgaagacatcatcaccctgcgggcagaagataatgctgacaccctggccctggtgtttgaggcccccaaccaggagaaggtgtctgactatgagatgaagctgatggacctggatgtggagcagctgggcatccctgagcaggagtacagctgtgtggtgaagatgcccagcggggagtttgcccgcatctgccgggacctgagccacatcggagatgctgtggtgatcagctgtgccaaggatggagtgaagttcagcgccagcggggagctgggcaatggaaacatcaagctgagccagaccagcaatgtggacaaggaggaggaggccgtgaccatcgagatgaatgaacctgtgcagctgacctttgccctgcgctacctgaacttcttcaccaaggccacccccctgagcagcacagtgaccctgtccatgtctgcagatgtgcccctggtggtggagtacaagattgctgacatgggccacctgaagtactacctggcccccaagattgaagatgaggagggcagctag

SEQ ID NO: 21287 - DNA, 786 bp, Artificial Sequence; identical to SEQ ID NO: 21286
  Description of Artificial Sequence: Synthetic coding sequence

SEQ ID NO: 21288 - DNA, 1140 bp, Artificial Sequence
  Description of Artificial Sequence: Synthetic coding sequence
atgagcagccccagcctgagtgacctgggcaagcgggagcctgctgctgctgctgatgagcggggcacccagcagaggcgggcctgtgccaatgccacctggaacagcatccacaatggagtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgagggccagaagctgctggacagcctggccgagacctgggacttcttcttcagtgatgtgctgcccatgctgcaggccatcttctaccctgtgcagggcaaggagcccagcgtgcggcagctggccctgctgcacttcagaaatgccatcaccctgtctgtgaagctggaggatgccctggcccgggcccacgcccgggtgcccccagccatcgtgcagatgctgctggtgctgcagggcgtgcatgagagcagaggagtgacagaggactacctgcggctggagaccctggtgcagaaggtggtgagcccctacctgggcacctacggcctgcacagcagcgagggccccttcacccacagctgcatcctggagaagaggctgctgcggcgcagccgctctggagatgtgctggccaagaaccctgtggtgcgcagcaagagctacaacacccccctgctgaaccctgtgcaggagcatgaagctgagggcgctgctgctgggggcaccagcatccgccgccacagcgtgtctgagatgaccagctgcccagagccccagggcttcagtgaccccccaggccagggccccaccggcaccttccgcagcagccctgccccccacagcggcccctgccccagccggctgtaccccaccacccagcccccagagcagggcctggaccccaccaggagcagcctgcccaggagcagccctgagaacctggtggaccagatcctggagagcgtggacagcgacagcgagggcatcttcatcgactttggccggggccggggcagcggcatgtctgacctggagggcagcggcggccggcagagcgtggtgtag

SEQ ID NO: 21289 - DNA, 1167 bp, Artificial Sequence
  Description of Artificial Sequence: Synthetic coding sequence
atgaggaccctgcggcggctgaagttcatgagcagccccagcctgagtgacctgggcaagcgggagcctgctgctgctgctgatgagcggggcacccagcagaggcgggcctgtgccaatgccacctggaacagcatccacaacggggtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgagggccagaagctgctggacagcctggccgagacctgggacttcttcttcagtgatgtgctgcccatgctgcaggccatcttctaccctgtgcagggcaaggagcccagcgtgcggcagctggccctgctgcacttcagaaatgccatcaccctgtctgtgaagctggaggatgccctggcccgggcccacgcccgggtgcccccagccatcgtgcagatgctgctggtgctgcagggcgtgcatgagagccggggcgtgacagaggactacctgcggctggagaccctggtgcagaaggtggtgagcccctacctgggcacctacggcctgcacagcagcgagggccccttcacccacagctgcatcctggagaagaggctgctgcggcgcagccgctctggagatgtgctggccaagaaccctgtggtgcgcagcaagagctacaacacccccctgctgaaccctgtgcaggagcacgaggccgagggcgctgctgctgggggcaccagcatcagaagacacagcgtgtctgagatgaccagctgcccagagccccagggcttcagtgaccccccaggccagggccccaccggcaccttccgcagcagccctgccccccacagcggcccctgccccagccggctgtaccccaccacccagcccccagagcagggcctggaccccaccaggagcagcctgcccaggagcagccctgagaacctggtggaccagatcctggagagcgtggacagcgacagcgagggcatcttcatcgactttggccggggccggggcagcggcatgtctgacctggagggcagcggcggccggcagagcgtggtgtag

SEQ ID NO: 21290 - DNA, 804 bp, Artificial Sequence
  Description of Artificial Sequence: Synthetic coding sequence
atgagcagccccagcctgagtgacctgggcaagcgggagcctgctgctgctgctgatgagcggggcacccagcagaggcgggcctgtgccaatgccacctggaacagcatccacaatggagtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgagggccagaagctgctggacagcctggccgagacctgggacttcttcttcagtgatgtgctgcccatgctgcaggccatcttctaccctgtgcagggcaaggagcccagcgtgcggcagctggccctgctgcacttcagaaatgccatcaccctgtctgtgaagctggaggatgccctggcccgggcccacgcccgggtgcccccagccatcgtgcagatgctgctggtgctgcagggcgtgcatgagagcagaggagtgacagaggactacctgcggctggagaccctggtgcagaaggtggtgagcccctacctgggcacctacggcctgcacagcagcgagggccccttcacccacagctgcatcctggagaagaggctgctgcggcgcagccgctctggagatgtgctggccaagaaccctgtggtgcgcagcaagagctacaacacccccctgctgaaccctgtgcaggagcatgaagctgagggcgctgctgctgggggcacctag

SEQ ID NO: 21291 - DNA, 681 bp, Artificial Sequence
  Description of Artificial Sequence: Synthetic coding sequence
atgagcagccccagcctgagtgacctgggcaagcgggagcctgctgctgctgctgatgagcggggcacccagcagaggcgggcctgtgccaatgccacctggaacagcatccacaatggagtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgagggccagaagctgctggacagcctggccgagacctgggacttcttcttcagtgatgtgctgcccatgctgcaggccatcttctaccctgtgcagggcaaggagcccagcgtgcggcagctggccctgctgcacttcagaaatgccatcaccctgtctgtgaagctggaggatgccctggcccgggcccacgcccgggtgcccccagccatcgtgcagatgctgctggtgctgcagggcgtgcatgagagcagaggagtgacagaggactacctgcggctggagaccctggtgcagaaggtggtgagcccctacctgggcacctacggcctgcacagcagcgagggccccttcacccacagctgcatcctggagaagaggctgctgtag

SEQ ID NO: 21292 - DNA, 1236 bp, Artificial Sequence
  Description of Artificial Sequence: Synthetic coding sequence
atggtgtgcctggagctgagccagcgggaggcctggggcagcggcagccctgagaagatgcctgcccagcctgagggcctgtaccgcctgaagttcatgagcagccccagcctgagtgacctgggcaagcgggagcctgctgctgctgctgatgagcggggcacccagcagaggcgggcctgtgccaatgccacctggaacagcatccacaatggagtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgagggccagaagctgctggacagcctggccgagacctgggacttcttcttcagtgatgtgctgcccatgctgcaggccatcttctaccctgtgcagggcaaggagcccagcgtgcggcagctggccctgctgcacttcagaaatgccatcaccctgtctgtgaagctggaggatgccctggcccgggcccacgcccgggtgcccccagccatcgtgcagatgctgctggtgctgcagggcgtgcatgagagcagaggagtgacagaggactacctgcggctggagaccctggtgcagaaggtggtgagcccctacctgggcacctacggcctgcacagcagcgagggccccttcacccacagctgcatcctggagaagaggctgctgcggcgcagccgctctggagatgtgctggccaagaaccctgtggtgcgcagcaagagctacaacacccccctgctgaaccctgtgcaggagcatgaagctgagggcgctgctgctgggggcaccagcatccgccgccacagcgtgtctgagatgaccagctgcccagagccccagggcttcagtgaccccccaggccagggccccaccggcaccttccgcagcagccctgccccccacagcggcccctgccccagccggctgtaccccaccacccagcccccagagcagggcctggaccccaccaggagcagcctgcccaggagcagccctgagaacctggtggaccagatcctggagagcgtggacagcgacagcgagggcatcttcatcgactttggccggggccggggcagcggcatgtctgacctggagggcagcggcggccggcagagcgtggtgtag

SEQ ID NO: 21293 - DNA, 2649 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctgcctgaggaggccgagcgggtgaaggcccaggtgcaggccctgggcctggccgaggcccagcccatggctgtggtgcagagcgtgcctggggcccaccctgtgcctgtgtatgccttcagcatcaagggccccagctatggagaagatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgtccccaccccacctggatggcccccccagccccaggagccctgtgattggcagcgaggtgttcctgcccaacagcaaccacgtggccagcggggccggggaggccgaggagcgggtggtggtgatcagcagcagtgaagattctgatgctgagaacagcagcagccgggagctggatgacagcagcagcgagagcagtgacctgcagctggagggccccagcaccctgcgggtgctggatgagaacctggccgacccccaggccgaggaccggcccctggtgttctttgacctgaagattgacaatgagacccagaagatcagccagctggccgctgtgaaccgggagagcaagttccgggtggtgatccagcctgaggccttcttcagcatctacagcaaggctgtgtccctggaggtgggcctgcagcacttcctgtccttcctgagctccatgaggcggcccatcctggcctgctacaagctgtggggccctggcctgcccaacttcttccgggccctggaggacatcaaccggctgtgggagttccaggaggccatcagcggcttcctggccgccctgcccctcatccgggagcgggtgcctggggccagcagcttcaagctgaagaacctggcccagacctacctggccaggaacatgtctgagaggtctgccatggctgctgtgctggccatgagggacctgtgccgcctgctggaggtgtccccaggcccccagctggcccagcacgtgtaccccttcagcagcctgcagtgctttgccagcctgcagcccctggtgcaggccgctgtgctgcccagggctgaggcccggctgctggccctgcacaacgtgtccttcatggagctgctgagcgcccacagaagagaccggcagggcggcctgaagaagtacagccgctacctgagcctgcagaccaccaccctgcccccagcccagcctgccttcaacctgcaggccctgggcacctactttgagggcctgctggagggccctgccctggcccgggcagagggcgtgtccacccccctggccggccggggcctggccgagcgggccagccagcagagctag

SEQ ID NO: 21294 - DNA, 2490 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctgcctgaggaggccgagcgggtgaaggcccaggtgcaggccctgggcctggccgaggcccagcccatggctgtggtgcagagcgtgcctggggcccaccctgtgcctgtgtatgccttcagcatcaagggccccagctatggagaagatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgtccccaccccacctggatggcccccccagccccaggagccctgtgattggcagcgaggtgttcctgcccaacagcaaccacgtggccagcggggccggggaggccgaggagcgggtggtggtgatcagcagcagtgaagattctgatgctgagaacagctgcatggagcccatggagacagctgagccccagagcagccctgcccacagcagccctgcccacagcagccctgcccacagcagccctgtgcagagcctgctgcgggcccagggcgccagcagcctgccctgtggcacctaccaccccccagcctggccaccccaccagcctgctgagcaggccgccaccccagatgctgagccccacagcgagcccccagaccaccaggagaggcctgctgtgcaccggggcatccgctacctgctgtaccgggcccagagggccatccggctgcggcatgccctgcggctgcacccccagctgcaccgggcccccatccgcacctggagcccccacgtggtgcaggccagcaccccagccatcaccggccccctgaaccacccagccaatgcccaggagcacccagcccagctgcagaggggcatcagccccccccaccgcatcagaggagctgtgcgcagccgcagccgcagcctgcggggcagcagccacctgagccagtggctgaacaacttctttgccctgcccttcagctccatggccagccagctggacatgagctctgtggtgggcgctggggagagccgggcccagaccctgggcgccggcgtgcccccaggggacagcgtgcggggctccatggaggccagccaggtgcaggtgcccctggaggccagccccatcaccttccccccaccctgtgcccctgagcggccccccatcagccctgtgcctggggcccggcaggccggcctgtag

SEQ ID NO: 21295 - DNA, 2346 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctggatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgtccccaccccacctggatggcccccccagccccaggagccctgtgattggcagcgaggtgttcctgcccaacagcaaccacgtggccagcggggccggggaggccgaggagcgggtggtggtgatcagcagcagtgaagattctgatgctgagaacagctgcatggagcccatggagacagctgagccccagagcagccctgcccacagcagccctgcccacagcagccctgcccacagcagccctgtgcagagcctgctgcgggcccagggcgccagcagcctgccctgtggcacctaccaccccccagcctggccaccccaccagcctgctgagcaggccgccaccccagatgctgagccccacagcgagcccccagaccaccaggagaggcctgctgtgcaccggggcatccgctacctgctgtaccgggcccagagggccatccggctgcggcatgccctgcggctgcacccccagctgcaccgggcccccatccgcacctggagcccccacgtggtgcaggccagcaccccagccatcaccggccccctgaaccacccagccaatgcccaggagcacccagcccagctgcagaggggcatcagccccccccaccgcatcagaggagctgtgcgcagccgcagccgcagcctgcggggcagcagccacctgagccagtggctgaacaacttctttgccctgcccttcagctccatggccagccagctggacatgagctctgtggtgggcgctggggagagccgggcccagaccctgggcgccggcgtgcccccaggggacagcgtgcggggctccatggaggccagccaggtgcaggtgcccctggaggccagccccatcaccttccccccaccctgtgcccctgagcggccccccatcagccctgtgcctggggcccggcaggccggcctgtag

SEQ ID NO: 21296 - DNA, 1272 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctgagaaatgccctgtggtag

SEQ ID NO: 21297 - DNA, 1308 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctgctgcccccaccagcccacgccctgactggacctgcccagagcagcacccactag

SEQ ID NO: 21298 - DNA, 1902 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctgcctgaggaggccgagcgggtgaaggcccaggtgcaggccctgggcctggccgaggcccagcccatggctgtggtgcagagcgtgcctggggcccaccctgtgcctgtgtatgccttcagcatcaagggccccagctatggagaagatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgtccccaccccacctggatggcccccccagccccaggagccctgtgattggcagcgaggtgttcctgcccaacagcaaccacgtggccagcggggccggggaggccgaggagcgggtggtggtgatcagcagcagtgaagattctgatgctgagaacagcagcagccgggagctggatgacagcagcagcgagagcagtgacctgcagctggagggccccagcaccctgcgggtgctggatgagaacctggccgacccccaggccgaggaccggcccctggtgttctttgacctgaagattgacaatgaaagtggcttctcctggggctacccccaccccttcctgatctag

SEQ ID NO: 21299 - DNA, 1332 bp, Artificial Sequence
  Description of Artificial Sequence: Synthetic coding sequence
atggctgtggtgcagagcgtgcctggggcccaccctgtgcctgtgtatgccttcagcatcaagggccccagctatggagaagatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgagccccccccacctggatggcccccccagccccaggagccctgtgattggcagcgaggtgttcctgcccaacagcaaccacgtggccagcggggccggggaggccgaggagcgggtggtggtgatcagcagcagcgaggacagtgatgctgagaacagcagcagccgggagctggatgacagcagcagcgagagcagtgacctgcagctggagggccccagcaccctgcgggtgctggatgagaacctggccgacccccaggctgaagatcggcccctggtgttctttgacctgaagattgacaatgagacccagaagatcagccagctggccgctgtgaaccgggagagcaagttccgggtggtgatccagcctgaggccttcttcagcatctacagcaaggctgtgtccctggaggtgggcctgcagcacttcctgtccttcctgagctccatgagaagacccatcctggcctgctacaagctgtggggccctggcctgcccaacttcttccgggccctggaggacatcaaccggctgtgggagttccaggaggccatcagcggcttcctggccgccctgcccctcatccgggagcgggtgcctggggccagcagcttcaagctgaagaacctggcccagacctacctggccaggaacatgtctgagaggtctgccatggctgctgtgctggccatgagggacctgtgccgcctgctggaggtgtccccaggcccccagctggcccagcacgtgtaccccttcagcagcctgcagtgctttgccagcctgcagcccctggtgcaggccgctgtgctgcccagggctgaggcccggctgctggccctgcacaacgtgtccttcatggagctgctgagcgcccaccggcgggaccggcagggcggcctgaagaagtacagccgctacctgagcctgcagaccaccaccctgcccccagcccagcctgccttcaacctgcaggccctgggcacctactttgagggcctgctggagggccctgccctggcccgggcagagggcgtgtccacccccctggccggccggggcctggccgagcgggccagccagcagagctag

SEQ ID NO: 21300 - DNA, 2598 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctgcctgaggaggccgagcgggtgaaggcccaggtgcaggccctgggcctggccgaggcccagcccatggctgtggtgcagagcgtgcctggggcccaccctgtgcctgtgtatgccttcagcatcaagggccccagctatggagaagatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgtccccaccccacctggatggcccccccagccccaggagccctgtgattggcagcgaggtgttcctgcccaacagcaaccacgtggccagcggggccggggaggccgaggagcgggtggtggtgatcagcagcagtgaagattctgatgctgagaacagcagcagccgggagctggatgacagcagcagcgagagcagtgacctgcagctggagggccccagcaccctgcgggtgctggatgagaacctggccgacccccaggccgaggaccggcccctggtgttctttgacctgaagattgacaatgagacccagaagatcagccagctggccgctgtgaaccgggagagcaagttccgggtggtgatccagcctgaggccttcttctccttcctgagctccatgagaagacccatcctggcctgctacaagctgtggggccctggcctgcccaacttcttccgggccctggaggacatcaaccggctgtgggagttccaggaggccatcagcggcttcctggccgccctgcccctcatccgggagcgggtgcctggggccagcagcttcaagctgaagaacctggcccagacctacctggccaggaacatgtctgagaggtctgccatggctgctgtgctggccatgagggacctgtgccgcctgctggaggtgtccccaggcccccagctggcccagcacgtgtaccccttcagcagcctgcagtgctttgccagcctgcagcccctggtgcaggccgctgtgctgcccagggctgaggcccggctgctggccctgcacaacgtgtccttcatggagctgctgagcgcccaccggcgggaccggcagggcggcctgaagaagtacagccgctacctgagcctgcagaccaccaccctgcccccagcccagcctgccttcaacctgcaggccctgggcacctactttgagggcctgctggagggccctgccctggcccgggcagagggcgtgtccacccccctggccggccggggcctggccgagcgggccagccagcagagctag

SEQ ID NO: 21301 - DNA, 1836 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctgcctgaggaggccgagcgggtgaaggcccaggtgcaggccctgggcctggccgaggcccagcccatggctgtggtgcagagcgtgcctggggcccaccctgtgcctgtgtatgccttcagcatcaagggccccagctatggagaagatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgtccccaccccacctggatggcccccccagccccaggagccctgtgattggcagcgaggtgttcctgcccaacagcaaccacgtggccagcggggccggggaggccgaggagcgggtggtggtgatcagcagcagtgaagattctgatgctgagaacagcgtgtctggccctgaggtgcagcccaggaccccagccagcccccacttccgcagccagggcgcccagccccagcaggtgaccctgcggctggccctgcggctgggcaacttccctgtgcgccactag

SEQ ID NO: 21302 - DNA, 1683 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctgcctgaggaggccgagcgggtgaaggcccaggtgcaggccctgggcctggccgaggcccagcccatggctgtggtgcagagcgtgcctggggcccaccctgtgcctgtgtatgccttcagcatcaagggccccagctatggagaagatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgtccccaccccacctggatggcccccccagccccaggagccctgtgattggcagcgaggtgttcctgcccaacagcaaccacgtggccagcggggccggggaggccggccgggagagaaatgccctgtggtag

SEQ ID NO: 21303 - DNA, 1758 bp, Artificial Sequence
  Description of Artificial Sequence: Synthetic coding sequence
atggagcccgccccagcccggagcccccggccccagcaggaccctgcccggccccaggagcccaccatgcctcctcctgagacccccagcgagggccggcagcccagccccagccccagccccacagagcgggccccagccagcgaggaggagttccagttcctgcgctgccagcagtgccaggccgaggccaagtgccccaagctgctgccctgcctgcacaccctgtgcagcggctgcctggaggccagcggcatgcagtgccccatctgccaggccccctggcccctgggcgctgacaccccagccctggacaacgtgttctttgagagcctgcagaggcggctgtctgtgtaccggcagatcgtggatgcccaggccgtgtgcacccgctgcaaggagagcgctgacttctggtgctttgaatgtgagcagctgctgtgtgccaagtgctttgaggcccaccagtggttcctgaagcatgaggcccggcccctggccgagctgaggaaccagagcgtgcgggagttcctggatggcaccaggaagaccaacaacatcttctgcagcaaccccaaccacaggacccccaccctgaccagcatctactgccggggctgcagcaagcccctgtgctgcagctgtgccctgctggacagcagccacagcgagctgaagtgtgacatctctgctgagatccagcagaggcaggaggagctggatgccatgacccaggccctgcaggagcaggacagcgccttcggggctgtgcacgcccagatgcatgctgctgtgggccagctgggccgggcccgggcagagacagaggagctgatccgggagcgggtgcggcaggtggtggcccacgtgcgggcccaggagcgggagctgctggaggccgtggatgcccgctaccagagggactatgaggagatggccagccggctgggccgcctggatgctgtgctgcagaggatcagaacaggcagcgccctggtgcagaggatgaagtgctacgccagtgaccaggaggtgctggacatgcacggcttcctgcggcaggccctgtgccgcctgcggcaggaggagccccagagcctgcaggccgctgtgaggacagatggctttgatgagttcaaggtgcggctgcaggacctgagcagctgcatcacccagggcaaggatgctgctgtgtccaagaaggccagccctgaggccgccagcaccccccgggaccccattgatgtggacctggatgtgagcaacaccaccacagcccagaagaggaagtgcagccagacccagtgccccaggaaggtgatcaagatggagagcgaggagggcaaggaggcccggctggcccggagcagccctgagcagccccggcccagcaccagcaaggctgtgtccccaccccacctggatggcccccccagccccaggagccctgtgattggcagcgaggtgttcctgcccaacagcaaccacgtggccagcggggccggggaggccgaggagcgggtggtggtgatcagcagcagtgaagattctgatgctgagaacagcagcagccgggagctggatgacagcagcagcgagagcagtgacctgcagctggagggccccagcaccctgcgggtgctggatgagaacctggccgacccccaggccgaggaccggcccctggtgttctttgacctgaagattgacaatgaaagtggcttctcctggggctacccccaccccttcctgatctag

SEQ ID NO: 21304 - DNA, 483 bp, Artificial Sequence
  Description of Artificial Sequence: Synthetic coding sequence
atgcagcctgccagcgccaagtggtatgacagaagagattatgtgttcatcgagttctgtgtggaggacagcaaggatgtgaatgtgaactttgagaagagcaagctgaccttcagctgcctgggcggcagtgacaacttcaagcacctgaatgaaattgacctcttccactgcatcgaccccaatgacagcaagcacaagaggacagacaggagcatcctgtgctgcctgaggaaaggagagagcggccagagctggccccggctgaccaaggagcgggccaagctgaactggctgtctgtggacttcaacaactggaaggactgggaggatgacagtgatgaggacatgagcaactttgaccgcttcagcgagatgatgaacaacatgggaggagatgaagatgtggacctgcctgaggtggatggagcagatgatgacagccaggacagtgatgatgagaagatgccagacctggagtag

SEQ ID NO: 21305 - DNA, 3141 bp, Artificial Sequence
  Description of Artificial Sequence: Synthetic coding sequence
atgcagaagcccagcggcctgaagcccccaggccggggcggcaagcacagcagccccatgggccgcaccagcactggaagtgccagcagcagcgctgctgtggccgccagcagcaaggagggcagccccctgcacaagcagagcagcggccccagcagcagccctgctgctgctgctgcccctgagaagccaggccccaaggctgctgaggtgggagatgacttcctgggggactttgtggtgggggagcgggtgtgggtgaatggagtgaagccaggagtggtgcagtacctgggggagacccagtttgcccctggccagtgggccggcgtggtgctggatgatcctgtgggcaagaatgatggagctgtgggcggcgtgcgctactttgaatgtcctgccctgcagggcatcttcacccggcccagcaagctgacccggcagcccacagctgagggcagcggcagtgatgcccacagcgtggagagcctgacagcccagaacctgagcctgcacagcggcacagccaccccacccctgaccagcagggtcatccccctgcgggagagcgtgctgaacagctctgtgaagacaggaaatgaaagtggcagcaacctgagtgacagcggctctgtgaagagaggagagaaggacctgcggctgggggacagagtgctggtgggcggcaccaagacaggagtggtgcgctacgtgggggagacagactttgccaagggggagtggtgtggggtggagctggatgagcccctgggcaagaatgatggagctgtggccggcacccgctacttccagtgcccccccaagtttggcctgtttgcccccatccacaaggtgatccgcatcggcttccccagcaccagccctgccaaggccaagaagaccaagaggatggccatgggcgtgtctgccctgacccacagccccagcagcagcagcatcagctctgtgtcctctgtggccagctctgtgggcggccggcccagccgcagcggcctgctgacagagaccagcagccgctatgccaggaagatcagcggcaccacagccctgcaggaggccctgaaggagaagcagcagcacatcgagcagctgctggccgagcgggacctggagcgggcagaggtggccaaggccaccagccacatctgtgaggtggagaaggagatcgccctgctgaaggcccagcacgagcagtatgtggccgaggccgaggagaagctgcagagggcccggctgctggtggagagcgtgaggaaggagaaggtggacctgagcaaccagctggaggaggagaggaggaaggtggaggacctgcagttccgggtggaggaggagagcatcaccaagggggacctggagacccagacccagctggagcacgcccgcatcggggagctggagcagagcctgctgctggagaaggcccaggccgagcggctgctgcgggagctggccgacaaccggctgaccaccgtggccgagaagagccgggtgctgcagctggaggaggagctgaccctgcggcggggggagattgaggagctgcagcagtgcctgctgcacagcggccccccacctccagaccacccagatgctgctgagatcctgcggctgcgggagcggctgctgagcgccagcaaggagcaccagcgggagagcggcgtgctgcgggacaagtatgagaaggccctgaaggcctaccaggccgaggtggacaagctgcgggccgccaatgagaagtatgcccaggaggtggccggcctgaaggacaaggtgcagcaggccaccagcgagaacatgggcctgatggacaactggaagagcaagctggacagcctggccagtgaccaccagaagagcctggaggacctgaaggccaccctgaacagcggccctggggcccagcagaaggagatcggggagctgaaggctgtgatggagggcatcaagatggagcaccagctggagctgggcaacctgcaggccaagcatgacctggagacagccatgcacgtgaaggagaaggaggccctgcgggagaagctgcaggaggcccaggaggagctggccggcctgcagaggcactggagggcccagctggaggtgcaggccagccagcaccggctggagctgcaggaggcccaggaccagaggagagatgctgagctgcgggtgcatgagctggagaagctggatgtggagtaccggggccaggcccaggccatcgagttcctgaaggagcagatcagcctggccgagaagaagatgctggactatgaaaggctgcagagagctgaggcccagggcaagcaggaggtggagagcctgcgggagaagctgctggtggctgaaaatcggctgcaggccgtggaggccctgtgcagcagccagcacacccacatgattgagagcaatgacatcagcgaggagaccatccgcaccaaggagaccgtggagggcctgcaggacaagctgaacaagagggacaaggaggtgacagccctgaccagccagacagagatgctgcgggcccaggtgtctgccctggagagcaagtgcaagagcggggagaagaaggtggatgccctgctgaaggagaagaggcggctggaggccgagctggagaccgtgtccaggaagacccatgatgccagcggccagctggtgctgatcagccaggagctgctgaggaaggagaggagcctgaatgagctgcgggtgctgctgctggaggccaacagacacagccctggccctgagcgggacctgagccgggaggtgcacaaggccgagtggaggatcaaggagcagaagctgaaggatgacatccggggcctgcgggagaagctgaccggcctggacaaggagaagagcctgagtgaccagaggcgctacagcctgattgacaggagcagcgcccctgagctgctgcggctgcagcaccagctgatgagcacagaagatgccctgagagatgccctggaccaggcccagcaggtggagaagctgatggaggccatgaggagctgcccagacaaggcccagaccatcggcaacagcggcagcgccaacggcatccaccagcaggacaaggcccagaagcaggaggacaagcactag

SEQ ID NO: 21306 - DNA, 1800 bp, Artificial Sequence
  Description of Artificial Sequence: Synthetic coding sequence
atgagccgcagcctgctgctgtggttcctgctcttcctgctgctgctgccccccctgcctgtgctgctggccgaccccggggcccccacccctgtgaacccctgctgctactacccctgccagcaccagggcatctgtgtgcgcttcggcctggaccgctaccagtgtgactgcaccaggacaggctacagcggccccaactgcaccatccctggcctgtggacctggctgaggaacagcctgcggcccagccccagcttcacccacttcctgctgacccacggccgctggttctgggagtttgtgaatgccaccttcatccgggagatgctgatgaggctggtgctgactgtgcgcagcaacctgatccccagcccccccacctacaacagcgcccatgactacatctcctgggagagcttcagcaatgtgtcctactacacccgcatcctgcccagcgtgcccaaggactgccccacccccatgggcaccaagggcaagaagcagctgcctgatgcccagctgctggcccggcgcttcctgctgcggaggaagttcatcccagacccccagggcaccaacctgatgtttgccttctttgcccagcacttcacccaccagttcttcaagaccagcggcaagatgggccctggcttcaccaaggccctgggccatggagtggacctgggccacatctatggagacaacctggagcggcagtaccagctgcggctcttcaaggatggcaagctgaagtaccaggtgctggatggagagatgtacccacccagcgtggaggaggcccctgtgctgatgcactacccccggggcatccccccccagagccagatggctgtgggccaggaggtgtttggcctgctgcccggcctgatgctgtatgccaccctgtggctgcgggagcacaacagagtgtgtgacctgctgaaggccgagcaccccacctggggagatgagcagctgttccagaccaccaggctcatcctgattggagagaccatcaagatcgtcatcgaggagtatgtgcagcagctgagcggctacttcctgcagctgaagtttgatcctgagctgctgtttggagtgcagttccagtacagaaaccgcatcgccatggagttcaaccacctgtaccactggcaccccctgatgccagacagcttcaaggtgggcagccaggagtacagctatgagcagttcctgttcaacacctccatgctggtggactatggagtggaggccctggtggatgccttcagccggcagattgctggaagaattggaggcggcaggaacatggaccaccacatcctgcacgtggccgtggatgtgatccgggagagccgggagatgaggctgcagcccttcaatgagtacaggaagagatttggcatgaagccctacaccagcttccaggagctggtgggggagaaggagatggctgctgagctggaggagctgtatggagacattgatgccctggagttctacccaggcctgctgctggagaagtgccaccccaacagcatctttggagagagcatgattgagatcggggcccccttcagcctgaagggcctgctgggcaaccccatctgcagccctgagtactggaagcccagcacctttggaggagaggtgggcttcaacatcgtgaagacagccaccctgaagaagctggtgtgcctgaacaccaagacctgcccctacgtgtccttccgggtgcctgatgccagccaggatgatggccctgctgtggagcggcccagcacagagctgtag

SEQ ID NO: 21307 - DNA, 1473 bp, Artificial Sequence
  Description of Artificial Sequence: Synthetic coding sequence
atgctgatgaggctggtgctgactgtgcgcagcaacctgatccccagcccccccacctacaacagcgcccatgactacatctcctgggagagcttcagcaatgtgtcctactacacccgcatcctgcccagcgtgcccaaggactgccccacccccatgggcaccaagggcaagaagcagctgcctgatgcccagctgctggcccggcgcttcctgctgcggaggaagttcatcccagacccccagggcaccaacctgatgtttgccttctttgcccagcacttcacccaccagttcttcaagaccagcggcaagatgggccctggcttcaccaaggccctgggccacggcgtggacctgggccacatctacggggacaacctggagcggcagtaccagctgcggctcttcaaggatggcaagctgaagtaccaggtgctggatggagagatgtacccaccttctgtggaggaggcccctgtgctgatgcactacccccggggcatccccccccagagccagatggctgtgggccaggaggtgtttggcctgctgcccggcctgatgctgtatgccaccctgtggctgcgggagcacaacagagtgtgtgacctgctgaaggccgagcaccccacctggggagatgagcagctgttccagaccaccaggctcatcctgattggagagaccatcaagatcgtgattgaggagtatgtgcagcagctgagcggctacttcctgcagctgaagtttgatcctgagctgctgtttggagtgcagttccagtacagaaacagaattgccatggagttcaaccacctgtaccactggcaccccctgatgccagacagcttcaaggtgggcagccaggagtacagctatgagcagttcctgttcaacacctccatgctggtggactatggagtggaggccctggtggatgccttcagccggcagattgctggccgcatcggcggcggcaggaacatggaccaccacatcctgcacgtggccgtggatgtgatccgggagagccgggagatgaggctgcagcccttcaatgagtacaggaagcgcttcggcatgaagccctacaccagcttccaggagctggtgggggagaaggagatggctgctgagctggaggagctgtatggagacattgatgccctggagttctacccaggcctgctgctggagaagtgccaccccaacagcatctttggagagagcatgattgaaattggagcccccttcagcctgaagggcctgctgggcaaccccatctgcagccctgagtactggaagcccagcaccttcggcggggaggtgggcttcaacatcgtgaagacagccaccctgaagaagctggtgtgcctgaacaccaagacctgcccctacgtgtccttccgggtgcctgatgccagccaggatgatggccctgctgtggagcggcccagcacagagctgtag

SEQ ID NO: 21308 - DNA, 471 bp, Artificial Sequence
  Description of Artificial Sequence: Synthetic coding sequence
agcctgctgctgtggttcctgctcttcctgctgctgctgccccccctgcctgtgctgctggccgaccccggggcccccaccccagctggcctgtggacctggctgaggaacagcctgcggcccagccccagcttcacccacttcctgctgacccacggccgctggttctgggagtttgtgaatgccaccttcatccgggagatgctgatgaggctggtgctgactgtgcgcagcaacctgatccccagcccccccacctacaacagcgcccatgactacatctcctgggagagcttcagcaacttcttcaagaccagcggcaagatgggccctggcttcaccaaggccctgggccatggagtggacctgggccacatctatggagacaacctggagcggcagtaccagctgcggctcttcaaggatggcaagctgaagtaccaggtgctggatggagagatgtacccctag

SEQ ID NO: 21309 - DNA, 1614 bp, Artificial Sequence
  Description of Artificial Sequence: Synthetic coding sequence
atgaggaagccccggctgatgaacccctgctgctactacccctgccagcaccagggcatctgtgtgcgcttcggcctggaccgctaccagtgtgactgcaccaggacaggctacagcggccccaactgcaccatccctggcctgtggacctggctgaggaacagcctgcggcccagccccagcttcacccacttcctgctgacccacggccgctggttctgggagtttgtgaatgccaccttcatccgggagatgctgatgaggctggtgctgactgtgcgcagcaacctgatccccagcccccccacctacaacagcgcccatgactacatctcctgggagagcttcagcaatgtgtcctactacacccgcatcctgcccagcgtgcccaaggactgccccacccccatgggcaccaagggcaagaagcagctgcctgatgcccagctgctggcccggcgcttcctgctgcggaggaagttcatcccagacccccagggcaccaacctgatgtttgccttctttgcccagcacttcacccaccagttcttcaagaccagcggcaagatgggccctggcttcaccaaggccctgggccacggcgtggacctgggccacatctacggggacaacctggagcggcagtaccagctgcggctcttcaaggatggcaagctgaagtaccaggtgctggatggagagatgtacccaccttctgtggaggaggcccctgtgctgatgcactacccccggggcatccccccccagagccagatggctgtgggccaggaggtgtttggcctgctgcccggcctgatgctgtatgccaccctgtggctgcgggagcacaacagagtgtgtgacctgctgaaggccgagcaccccacctggggagatgagcagctgttccagaccaccaggctcatcctgattggagagaccatcaagatcgtgattgaggagtatgtgcagcagctgagcggctacttcctgcagctgaagtttgatcctgagctgctgtttggagtgcagttccagtacagaaacagaattgccatggagttcaaccacctgtaccactggcaccccctgatgccagacagcttcaagattggaggcggcaggaacatggaccaccacatcctgcacgtggccgtggatgtgatccgggagagccgggagatgaggctgcagcccttcaatgagtacaggaagagatttggcatgaagccctacaccagcttccaggagctggtgggggagaaggagatggctgctgagctggaggagctgtatggagacattgatgccctggagttctacccaggcctgctgctggagaagtgccaccccaacagcatctttggagagagcatgattgagatcggggcccccttcagcctgaagggcctgctgggcaaccccatctgcagccctgagtactggaagcccagcacctttggaggagaggtgggcttcaacatcgtgaagacagccaccctgaagaagctggtgtgcctgaacaccaagacctgcccctacgtgtccttccgggtgcctgatgccagccaggatgatggccctgctgtggagcggcccagcacagagctgtag

SEQ ID NO: 21310 - DNA, 1815 bp, Artificial Sequence
  Description of Artificial Sequence: Synthetic coding sequence
atgctggcccgggccctgctgctgtgtgctgtgctggccctgagccacacagccaacccctgctgcagccacccctgccagaacagaggagtgtgcatgtctgtgggctttgaccagtacaagtgtgactgcaccaggacaggcttctacggggagaactgcagcaccccagagttcctgacccgcatcaagctgttcctgaagcccacccccaacacagtgcactacatcctgacccacttcaagggcttctggaatgtggtgaacaacatccccttcctgagaaatgccatcatgtcctatgtgctgaccagccgcagccacctgattgacagcccccccacctacaatgctgactatggctacaagtcctgggaggccttcagcaacctgagctactacacccgggccctgccccctgtgcctgatgactgccccacccccctgggcgtgaagggcaagaagcagctgcctgacagcaatgaaattgtggagaagctgctgctgcggaggaagttcatcccagacccccagggcagcaacatgatgtttgccttctttgcccagcacttcacccaccagttcttcaagacagaccacaagaggggccctgccttcaccaacggcctgggccacggcgtggacctgaaccacatctacggggagaccctggcccggcagaggaagctgcggctcttcaaggatggcaagatgaagtaccagatcattgatggagagatgtacccacccaccgtgaaggacacccaggccgagatgatctacccaccccaggtgcctgagcacctgcgctttgctgtgggccaggaggtgtttggcctggtgcccggcctgatgatgtatgccaccatctggctgcgggagcacaacagagtgtgtgatgtgctgaagcaggagcaccctgagtggggagatgagcagctgttccagaccagccgcctcatcctgattggagagaccatcaagatcgtgattgaggactatgtgcagcacctgagcggctaccacttcaagctgaagtttgatcctgagctgctcttcaacaagcagttccagtaccagaacagaattgctgctgagttcaacaccctgtaccactggcaccccctgctgcctgacaccttccagatccatgaccagaagtacaactaccagcagttcatctacaacaacagcatcctgctggagcacggcatcacccagtttgtggagagcttcacccggcagattgctggccgggtggccggcggcagaaatgtgcccccagctgtgcagaaggtgtcccaggccagcattgaccagagccggcagatgaagtaccagagcttcaatgagtacaggaagcgcttcatgctgaagccctatgagagctttgaggagctgaccggggagaaggagatgtctgctgagctggaggccctgtatggagacattgatgctgtggagctgtacccagccctgctggtggagaagcccaggccagatgccatctttggagagaccatggtggaggtgggcgcccccttcagcctgaagggcctgatgggaaatgtcatctgcagccctgcctactggaagcccagcaccttcggcggggaggtgggcttccagatcatcaacacagccagcatccagagcctcatctgcaacaacgtgaagggctgccccttcaccagcttctctgtgcctgaccctgagctgatcaagacagtgaccatcaatgccagcagcagccgcagcggcctggatgacatcaaccccaccgtgctgctgaaggagaggagcacagagctgtag

SEQ ID NO: 21311 - DNA, 1614 bp, Artificial Sequence
  Description of Artificial Sequence: Synthetic coding sequence
agcctggtgcctgccaccaactacatctacacccccctgaaccagctgaagggcggcaccatcgtgaatgtgtatggagtggtgaagttcttcaagccaccctacctgagcaagggcacagactactgcagcgtggtgaccatcgtggaccagaccaacgtgaagctgacctgcctgctcttcagcggcaactatgaggccctgcccatcatctacaagaatggagacatcgtgcgcttccaccggctgaagatccaggtgtacaagaaggagacccagggcatcaccagcagcggctttgccagcctgacctttgagggcaccctgggcgcccccatcatccccaggaccagcagcaagtacttcaacttcaccacagaggaccacaagatggtggaggccctgcgggtgtgggccagcacccacatgagccccagctggaccctgctgaagctgtgtgatgtgcagcccatgcagtactttgacctgacctgccagctgctgggcaaggccgaggtggatggagccagcttcctgctgaaggtgtgggatggcaccaggacccccttccccagctggagggtgctgatccaggacctggtgctggagggggacctgagccacatccaccggctgcagaacctgaccatcgacatcctggtgtatgacaaccacgtgcacgtggcccggagcctgaaggtgggcagcttcctgcgcatctacagcctgcacaccaagctgcagagcatgaacagcgagaaccagaccatgctgagcctggagttccacctgcatggaggcaccagctatggccggggcatccgggtgctgcctgagagcaacagtgatgtggaccagctgaagaaggacctggagagcgccaacctgacagccaaccagcacagtgatgtgatctgccagagcgagccagatgacagcttccccagcagcggctctgtgtccctgtatgaggtggagcgctgccagcagctgagcgccaccatcctgacagaccaccagtacctggagaggacccccctgtgtgccatcctgaagcagaaggccccccagcagtaccgcatccgggccaagctgcggagctacaagcccaggaggctcttccagagcgtgaagctgcactgccccaagtgccacctgctgcaggaggtgccccatgaaggagacctggacatcatcttccaggatggagccaccaagaccccagatgtgaagctgcagaacaccagcctgtatgacagcaagatctggaccaccaagaaccagaagggcaggaaggtggccgtgcactttgtgaagaacaacggcatcctgcccctgagcaatgaatgtctgctgctgattgagggcggcaccctgtctgagatctgcaagctgagcaacaagttcaacagcgtcatccctgtgcgcagcggccacgaggacctggagctgctggacctgagcgcccccttcctgatccagggcaccatccaccactacggctgcaagcagtgcagcagcctgcggagcatccagaacctgaacagcctggtggacaagacctcctggatccccagctctgtggccgaggagctggacatcgtgctgcagtag

SEQ ID NO: 21312 - DNA, 1905 bp, Artificial Sequence
  Description of Artificial Sequence: Synthetic coding sequence
atgagcctggtgcctgccaccaactacatctacacccccctgaaccagctgaagggcggcaccatcgtgaatgtgtatggagtggtgaagttcttcaagccaccctacctgagcaaaggaacagactactgcagcgtggtgaccatcgtggaccagaccaacgtgaagctgacctgcctgctcttcagcggcaactatgaggccctgcccatcatctacaagaatggagacatcgtgcgcttccaccggctgaagatccaggtgtacaagaaggagacccagggcatcaccagcagcggctttgccagcctgacctttgagggcaccctgggcgcccccatcatccccaggaccagcagcaagtacttcaacttcaccacagaggaccacaagatggtggaggccctgcgggtgtgggccagcacccacatgagccccagctggaccctgctgaagctgtgtgatgtgcagcccatgcagtactttgacctgacctgccagctgctgggcaaggccgaggtggatggagccagcttcctgctgaaggtgtgggatggcaccaggacccccttccccagctggagggtgctgatccaggacctggtgctggagggggacctgagccacatccaccggctgcagaacctgaccatcgacatcctggtgtatgacaaccacgtgcacgtggcccggagcctgaaggtgggcagcttcctgcgcatctacagcctgcacaccaagctgcagagcatgaacagcgagaaccagaccatgctgagcctggagttccacctgcacggcggcaccagctatggccggggcatccgggtgctgcctgagagcaacagtgatgtggaccagctgaagaaggacctggagagcgccaacctgacagccaaccagcacagtgatgtgatctgccagagcgagccagatgacagcttccccagcagcggctctgtgtccctgtatgaggtggagcgctgccagcagctgagcgccaccatcctgacagaccaccagtacctggagaggacccccctgtgtgccatcctgaagcagaaggccccccagcagtaccgcatccgggccaagctgcggagctacaagccccggcggctcttccagagcgtgaagctgcactgccccaagtgccacctgctgcaggaggtgccccatgaaggagacctggacatcatcttccaggatggagccaccaagaccccagatgtgaagctgcagaacaccagcctgtatgacagcaagatctggaccaccaagaaccagaagggcaggaaggtggccgtgcactttgtgaagaacaacggcatcctgcccctgagcaatgaatgtctgctgctgattgaaggaggcaccctgtctgagatctgcaagctgagcaacaagttcaacagcgtcatccctgtgcgcagcggccacgaggacctggagctgctggacctgagcgcccccttcctgatccagggcaccatccaccactacggctgcaagcagtgcagcagcctgcggagcatccagaacctgaacagcctggtggacaagacctcctggatccccagctctgtggccgaggccctgggcatcgtgcccctgcagtatgtgtttgtgatgaccttcaccctggatgatggcaccggggtgctggaggcctacctgatggacagcgacaagttcttccagatcccagccagcgaggtgctgatggatgatgacctgcagaagtctgtggacatgatcatggacatgttctgccccccaggcatcaagattgatgcctacccctggctggagtgcttcatcaagagctacaacgtgaccaacggcacagacaaccagatctgctaccagatctttgacaccaccgtggctgaagatgtgatctag

SEQ ID NO: 21313 - DNA, 1023 bp, Artificial Sequence
  Description of Artificial Sequence: Synthetic coding sequence
ctgagcctggtgcctgccaccaactacatctacacccccctgaaccagctgaagggcggcaccatcgtgaatgtgtatggagtggtgaagttcttcaagccaccctacctgagcaaaggaacagactactgcagcgtggtgaccatcgtggaccagaccaacgtgaagctgacctgcctgctcttcagcggcaactatgaggccctgcccatcatctacaagaatggagacatcgtgcgcttccaccggctgaagatccaggtgtacaagaaggagacccagggcatcaccagcagcggctttgccagcctgacctttgagggcaccctgggcgcccccatcatccccaggaccagcagcaagtacttcaacttcaccacagaggaccacaagatggtggaggccctgcgggtgtgggccagcacccacatgagccccagctggaccctgctgaagctgtgtgatgtgcagcccatgcagtactttgacctgacctgccagctgctgggcaaggccgaggtggatggagccagcttcctgctgaaggtgtgggatggcaccaggacccccttccccagctggagggtgctgatccaggacctggtgctggagggggacctgagccacatccaccggctgcagaacctgaccatcgacatcctggtgtatgacaaccacgtgcacgtggcccggagcctgaaggtgggcagcttcctgcgcatctacagcctgcacaccaagctgcagagcatgaacagcgagaaccagaccatgctgagcctggagttccacctgcacggcggcaccagctatggccggggcatccgggtgctgcctgagagcaacagtgatgtggaccagctgaagaaggacctggagagcgccaacctgacagccaaccagcacagtgatgtgatctgccagagcgagccagatgacagcttccccaatggagtgtccctgcggcccccaggctggagctctgtggcccggagccggctgattgctgccagcaccagctag

SEQ ID NO: 21314 - DNA, 1512 bp, Artificial Sequence
  Description of Artificial Sequence: Synthetic coding sequence
atggtggaggccctgcgggtgtgggccagcacccacatgagccccagctggaccctgctgaagctgtgtgatgtgcagcccatgcagtactttgacctgacctgccagctgctgggcaaggccgaggtggatggagccagcttcctgctgaaggtgtgggatggcaccaggacccccttccccagctggagggtgctgatccaggacctggtgctggagggggacctgagccacatccaccggctgcagaacctgaccatcgacatcctggtgtatgacaaccacgtgcacgtggcccggagcctgaaggtgggcagcttcctgcgcatctacagcctgcacaccaagctgcagagcatgaacagcgagaaccagaccatgctgagcctggagttccacctgcatggaggcaccagctatggccggggcatccgggtgctgcctgagagcaacagtgatgtggaccagctgaagaaggacctggagagcgccaacctgacagccaaccagcacagtgatgtgatctgccagagcgagccagatgacagcttccccagcagcggctctgtgtccctgtatgaggtggagcgctgccagcagctgagcgccaccatcctgacagaccaccagtacctggagaggacccccctgtgtgccatcctgaagcagaaggccccccagcagtaccgcatccgggccaagctgcggagctacaagcccaggaggctcttccagagcgtgaagctgcactgccccaagtgccacctgctgcaggaggtgccccatgaaggagacctggacatcatcttccaggatggagccaccaagaccccagatgtgaagctgcagaacaccagcctgtatgacagcaagatctggaccaccaagaaccagaagggcaggaaggtggccgtgcactttgtgaagaacaacggcatcctgcccctgagcaatgaatgtctgctgctgattgagggcggcaccctgtctgagatctgcaagctgagcaacaagttcaacagcgtcatccctgtgcgcagcggccacgaggacctggagctgctggacctgagcgcccccttcctgatccagggcaccatccaccactacggctgcaagcagtgcagcagcctgcggagcatccagaacctgaacagcctggtggacaagacctcctggatccccagctctgtggccgaggccctgggcatcgtgcccctgcagtatgtgtttgtgatgaccttcaccctggatgatggcactggagtgctggaggcctacctgatggacagcgacaagttcttccagatcccagccagcgaggtgctgatggatgatgacctgcagaagtctgtggacatgatcatggacatgttctgccccccaggcatcaagattgatgcctacccctggctggagtgcttcatcaagagctacaacgtgaccaatggaacagacaaccagatctgctaccagatctttgacaccaccgtggccgaggatgtgatctag

SEQ ID NO: 21315 - DNA, 1380 bp, Artificial Sequence
  Description of Artificial Sequence: Synthetic coding sequence
ctgagcctggtgcctgccaccaactacatctacacccccctgaaccagctgaagggcggcaccatcgtgaatgtgtatggagtggtgaagttcttcaagccaccctacctgagcaaaggaacagactactgcagcgtggtgaccatcgtggaccagaccaacgtgaagctgacctgcctgctcttcagcggcaactatgaggccctgcccatcatctacaagaatggagacatcgtgcgcttccaccggctgaagatccaggtgtacaagaaggagacccagggcatcaccagcagcggctttgccagcctgacctttgagggcaccctgggcgcccccatcatccccaggaccagcagcaagtacttcaacttcaccacagaggaccacaagatggtggaggccctgcgggtgtgggccagcacccacatgagccccagctggaccctgctgaagctgtgtgatgtgcagcccatgcagtactttgacctgacctgccagctgctgggcaaggccgaggtggatggagccagcttcctgctgaaggtgtgggatggcaccaggacccccttccccagctggagggtgctgatccaggacctggtgctggagggggacctgagccacatccaccggctgcagaacctgaccatcgacatcctggtgtatgacaaccacgtgcacgtggcccggagcctgaaggtgggcagcttcctgcgcatctacagcctgcacaccaagctgcagagcatgaacagcgagaaccagaccatgctgagcctggagttccacctgcacggcggcaccagctatggccggggcatccgggtgctgcctgagagcaacagtgatgtggaccagctgaagaaggacctggagagcgccaacctgacagccaaccagcacagtgatgtgatctgccagagcgagccagatgacagcttccccagcagcggctctgtgtccctgtatgaggtggagcgctgccagcagctgagcgccaccatcctgacagaccaccagtacctggagaggacccccctgtgtgccatcctgaagcagaaggccccccagcagtaccgcatccgggccaagctgcggagctacaagccccggcggctcttccagagcgtgaagctgcactgccccaagtgccacctgctgcaggaggtgccccatgaaggagacctggacatcatcttccaggatggagccaccaagaccccagatgtgaagctgcagaacaccagcctgtatgacagcaagatctggaccaccaagaaccagaagggcaggaaggtggccgtgcactttgtgaagaacaacggcatcctgcccctgagcaatgaatgtctgctgctgattgaggtgctgctgtag

SEQ ID NO: 21316 - DNA, 249 bp, Artificial Sequence
  Description of Artificial Sequence: Synthetic coding sequence
atgagcctggtgcctgccaccaactacatctacacccccctgaaccagctgaagggcggcaccatcgtgaatgtgtatggagtggtgaagttcttcaagccaccctacctgagcaaaggaacagactactgcagcgtggtgaccatcgtggaccagaccaacgtgaagctgacctgcctgctcttcagcggcaactatgaggccctgcccatcatctacaagaatggagacatcgtgcgcttccactag

SEQ ID NO: 21317 - DNA, 1557 bp, Artificial Sequence
  Description of Artificial Sequence: Synthetic coding sequence
ctgagcctggtgcctgccaccaactacatctacacccccctgaaccagctgaagggcggcaccatcgtgaatgtgtatggagtggtgaagttcttcaagccaccctacctgagcaaaggaacagactactgcagcgtggtgaccatcgtggaccagaccaacgtgaagctgacctgcctgctcttcagcggcaactatgaggccctgcccatcatctacaagaatggagacatcgtgcgcttccaccggctgaagatccaggtgtacaagaaggagacccagggcatcaccagcagcggctttgccagcctgacctttgagggcaccctgggcgcccccatcatccccaggaccagcagcaagtacttcaacttcaccacagaggaccacaagatggtggaggccctgcgggtgtgggccagcacccacatgagccccagctggaccctgctgaagctgtgtgatgtgcagcccatgcagtactttgacctgacctgccagctgctgggcaaggccgaggtggatggagccagcttcctgctgaaggtgtgggatggcaccaggacccccttccccagctggagggtgctgatccaggacctggtgctggagggggacctgagccacatccaccggctgcagaacctgaccatcgacatcctggtgtatgacaaccacgtgcacgtggcccggagcctgaaggtgggcagcttcctgcgcatctacagcctgcacaccaagctgcagagcatgaacagcgagaaccagaccatgctgagcctggagttccacctgcacggcggcaccagctatggccggggcatccgggtgctgcctgagagcaacagtgatgtggaccagctgaagaaggacctggagagcgccaacctgacagccaaccagcacagtgatgtgatctgccagagcgagccagatgacagcttccccagcagcggctctgtgtccctgtatgaggtggagcgctgccagcagctgagcgccaccatcctgacagaccaccagtacctggagaggacccccctgtgtgccatcctgaagcagaaggccccccagcagtaccgcatccgggccaagctgcggagctacaagccccggcggctcttccagagcgtgaagctgcactgccccaagtgccacctgctgcaggaggtgccccatgaaggagacctggacatcatcttccaggatggagccaccaagaccccagatgtgaagctgcagaacaccagcctgtatgacagcaagatctggaccaccaagaaccagaagggcaggaaggtggccgtgcactttgtgaagaacaacggcatcctgcccctgagcaatgaatgtctgctgctgattgaaggaggcaccctgtctgagatctgcaagctgagcaacaagttcaacagcgtcatccctgtgcgcagcggccacgaggacctggagctgctggacctgagcgcccccttcctgatccagggcaccatccaccactatggaacaggctactgcaccccacccatctgtgtgtgctatgacctgtacacctag

SEQ ID NO: 21318 - DNA, 1374 bp, Artificial Sequence
  Description of Artificial Sequence: Synthetic coding sequence
agccctgaggaccccaggagcaagcacaagttcaagatccacacctacggcagccccaccttctgtgaccactgcggcagcctgctgtatggcctcatccaccagggcatgaagtgtgacacctgtgacatgaatgtgcacaagcagtgtgtgatcaacgtgcccagcctgtgtggcatggaccacacagagaagaggggccgcatctacctgaaggccgaggtggctgatgagaagctgcacgtgacagtgagagatgccaagaacctgatccccatggaccccaacggcctgagtgacccctacgtgaagctgaagctgatcccagaccccaagaatgaaagcaagcagaagaccaagaccatccgcagcaccctgaacccccagtggaatgaaagcttcaccttcaagctgaagcccagcgacaaggaccggcggctgtctgtggagatctgggactgggacaggaccaccagaaatgacttcatgggcagcctgagctttggagtgtctgagctgatgaagatgcctgccagcggctggtacaagctgctgaaccaggaggagggggagtactacaacgtgcccatcccagaaggagatgaggagggcaacatggagctgcggcagaagtttgagaaggccaagctgggccctgctggcaacaaggtgatcagccccagcgaggacaggaagcagcccagcaacaacctggacagagtgaagctgacagacttcaacttcctgatggtgctgggcaagggcagctttgggaaggtgatgctggccgacaggaagggcacagaggagctgtatgccatcaagatcctgaagaaggatgtggtgatccaggatgatgatgtggagtgcaccatggtggagaagagggtgctggccctgctggacaagccacccttcctgacccagctgcacagctgcttccagacagtggaccggctgtactttgtgatggagtatgtgaatggaggagacctgatgtaccacatccagcaggtgggcaagttcaaggagccccaggccgtgttctatgctgctgagatcagcatcggcctcttcttcctgcacaagaggggcatcatctacagagacctgaagctggacaacgtgatgctggacagcgagggccacatcaagattgctgactttggcatgtgcaaggagcacatgatggatggagtgaccaccaggaccttctgtggcaccccagactacatcgcccctgagatcatcgcctaccagccctacggcaagtctgtggactggtgggcctatggagtgctgctgtatgagatgctggccggccaggtgatgttctgctacatcttcatgtttgtgtactgctgcgtgatgtag

SEQ ID NO: 21319 - DNA, 2019 bp, Artificial Sequence
  Description of Artificial Sequence: Synthetic coding sequence
atggctgatgtgtttcctggaaatgacagcacagccagccaggatgtggccaacagatttgccaggaaaggagccctgcggcagaagaatgtgcatgaggtgaaggaccacaagttcatcgcccgcttcttcaagcagcccaccttctgcagccactgcacagacttcatctggggctttgggaagcagggcttccagtgccaggtgtgctgctttgtggtgcacaagcgctgccatgaatttgtgaccttcagctgccctggagctgacaagggccctgacacagatgaccccaggagcaagcacaagttcaagatccacacctacggcagccccaccttctgtgaccactgcggcagcctgctgtatggcctcatccaccagggcatgaagtgtgacacctgtgacatgaatgtgcacaagcagtgtgtgatcaacgtgcccagcctgtgtggcatggaccacacagagaagaggggccgcatctacctgaaggccgaggtggctgatgagaagctgcacgtgacagtgagagatgccaagaacctgatccccatggaccccaacggcctgagtgacccctacgtgaagctgaagctgatcccagaccccaagaatgaaagcaagcagaagaccaagaccatccgcagcaccctgaacccccagtggaatgaaagcttcaccttcaagctgaagcccagcgacaaggaccggcggctgtctgtggagatctgggactgggacaggaccaccagaaatgacttcatgggcagcctgagctttggagtgtctgagctgatgaagatgcctgccagcggctggtacaagctgctgaaccaggaggagggggagtactacaacgtgcccatcccagaaggagatgaggagggcaacatggagctgcggcagaagtttgagaaggccaagctgggccctgctggcaacaaggtgatcagccccagcgaggacaggaagcagcccagcaacaacctggacagagtgaagctgacagacttcaacttcctgatggtgctgggcaagggcagctttgggaaggtgatgctggccgacagaaaaggaacagaggagctgtatgccatcaagatcctgaagaaggatgtggtgatccaggatgatgatgtggagtgcaccatggtggagaagagggtgctggccctgctggacaagccacccttcctgacccagctgcacagctgcttccagacagtggaccggctgtactttgtgatggagtatgtgaatggaggagacctgatgtaccacatccagcaggtgggcaagttcaaggagccccaggccgtgttctacgccgctgagatcagcatcggcctcttcttcctgcacaagaggggcatcatctacagagacctgaagctggacaacgtgatgctggacagcgagggccacatcaagattgctgactttggcatgtgcaaggagcacatgatggatggagtgaccaccaggaccttctgtggcaccccagactacatcgcccctgagatcatcgcctaccagccctacggcaagtctgtggactggtgggcctacggcgtgctgctgtatgagatgctggccggccagcccccatttgatggagaagatgaagatgagctgttccagagcatcatggagcacaacgtgtcctaccccaagagcctgagcaaggaggccgtgtctgtgtgcaagggcctgatgaccaagcacccagccaagaggctgggctgcggccctgagggggagagagatgtgcgggagcacgccttcttcagaagaattgactgggagaagctggagaaccgggagatccagccccccttcaagcccaaggtgtgtgggaaaggagctgagaactttgacaagttcttcacccggggccagcctgtgctgaccccaccagaccagctggtgattgccaacatcgaccagagcgactttgagggcttctcctatgtgaacccccagtttgtgcaccccatcctgcagagcgctgtgtag

SEQ ID NO: 21320 - DNA, 2022 bp, Artificial Sequence
  Description of Artificial Sequence: Synthetic coding sequence
atggctgaccctgctgctggccccccaccttctgagggggaggagagcacagtgcgctttgccaggaaaggagccctgcggcagaagaatgtgcatgaggtgaagaaccacaagttcaccgcccgcttcttcaagcagcccaccttctgcagccactgcacagacttcatctggggctttgggaagcagggcttccagtgccaggtgtgctgctttgtggtgcacaagcgctgccatgaatttgtgaccttcagctgccctggagctgacaagggccctgccagtgatgaccccaggagcaagcacaagttcaagatccacacctacagcagccccaccttctgtgaccactgcggcagcctgctgtatggcctcatccaccagggcatgaagtgtgacacctgcatgatgaatgtgcacaagagatgtgtgatgaatgtgcccagcctgtgtggcacagaccacacagagcggcggggccgcatctacatccaggcccacatcgacagagatgtgctgattgtgctggtgagagatgccaagaacctggtgcccatggaccccaacggcctgagtgacccctacgtgaagctgaagctgatcccagaccccaagtctgagagcaagcagaagaccaagaccatcaagtgcagcctgaaccctgagtggaatgagaccttccgcttccagctgaaggagagtgacaaggaccggcggctgtctgtggagatctgggactgggacctgaccagcagaaatgacttcatgggcagcctgagctttggcatcagcgagctgcagaaggcctctgtggatggctggttcaagctgctgagccaggaggagggggagtacttcaacgtgcctgtgcccccagagggcagcgaggccaatgaggagctgcggcagaagtttgagcgggccaagatcagccagggcaccaaggtgcctgaggagaagaccaccaacacagtgtccaagtttgacaacaatggaaacagagacaggatgaagctgacagacttcaacttcctgatggtgctgggcaagggcagctttgggaaggtgatgctgtctgagaggaagggcacagatgagctgtatgctgtgaagatcctgaagaaggatgtggtgatccaggatgatgatgtggagtgcaccatggtggagaagagggtgctggccctgcccgggaagccacccttcctgacccagctgcacagctgcttccagaccatggaccggctgtactttgtgatggagtatgtgaatggaggagacctgatgtaccacatccagcaggtgggccgcttcaaggagccccatgctgtgttctatgctgctgagatcgccatcggcctcttcttcctgcagagcaagggcatcatctacagagacctgaagctggacaacgtgatgctggacagcgagggccacatcaagattgctgactttggcatgtgcaaggagaacatctgggatggagtgaccaccaagaccttctgtggcaccccagactacatcgcccctgagatcatcgcctaccagccctacggcaagtctgtggactggtgggcctttggagtgctgctgtatgagatgctggccggccaggccccctttgaaggagaagatgaagatgagctgttccagagcatcatggagcacaacgtggcctaccccaagtccatgagcaaggaggccgtggccatctgcaagggcctgatgaccaagcaccctgggaagaggctgggctgcggccctgagggggagcgggacatcaaggagcacgccttcttccgctacatcgactgggagaagctggagaggaaggagatccagcccccctacaagcccaaggcctgtggcagaaatgcagaaaattttgaccgcttcttcaccaggcacccccctgtgctgaccccaccagaccaggaggtgatcagaaatattgaccagagcgagtttgagggcttctcctttgtgaacagcgagttcctgaagccagaggtgaagagctag

SEQ ID NO: 21321 - DNA, 2016 bp, Artificial Sequence
  Description of Artificial Sequence: Synthetic coding sequence
atggctgaccctgctgctggccccccaccttctgagggggaggagagcacagtgcgctttgccaggaaaggagccctgcggcagaagaatgtgcatgaggtgaagaaccacaagttcaccgcccgcttcttcaagcagcccaccttctgcagccactgcacagacttcatctggggctttgggaagcagggcttccagtgccaggtgtgctgctttgtggtgcacaagcgctgccatgaatttgtgaccttcagctgccctggagctgacaagggccctgccagtgatgaccccaggagcaagcacaagttcaagatccacacctacagcagccccaccttctgtgaccactgcggcagcctgctgtatggcctcatccaccagggcatgaagtgtgacacctgcatgatgaatgtgcacaagagatgtgtgatgaatgtgcccagcctgtgtggcacagaccacacagagcggcggggccgcatctacatccaggcccacatcgacagagatgtgctgattgtgctggtgagagatgccaagaacctggtgcccatggaccccaacggcctgagtgacccctacgtgaagctgaagctgatcccagaccccaagtctgagagcaagcagaagaccaagaccatcaagtgcagcctgaaccctgagtggaatgagaccttccgcttccagctgaaggagagtgacaaggaccggcggctgtctgtggagatctgggactgggacctgaccagcagaaatgacttcatgggcagcctgagctttggcatcagcgagctgcagaaggcctctgtggatggctggttcaagctgctgagccaggaggagggggagtacttcaacgtgcctgtgcccccagagggcagcgaggccaatgaggagctgcggcagaagtttgagcgggccaagatcagccagggcaccaaggtgcctgaggagaagaccaccaacacagtgtccaagtttgacaacaatggaaacagagacaggatgaagctgacagacttcaacttcctgatggtgctgggcaagggcagctttgggaaggtgatgctgtctgagaggaagggcacagatgagctgtatgctgtgaagatcctgaagaaggatgtggtgatccaggatgatgatgtggagtgcaccatggtggagaagagggtgctggccctgcccgggaagccacccttcctgacccagctgcacagctgcttccagaccatggaccggctgtactttgtgatggagtatgtgaatggaggagacctgatgtaccacatccagcaggtgggccgcttcaaggagccccatgctgtgttctatgctgctgagatcgccatcggcctcttcttcctgcagagcaagggcatcatctacagagacctgaagctggacaacgtgatgctggacagcgagggccacatcaagattgctgactttggcatgtgcaaggagaacatctgggatggagtgaccaccaagaccttctgtggcaccccagactacatcgcccctgagatcatcgcctaccagccctacggcaagtctgtggactggtgggcctttggagtgctgctgtatgagatgctggccggccaggccccctttgaaggagaagatgaagatgagctgttccagagcatcatggagcacaacgtggcctaccccaagtccatgagcaaggaggccgtggccatctgcaagggcctgatgaccaagcaccctgggaagaggctgggctgcggccctgagggggagcgggacatcaaggagcacgccttcttccgctacatcgactgggagaagctggagaggaaggagatccagcccccctacaagcccaaggcccgggacaagagggacaccagcaactttgacaaggagttcacccggcagcctgtggagctgacccccacagacaagctgttcatcatgaacctggaccagaatgaatttgctggcttctcctacaccaaccctgagtttgtgatcaacgtgtag

SEQ ID NO: 21322 - DNA, 786 bp, Artificial Sequence
  Description of Artificial Sequence: Synthetic coding sequence
atgagggagagcgccctggagcggggccctgtgcctgaggccccagctgggggccctgtgcatgctgtgacagtggtgaccctgctggagaagctggcctccatgctggagaccctgcgggagcggcagggcggcctggcccggcggcagggcggcctggccggctctgtgcggcgcatccagagcggcctgggcgccctgagccgcagccatgacaccaccagcaacaccctggcccagctgctggccaaggccgagcgggtgagcagccacgccaatgctgcccaggagagagctgtgagaagagctgcccaggtgcagaggctggaggccaaccacggcctgctggtggcccggggcaagctgcacgtgctgctcttcaaggaggagggggaggtgcctgccagcgccttccagaaggcccctgagcccctgggccctgctgaccagagcgagctgggccctgagcagctggaggccgaggtgggggagagcagtgatgaggagcctgtggagagccgggcccagaggctgcggaggacaggcctgcagaaggtgcagagcctgcggcgggccctgagcggcaggaaaggacctgctgcccccccacccacccctgtgaagccaccccggctgggccctggccgctctgctgaggcccagcctgaggcccagcctgccctggagcccaccctggagcctgagcccccccaggacacagaggaggaccccggccggcctggagctgctgaggaggccctgctgcagatggagagcgtggcctag

SEQ ID NO: 21323 - DNA, 2214 bp, Artificial Sequence
  Description of Artificial Sequence: Synthetic coding sequence
atggtggtgttcaacggcctgctgaagatcaagatctgtgaggccgtgtccctgaagcccacagcctggagcctgcggcatgctgtgggcccccggccccagaccttcctgctggacccctacatcgccctgaatgtggatgacagcagaattggccagacagccaccaagcagaagaccaacagccctgcctggcatgatgaatttgtgacagatgtgtgcaatggaaggaagattgagctggccgtgttccatgatgcccccatcggctatgatgactttgtggccaactgcaccatccagtttgaggagctgctgcagaatggcagccgccactttgaggactggattgacctggagcctgagggccgggtgtatgtgatcatcgacctgagcggcagcagtggagaggcccccaaggacaatgaggagagggtcttccgggagaggatgaggcccaggaagaggcagggcgctgtgagaagaagagtgcaccaggtgaatggccacaagttcatggccacctacctgcggcagcccacctactgcagccactgccgggacttcatctggggcgtcatcggcaagcagggctaccagtgccaggtgtgcacctgtgtggtgcacaagcgctgccacgagctgatcatcaccaagtgtgccggcctgaagaagcaggagaccccagaccaggtgggcagccagcgcttctctgtgaacatgccccacaagtttggcatccacaactacaaggtgcccaccttctgtgaccactgcggcagcctgctgtggggcctgctgcggcagggcctgcagtgcaaggtgtgcaagatgaatgtgcaccggcgctgtgagaccaacgtggcccccaactgtggggtggatgcccggggcatcgccaaggtgctggccgacctgggcgtgaccccagacaagatcaccaacagcggccagaggaggaagaagctgattgctggagctgagagcccccagcctgccagcggcagcagccccagtgaagaagatagaagcaagagcgcccccaccagcccctgtgaccaggagatcaaggagctggagaacaacatcaggaaggccctgagctttgacaacagaggagaggagcaccgggccgccagcagcccagatggccagctgatgagccctggagaaaatggagaggtgcggcagggccaggccaagaggctgggcctggatgagttcaacttcatcaaggtgctgggcaagggcagctttgggaaggtgatgctggccgagctgaagggcaaggatgaggtgtatgctgtgaaggtgctgaagaaggatgtgatcctgcaggatgatgatgtggactgcaccatgacagagaagaggatcctggccctggccaggaagcacccctacctgacccagctgtactgctgcttccagaccaaggacaggctcttctttgtgatggagtatgtgaatggaggagacctgatgttccagatccagaggagcaggaagtttgatgagcccaggagccgcttctatgctgctgaggtgaccagcgccctgatgttcctgcaccagcacggcgtcatctacagagacctgaagctggacaacatcctgctggatgctgagggccactgcaagctggccgactttggcatgtgcaaggagggcatcctgaatggagtgaccaccaccaccttctgtggcaccccagactacatcgcccctgagatcctgcaggagctggagtatggccccagcgtggactggtgggccctgggcgtgctgatgtatgagatgatggccggccagcccccatttgaagctgacaatgaagatgacctgtttgagagcatcctgcatgatgatgtgctgtaccctgtgtggctgagcaaggaggccgtgtccatcctgaaggccttcatgaccaagaacccccacaagaggctgggctgtgtggccagccagaatggagaagatgccatcaagcagcaccccttcttcaaggagattgactgggtgctgctggagcagaagaagatcaagccacccttcaagccccgcatcaagaccaagagagatgtgaacaactttgaccaggacttcacccgggaggagcctgtgctgaccctggtggatgaggccatcgtgaagcagatcaaccaggaggagttcaagggcttctcctactttggagaggacctgatgccctag

SEQ ID NO: 21324 - DNA, 384 bp, Artificial Sequence
  Description of Artificial Sequence: Synthetic coding sequence
atggtggtgttcaacggcctgctgaagatcaagatctgtgaggccgtgtccctgaagcccacagcctggagcctgcggcatgctgtgggcccccggccccagaccttcctgctggacccctacatcgccctgaatgtggatgacagcagaattggccagacagccaccaagcagaagaccaacagccctgcctggcatgatgaatttgtgacagatgtgtgcaatggaaggaagattgagctggccgtgttccatgatgcccccatcggctatgatgactttgtggccaactgcaccatccagtttgaggagctgctgcagaatggcagccgccactttgaggactggattgacctggagcctgagggccgggtgtatgtgtag

SEQ ID NO: 21325 - DNA, 2094 bp, Artificial Sequence
  Description of Artificial Sequence: Synthetic coding sequence
atggccggcctgggccctggggtgggggacagcgagggcggcccccggcccctcttctgcaggaagggggccctgcggcagaaggtggtgcatgaggtgaagagccacaagttcaccgcccgcttcttcaagcagcccaccttctgcagccactgcacagacttcatctggggcatcggcaagcagggcctgcagtgccaggtgtgcagctttgtggtgcaccggcgctgccacgagtttgtgacctttgagtgccctggggccggcaagggcccccagacagatgaccccaggaacaagcacaagttccggctgcacagctacagcagccccaccttctgtgaccactgcggcagcctgctgtatggcctggtgcaccagggcatgaagtgcagctgctgtgagatgaatgtgcaccggcgctgtgtgcgctctgtgcccagcctgtgtggggtggaccacacagaaagaagaggccgcctgcagctggagatccgggcccccacagcagatgagatccacgtgacagtgggggaggccaggaacctgatccccatggaccccaacggcctgagtgacccctacgtgaagctgaagctgatcccagaccccaggaacctgaccaagcagaagaccaggacagtgaaggccaccctgaaccctgtgtggaatgagacctttgtgttcaacctgaagccaggagatgtggagcggcggctgtctgtggaggtgtgggactgggacaggaccagcagaaatgacttcatgggcgccatgagctttggagtgtctgagctgctgaaggcccctgtggatggctggtacaagctgctgaaccaggaggagggggagtactacaacgtgcctgtggctgatgctgacaactgcagcctgctgcagaagtttgaggcctgcaactaccccctggagctgtatgaaagagtgaggatgggccccagcagcagccccatccccagccccagccccagccccacagaccccaagcgctgcttctttggagccagccctggccgcctgcacatcagtgacttctccttcctgatggtgctgggcaagggcagctttgggaaggtgatgctggccgagcggcggggcagtgatgagctgtatgccatcaagatcctgaagaaggatgtgattgtgcaggatgatgatgtggactgcaccctggtggagaagagggtgctggccctgggcggccggggccctgggggccggccccacttcctgacccagctgcacagcaccttccagaccccagaccggctgtactttgtgatggagtatgtgactggaggagacctgatgtaccacatccagcagctgggcaagttcaaggagccccatgctgccttctatgctgctgagatcgccatcggcctcttcttcctgcacaaccagggcatcatctacagagacctgaagctggacaacgtgatgctggatgctgagggccacatcaagatcacagactttggcatgtgcaaggaaaatgtgtttcctggcaccaccaccaggaccttctgtggcaccccagactacatcgcccctgagatcatcgcctaccagccctacggcaagtctgtggactggtggagctttggagtgctgctgtatgagatgctggccggccagcccccatttgatggagaagatgaggaggagctgttccaggccatcatggagcagacagtgacctaccccaagagcctgagccgggaggccgtggccatctgcaagggcttcctgaccaagcaccctgggaagaggctgggcagcggcccagatggagagcccaccatccgggcccacggcttcttccgctggattgactgggagcggctggagcggctggagatccccccacccttccggccccggccctgtggccgctctggagaaaattttgacaagttcttcacccgggccgccccagccctgaccccaccagaccggctggtgctggccagcattgaccaggccgacttccagggcttcacctacgtgaacccagactttgtgcacccagatgcccggagccccaccagccctgtgcctgtgcctgtgatgtag

SEQ ID NO: 21326 - DNA, 984 bp, Artificial Sequence
  Description of Artificial Sequence: Synthetic coding sequence
atggccggcctgggccctggggtgggggacagcgagggcggcccccggcccctcttctgcaggaagggggccctgcggcagaaggtggtgcatgaggtgaagagccacaagttcaccgcccgcttcttcaagcagcccaccttctgcagccactgcacagacttcatctggggcatcggcaagcagggcctgcagtgccaggtgtgcagctttgtggtgcaccggcgctgccacgagtttgtgacctttgagtgccctggggccggcaagggcccccagacagatgaccccaggaacaagcacaagttccggctgcacagctacagcagccccaccttctgtgaccactgcggcagcctgctgtatggcctggtgcaccagggcatgaagtgcagctgctgtgagatgaatgtgcaccggcgctgtgtgcgctctgtgcccagcctgtgtggggtggaccacacagaaagaagaggccgcctgcagctggagatccgggcccccacagcagatgagatccacgtgacagtgggggaggccaggaacctgatccccatggaccccaacggcctgagtgacccctacgtgaagctgaagctgatcccagaccccaggaacctgaccaagcagaagaccaggacagtgaaggccaccctgaaccctgtgtggaatgagacctttgtgttcaacctgaagccaggagatgtggagcggcggctgtctgtggaggtgtgggactgggacaggaccagcagaaatgacttcatgggcgccatgagctttggagtgtctgagctgctgaaggcccctgtggatggctggctggtgaccaccccctggaactgcatgagcggctgcggctgggcccccctgcccctgcccagcccccccctgcccctggtgccccccacccccagcgctgccagcagcggccgggtgcaggatgcctgcaccagccccaccagcgccagctcctggttctag

SEQ ID NO: 21327 - DNA, 2133 bp, Artificial Sequence
  Description of Artificial Sequence: Synthetic coding sequence
atggccggcctgggccctggggtgggggacagcgagggcggcccccggcccctcttctgcaggaagggggccctgcggcagaaggtggtgcatgaggtgaagagccacaagttcaccgcccgcttcttcaagcagcccaccttctgcagccactgcacagacttcatctggggcatcggcaagcagggcctgcagtgccaggtgtgcagctttgtggtgcaccggcgctgccacgagtttgtgacctttgagtgccctggggccggcaagggcccccagacagatgaccccaggaacaagcacaagttccggctgcacagctacagcagccccaccttctgtgaccactgcggcagcctgctgtatggcctggtgcaccagggcatgaagtgcagctgctgtgagatgaatgtgcaccggcgctgtgtgcgctctgtgcccagcctgtgtggggtggaccacacagaaagaagaggccgcctgcagctggagatccgggcccccacagcagatgagatccacgtgacagtgggggaggccaggaacctgatccccatggaccccaacggcctgagtgacccctacgtgaagctgaagctgatcccagaccccaggaacctgaccaagcagaagaccaggacagtgaaggccaccctgaaccctgtgtggaatgagacctttgtgttcaacctgaagccaggagatgtggagcggcggctgtctgtggaggtgtgggactgggacaggaccagcagaaatgacttcatgggcgccatgagctttggagtgtctgagctgctgaaggcccctgtggatggctggtacaagctgctgaaccaggaggagggggagtactacaacgtgcctgtggctgatgctgacaactgcagcctgctgcagaagtttgaggcctgcaactaccccctggagctgtatgaaagagtgaggatgggccccagcagcagccccatccccagccccagccccagccccacagaccccaagcgctgcttctttggagccagccctggccgcctgcacatcagtgacttctccttcctgatggtgctgggcaagggcagctttgggaaggtgatgctggccgagcggcggggcagtgatgagctgtatgccatcaagatcctgaagaaggatgtgattgtgcaggatgatgatgtggactgcaccctggtggagaagagggtgctggccctgggcggccggggccctgggggccggccccacttcctgacccagctgcacagcaccttccagaccccagaccggctgtactttgtgatggagtatgtgactggaggagacctgatgtaccacatccagcagctgggcaagttcaaggagccccatgctgccttctatgctgctgagatcgccatcggcctcttcttcctgcacaaccagggcatcatctacagagacctgaagctggacaacgtgatgctggatgctgagggccacatcaagatcacagactttggcatgtgcaaggaaaatgtgtttcctggcaccaccaccaggaccttctgtggcaccccagactacatcgcccctgagatcatcgcctaccagccctacggcaagtctgtggactggtggagctttggagtgctgctgtatgagatgctggccggccagcccccatttgatggagaagatgaggaggagctgttccaggccatcatggagcagacagtgacctaccccaagagcctgagccgggaggccgtggccatctgcaagggcttcctgaccaagcaccctgggaagaggctgggcagcggcccagatggagagcccaccatccgggcccacggcttcttccgctggattgactgggagcggctggagcggctggagatccccccacccttccggccccggccctgtggccgctctggagaaaattttgacaagttcttcacccgggccgccccagccctgaccccaccagaccggctggtgctggccagcattgaccaggccgacttccagggcttcacctacgtgaacccagactttgtgcacccagatgcccggagccccaccagccctgtgcctgtgcctgtgatcagctgcaccccagccttccagctgtgcccccggggcttctag

SEQ ID NO: 21328 - DNA, 1647 bp, Artificial Sequence
  Description of Artificial Sequence: Synthetic coding sequence
atgccccgcatctgtgacctgcgggtgtcccggcgctgggagggccccccagatggccgctgtgagatgaatgtgcacagaagatgtgtgcgctctgtgcccagcctgtgtggggtggaccacacagagcggcggggccgcctgcagctggagatccgggcccccacagcagatgagatccacgtgacagtgggggaggccaggaacctgatccccatggaccccaacggcctgagtgacccctacgtgaagctgaagctgatcccagaccccaggaacctgaccaagcagaagaccaggacagtgaaggccaccctgaaccctgtgtggaatgagacctttgtgttcaacctgaagccaggagatgtggagcggcggctgtctgtggaggtgtgggactgggacaggaccagcagaaatgacttcatgggcgccatgagctttggagtgtctgagctgctgaaggcccctgtggatggctggtacaagctgctgaaccaggaggagggggagtactacaacgtgcctgtggctgatgctgacaactgcagcctgctgcagaagtttgaggcctgcaactaccccctggagctgtatgagcgggtgaggatgggccccagcagcagccccatccccagccccagccccagccccacagaccccaagcgctgcttcttcggggccagccctggccgcctgcacatcagtgacttctccttcctgatggtgctgggcaagggcagctttgggaaggtgatgctggccgagcggcggggcagtgatgagctgtatgccatcaagatcctgaagaaggatgtgattgtgcaggatgatgatgtggactgcaccctggtggagaagagggtgctggccctgggcggccggggccctgggggccggccccacttcctgacccagctgcacagcaccttccagaccccagaccggctgtactttgtgatggagtatgtgactggaggagacctgatgtaccacatccagcagctgggcaagttcaaggagccccacgccgccttctacgccgctgagatcgccatcggcctcttcttcctgcacaaccagggcatcatctacagagacctgaagctggacaacgtgatgctggatgctgagggccacatcaagatcacagactttggcatgtgcaaggaaaatgtgtttcctggcaccaccaccaggaccttctgtggcaccccagactacatcgcccctgagatcatcgcctaccagccctacggcaagtctgtggactggtggagctttggagtgctgctgtatgagatgctggccggccagttcctgaccaagcaccctgggaagaggctgggcagcggcccagatggagagcccaccatccgggcccacggcttcttccgctggattgactgggagcggctggagcggctggagatccccccacccttccggccccggccctgtggccgcagcggggagaactttgacaagttcttcaccagggctgccccagccctgaccccaccagaccggctggtgctggccagcattgaccaggccgacttccagggcttcacctacgtgaacccagactttgtgcacccagatgcccggagccccaccagccctgtgcctgtgcctgtgatgtag

SEQ ID NO: 21329 - DNA, 1779 bp, Artificial Sequence
  Description of Artificial Sequence: Synthetic coding sequence
atgcccagcaggacaggccccaagatggagggcagcggcggccgggtgcggctgaaggcccactacggcggggacatcttcatcacctctgtggatgctgccaccacctttgaggagctgtgtgaggaggtgcgggacatgtgccgcctgcaccagcagcaccccctgaccctgaagtgggtggacagcgagggggacccctgcaccgtgagcagccagatggagctggaggaggccttccggctggcccggcagtgcagagatgagggcctcatcatccacgtgttccccagcaccccagagcagcccggcctgccctgccctggagaggacaagagcatctaccgccgcggggcccggcgctggaggaagctgtaccgggccaacggccacctgttccaggccaagcgcttcaacagaagagcctactgcggccagtgcagcgagcgcatctggggcctggcccggcagggctaccgctgcatcaactgcaagctgctggtgcacaagcgctgccacggcctggtgcccctgacctgcaggaagcacatggacagcgtgatgcccagccaggagccccctgtggatgacaagaatgaagatgctgacctgcccagcgaggagacagatggcatcgcctacatcagcagcagcaggaagcatgacagcatcaaggatgacagcgaggacctgaagcctgtgattgatggcatggatggcatcaagatcagccagggcctgggcctgcaggactttgacctgatccgggtcatcggccggggcagctatgccaaggtgctgctggtgcggctgaagaagaatgaccagatctatgccatgaaggtggtgaagaaggagctggtgcatgatgatgaggacatcgactgggtgcagacagagaagcacgtgtttgagcaggccagcagcaaccccttcctggtgggcctgcacagctgcttccagaccaccagccgcctcttcctggtgattgaatatgtgaatggaggagacctgatgttccacatgcagaggcagaggaagctgcctgaggagcacgcccgcttctatgctgctgagatctgcatcgccctgaacttcctgcacgagcggggcatcatctacagagacctgaagctggacaacgtgctgctggatgctgatggccacatcaagctgacagattatggcatgtgcaaggagggcctgggccctggggacaccaccagcaccttctgtggcacccccaactacatcgcccctgagatcctgcggggggaggagtatggcttctctgtggactggtgggccctgggcgtgctgatgtttgagatgatggccggccgcagcccctttgacatcatcacagacaacccagacatgaacacagaggactacctgttccaggtgatcctggagaagcccatccgcatcccccgcttcctgtctgtgaaggccagccacgtgctgaagggcttcctgaacaaggaccccaaggagcggctgggctgccggccccagacaggcttcagtgacatcaagagccacgccttcttccgcagcattgactgggacctgctggagaagaagcaggccctgccccccttccagccccagatcacagatgattatggcctggacaactttgacacccagttcaccagcgagcctgtgcagctgaccccagatgatgaagatgccatcaagagaattgaccagagcgagtttgagggctttgagtacatcaaccccctgctgctgagcacagaggagagcgtgtag

SEQ ID NO: 21330 - DNA, 1230 bp, Artificial Sequence
  Description of Artificial Sequence: Synthetic coding sequence
atggattctgtgatgcccagccaggagccccctgtggatgacaagaatgaagatgctgacctgcccagcgaggagacagatggcatcgcctacatcagcagcagcaggaagcatgacagcatcaaggatgattctgaggacctgaagcctgtgattgatggcatggatggcatcaagatcagccagggcctgggcctgcaggactttgacctgatccgggtgattggccggggcagctatgccaaggtgctgctggtgcggctgaagaagaatgaccagatctatgccatgaaggtggtgaagaaggagctggtgcatgatgatgaagatattgactgggtgcagacagagaagcacgtgtttgagcaggccagcagcaaccccttcctggtgggcctgcacagctgcttccagaccaccagccgcctcttcctggtgattgaatatgtgaatggaggagacctgatgttccacatgcagaggcagaggaagctgcctgaggagcacgcccgcttctacgccgctgagatctgcatcgccctgaacttcctgcacgagcggggcatcatctacagagacctgaagctggacaacgtgctgctggatgctgatggccacatcaagctgacagattatggcatgtgcaaggagggcctgggccctggggacaccaccagcaccttctgtggcacccccaactacatcgcccctgagatcctgcggggggaggagtatggcttctctgtggactggtgggccctgggcgtgctgatgtttgagatgatggccggccgcagcccctttgacatcatcacagacaacccagacatgaacacagaggactacctgttccaggtgatcctggagaagcccatccgcatcccccgcttcctgtctgtgaaggccagccacgtgctgaagggcttcctgaacaaggaccccaaggagcggctgggctgccggccccagacaggcttcagtgacatcaagagccacgccttcttccgcagcattgactgggacctgctggagaagaagcaggccctgccccccttccagccccagatcacagatgattatggcctggacaactttgacacccagttcaccagcgagcctgtgcagctgaccccagatgatgaagatgccatcaagagaattgaccagagcgagtttgagggctttgagtacatcaaccccctgctgctgagcacagaggagagcgtgtag

SEQ ID NO: 21331 - DNA, 1230 bp, Artificial Sequence; identical to SEQ ID NO: 21330
  Description of Artificial Sequence: Synthetic coding sequence

SEQ ID NO: 21332 - DNA, 1467 bp, Artificial Sequence
  Description of Artificial Sequence: Synthetic coding sequence
atgctgacccccaggacagatgagagcatctaccgccgcggggcccggcgctggaggaagctgtaccgggccaacggccacctgttccaggccaagcgcttcaacagaagagcctactgcggccagtgcagcgagcgcatctggggcctggcccggcagggctaccgctgcatcaactgcaagctgctggtgcacaagcgctgccacggcctggtgcccctgacctgcaggaagcacatggacagcgtgatgcccagccaggagccccctgtggatgacaagaatgaagatgctgacctgcccagcgaggagacagatggcatcgcctacatcagcagcagcaggaagcatgacagcatcaaggatgacagcgaggacctgaagcctgtgattgatggcatggatggcatcaagatcagccagggcctgggcctgcaggactttgacctgatccgggtcatcggccggggcagctatgccaaggtgctgctggtgcggctgaagaagaatgaccagatctatgccatgaaggtggtgaagaaggagctggtgcatgatgatgaggacatcgactgggtgcagacagagaagcacgtgtttgagcaggccagcagcaaccccttcctggtgggcctgcacagctgcttccagaccaccagccgcctcttcctggtgattgaatatgtgaatggaggagacctgatgttccacatgcagaggcagaggaagctgcctgaggagcacgcccgcttctatgctgctgagatctgcatcgccctgaacttcctgcacgagcggggcatcatctacagagacctgaagctggacaacgtgctgctggatgctgatggccacatcaagctgacagattatggcatgtgcaaggagggcctgggccctggggacaccaccagcaccttctgtggcacccccaactacatcgcccctgagatcctgcggggggaggagtatggcttctctgtggactggtgggccctgggcgtgctgatgtttgagatgatggccggccgcagcccctttgacatcatcacagacaacccagacatgaacacagaggactacctgttccaggtgatcctggagaagcccatccgcatcccccgcttcctgtctgtgaaggccagccacgtgctgaagggcttcctgaacaaggaccccaaggagcggctgggctgccggccccagacaggcttcagtgacatcaagagccacgccttcttccgcagcattgactgggacctgctggagaagaagcaggccctgccccccttccagccccagatcacagatgattatggcctggacaactttgacacccagttcaccagcgagcctgtgcagctgaccccagatgatgaagatgccatcaagagaattgaccagagcgagtttgagggctttgagtacatcaaccccctgctgctgagcacagaggagagcgtgtag

SEQ ID NO: 21333 - DNA, 78 bp, Artificial Sequence
  Description of Artificial Sequence: Synthetic coding sequence
atggattctgtgatgcccagccaggagccccctgtggatgacaagaatgaagatgctgacctgcccagcgaggagtag

SEQ ID NO: 21334 - DNA, 249 bp, Artificial Sequence
  Description of Artificial Sequence: Synthetic coding sequence
atggattctgtgatgcccagccaggagccccctgtggatgacaagaatgaagatgctgacctgcccagcgaggagacagatggcatcgcctacatcagcagcagcaggaagcatgacagcatcaaggatgattctgaggacctgaagcctgtgattgatggcatggatggcatcaagatcagccagggcctgggcctgcaggactttgacctgatccgggtgattggccggggcagctatgccaagtag

SEQ ID NO: 21335 - DNA, 297 bp, Artificial Sequence
  Description of Artificial Sequence: Synthetic coding sequence
atggattctgtgatgcccagccaggagccccctgtggatgacaagaatgaagatgctgacctgcccagcgaggagacagatggcatcgcctacatcagcagcagcaggaagcatgacagcatcaaggatgattctgaggacctgaagcctgtgattgatggcatggatggcatcaagatcagccagggcctgggcctgcaggactttgacctgatccgggtgattggccggggcagctatgccaaggtgctgctggtgcggctgaagaagaatgaccagatctatgccatgaagtag

SEQ ID NO: 21336 - DNA, 330 bp, Artificial Sequence
  Description of Artificial Sequence: Synthetic coding sequence
atggattctgtgatgcccagccaggagccccctgtggatgacaagaatgaagatgctgacctgcccagcgaggagacagatggcatcgcctacatcagcagcagcaggaagcatgacagcatcaaggatgattctgaggacctgaagcctgtgattgatggcatggatggcatcaagatcagccagggcctgggcctgcaggactttgacctgatccgggtgattggccggggcagctatgccaaggtgctgctggtgcggctgaagaagaatgaccagatctatgccatgaaggtggtgaagaaggagctggtgcatgatgatgaatag

SEQ ID NO: 21337 - DNA, 141 bp, Artificial Sequence
  Description of Artificial Sequence: Synthetic coding sequence
atggattctgtgatgcccagccaggagccccctgtggatgacaagaatgaagatgctgacctgcccagcgaggagacagatggcatcgcctacatcagcagcagcaggaagcatgacagcatcaaggatgattctgagtag

SEQ ID NO: 21338 - DNA, 222 bp, Artificial Sequence
  Description of Artificial Sequence: Synthetic coding sequence
atggattctgtgatgcccagccaggagccccctgtggatgacaagaatgaagatgctgacctgcccagcgaggagacagatggcatcgcctacatcagcagcagcaggaagcatgacagcatcaaggatgattctgaggacctgaagcctgtgattgatggcatggatggcatcaagatcagccagggcctgggcctgcaggactttgacctgatcagatag

SEQ ID NO: 21339 - DNA, 66 bp, Artificial Sequence
  Description of Artificial Sequence: Synthetic coding sequence
atggattctgtgatgcccagccaggagccccctgtggatgacaagaatgaagatgctgacctgtag

SEQ ID NO: 21340 - DNA, 216 bp, Artificial Sequence
  Description of Artificial Sequence: Synthetic coding sequence
atggattctgtgatgcccagccaggagccccctgtggatgacaagaatgaagatgctgacctgcccagcgaggagacagatggcatcgcctacatcagcagcagcaggaagcatgacagcatcaaggatgattctgaggacctgaagcctgtgattgatggcatggatggcatcaagatcagccagggcctgggcctgcaggactttgacctgtag

SEQ ID NO: 21341 - DNA, 417 bp, Artificial Sequence
  Description of Artificial Sequence: Synthetic coding sequence
atgatcagcctgacagacacccagaagattggcatgggcctgactggatttggagtcttcttcctgttcttcggcatgatcctcttctttgacaaggccctgctggccatcggaaatgtgctgtttgtggccggcctggccttcgtcatcggcctggagaggaccttccgcttcttcttccagaagcacaagatgaaggccaccggcttcttcctgggcggcgtgtttgtggtgctgattggctggcccctgattggcatgatctttgagatctacggcttcttcctgctcttccggggcttcttccctgtggtggtgggcttcatccggcgggtgcctgtgctgggcagcctgctgaacctgcccggcatccgcagctttgtggacaaggtgggggagagcaacaacatggtgtag

SEQ ID NO: 21342 - DNA, 702 bp, Artificial Sequence
  Description of Artificial Sequence: Synthetic coding sequence
atggacagcccagaagatgctgacctcttccacagcgaggagatcaaggcccctgagaaggaggagttcctggcctggcagcacgacctggaggtgaatgacaaggccccagcccaggcccggcccaccgtcttccgctggacaggaggcggcaaggaggtgtacctgagcggcagcttcaacaactggagcaagctgcccctgaccaggagccacaacaactttgtggccatcctggacctgcctgagggggagcaccagtacaagttctttgtggatggccagtggacccatgaccccagcgagcccatcgtgaccagccagctgggcaccgtgaacaacatcatccaggtgaagaagacagactttgaggtgtttgatgccctgatggtggacagccagaagtgcagtgatgtgtctgagctgagcagcagccccccaggcccctaccaccaggagccctacgtgtgcaagccagaggagcgcttccgggccccacccatcctgcccccccacctgctgcaggtgatcctgaacaaggacaccggcatcagctgtgaccctgccctgctgcctgagcccaaccacgtgatgctgaaccacctgtatgccctgagcatcaaggatggagtgatggtgctgagcgccacccaccgctacaagaagaagtatgtgaccaccctgctgtacaagcccatctag

SEQ ID NO: 21343 - DNA, 813 bp, Artificial Sequence
  Description of Artificial Sequence: Synthetic coding sequence
atgggcaacaccagcagcgagagagctgccctggagcggcacggcggccacaagaccccaagaagagacagcagcggcggcaccaaggatggagaccggcccaagatcctgatggacagcccagaagatgctgacctcttccacagcgaggagatcaaggcccctgagaaggaggagttcctggcctggcagcacgacctggaggtgaatgacaaggccccagcccaggcccggcccaccgtcttccgctggacaggaggcggcaaggaggtgtacctgagcggcagcttcaacaactggagcaagctgcccctgaccaggagccacaacaactttgtggccatcctggacctgcctgagggggagcaccagtacaagttctttgtggatggccagtggacccatgaccccagcgagcccatcgtgaccagccagctgggcaccgtgaacaacatcatccaggtgaagaagacagactttgaggtgtttgatgccctgatggtggacagccagaagtgcagtgatgtgtctgagctgagcagcagccccccaggcccctaccaccaggagccctacgtgtgcaagccagaggagcgcttccgggccccacccatcctgcccccccacctgctgcaggtgatcctgaacaaggacaccggcatcagctgtgaccctgccctgctgcctgagcccaaccacgtgatgctgaaccacctgtatgccctgagcatcaaggatggagtgatggtgctgagcgccacccaccgctacaagaagaagtatgtgaccaccctgctgtacaagcccatctag

SEQ ID NO: 21344 - DNA, 12384 bp, Artificial Sequence
  Description of Artificial Sequence: Synthetic coding sequence
atggccggcagcggggccggcgtgcgctgcagcctgctgcggctgcaggagaccctgtctgctgctgacagatgtggggccgccctggccggccaccagctgatccggggcctgggccaggagtgtgtgctgagcagcagccctgctgtgctggccctgcagaccagcctggtgttcagccgggactttggcctgctggtgtttgtgaggaagagcctgaacagcattgagttccgggagtgccgggaggagatcctgaagttcctgtgcatcttcctggagaagatgggccagaagatcgccccctacagcgtggagatcaagaacacctgcacctctgtgtacaccaaggaccgggccgccaagtgcaagatcccagccctggacctgctgatcaagctgctgcagaccttccgcagcagccggctgatggatgagttcaagattggagagctgttcagcaagttctatggagagctggccctgaagaagaagatcccagacacagtgctggagaaggtgtatgagctgctgggcctgctgggggaggtgcaccccagcgagatgatcaacaatgctgagaacctcttccgggccttcctgggggagctgaagacccagatgaccagcgctgtgcgggagcccaagctgcctgtgctggccggctgcctgaagggcctgagcagcctgctgtgcaacttcaccaagtccatggaggaggacccccagaccagccgggagatcttcaactttgtgctgaaggccatccggccccagattgacctgaagagatatgctgtgcccagcgctggcctgcggctgtttgccctgcacgccagccagttcagcacctgcctgctggacaactacgtgtccctgtttgaggtgctgctgaagtggtgtgcccacaccaacgtggagctgaagaaggccgccctgagcgccctggagagcttcctgaagcaggtgagcaacatggtggccaagaatgctgagatgcacaagaacaagctgcagtacttcatggagcagttctacggcatcatcagaaatgtggacagcaacaacaaggagctgagcatcgccatccggggctacggcctgtttgctggcccctgcaaggtgatcaatgccaaggatgtggacttcatgtatgtggagctgatccagcgctgcaagcagatgttcctgacccagacagacacaggagatgacagagtgtaccagatgcccagcttcctgcagagcgtggcctctgtgctgctgtacctggacacagtgcctgaggtgtacacccctgtgctggagcacctggtggtgatgcagattgacagcttcccccagtacagccccaagatgcagctggtgtgctgccgggccatcgtgaaggtgttcctggccctggccgccaagggccctgtgctgaggaactgcatcagcacagtggtgcaccagggcctcatccgcatctgcagcaagcctgtggtgctgcccaagggccctgagagcgagagcgaggaccaccgggccagcggggaggtgaggacaggcaagtggaaggtgcccacctacaaggactatgtggacctcttccgccacctgctgagcagtgaccagatgatggacagcatcctggctgatgaggccttcttctctgtgaacagcagcagcgagagcctgaaccacctgctgtatgatgaatttgtgaagtctgtgctgaagatcgtggagaagctggacctgaccctggagatccagacagtgggggagcaggagaatggagatgaggcccctggggtgtggatgatccccaccagtgaccctgctgccaacctgcacccagccaagcccaaggacttcagcgccttcatcaacctggtggagttctgccgggagatcctgcctgagaagcaggccgagttctttgagccctgggtgtacagcttctcctatgagctgatcctgcagagcacccggctgcccctcatcagcggcttctacaagctgctgagcatcaccgtgagaaatgccaagaagatcaagtactttgaaggagtgagccccaagagcctgaagcacagccctgaggaccctgagaagtacagctgctttgccctgtttgtgaagtttgggaaggaggtggccgtgaagatgaagcagtacaaggatgagctgctggccagctgcctgaccttcctgctgagcctgccccacaacatcatcgagctggatgtgcgggcctacgtgcctgccctgcagatggccttcaagctgggcctgagctacacccccctggccgaggtgggcctgaatgccctggaggagtggagcatctacatcgacagacatgtgatgcagccctactacaaggacatcctgccctgcctggatggctacctgaagaccagcgccctgagtgatgagaccaagaacaactgggaggtgtctgccctgagcagagctgcccagaagggcttcaacaaggtggtgctgaagcacctgaagaagaccaagaacctgagcagcaatgaggccatcagcctggaggagatccgcatccgggtggtgcagatgctgggcagcctgggcggccagatcaacaagaacctgctgactgtgaccagcagtgatgagatgatgaagagctatgtggcctgggaccgggagaagaggctgagctttgctgtgcccttccgggagatgaagcctgtgatcttcctggatgtgttcctgccccgggtgacagagctggccctgacagccagtgaccggcagaccaaggtggccgcctgtgagctgctgcacagcatggtgatgttcatgctgggcaaggccacccagatgcctgagggcggccagggcgccccacccatgtaccagctgtacaagaggaccttccctgtgctgctgcggctggcctgtgatgtggaccaggtgacccggcagctgtatgagcccctggtgatgcagctgatccactggttcaccaacaacaagaagtttgagagccaggacacagtggccctgctggaggccatcctggatggcatcgtggaccctgtggacagcaccctgcgggacttctgtggccgctgcatccgggagttcctgaagtggagcatcaagcagatcaccccccagcagcaggagaagagccctgtgaacaccaagagcctcttcaagaggctgtacagcctggccctgcaccccaatgccttcaagaggctgggcgccagcctggccttcaacaacatctaccgggagttccgggaggaggagagcctggtggagcagtttgtgtttgaggccctggtgatctacatggagagcctggccctggcccacgcagatgagaagagcctgggcaccatccagcagtgctgtgatgccatcgaccacctgtgccgcatcatcgagaagaagcacgtgtccctgaacaaggccaagaagaggcggctgccccggggcttcccccccagcgccagcctgtgcctgctggacctggtgaagtggctgctggcccactgcggccggccccagacagagtgccgccacaagagcattgagctgttctacaagtttgtgcccctgctgcccggcaacagaagccccaacctgtggctgaaggatgtgctgaaggaggagggcgtgtccttcctgatcaacacctttgagggcggcggctgcggccagcccagcggcatcctggcccagcccaccctgctgtaccggggccccttcagcctgcaggccaccctgtgctggctggacctgctgctggccgccctggagtgctacaacaccttcatcggggagaggacagtgggcgccctgcaggtgctgggcacagaggcccagagcagcctgctgaaggctgtggccttcttcctggagagcatcgccatgcatgacatcatcgctgctgagaagtgcttcggcaccggggctgctggcaacagaaccagcccccaggagggggagcgctacaactacagcaaatgtactgtggtggtgcgcatcatggagttcaccaccaccctgctgaacaccagccctgagggctggaagctgctgaagaaggacctgtgcaacacccacctgatgagggtgctggtgcagaccctgtgtgagcccgccagcatcggcttcaacattggagatgtgcaggtgatggcccacctgcctgatgtgtgtgtgaacctgatgaaggccctgaagatgagcccctacaaggacatcctggagacccacctgcgggagaagatcacagcccagagcattgaggagctgtgtgctgtgaacctgtatggcccagatgcccaggtggacaggagccggctggccgctgtggtgtctgcctgcaagcagctgcaccgggccggcctgctgcacaacatcctgcccagccagagcacagacctgcaccacagcgtgggcacagagctgctgagcctggtgtacaagggcatcgcccctggagatgagcggcagtgcctgcccagcctggacctgagctgcaagcagctggccagcggcctgctggagctggcctttgccttcggcggcctgtgtgagcggctggtgtccctgctgctgaacccagctgtgctgagcacagccagcctgggcagcagccagggcagcgtcatccacttcagccacggggagtacttctacagcctcttcagcgagaccatcaacacagagctgctgaagaacctggacctggccgtgctggagctgatgcagagctctgtggacaacaccaagatggtgtctgctgtgctgaatggcatgctggaccagagcttccgggagcgggccaaccagaagcaccagggcctgaagctggccaccaccatcctgcagcactggaagaagtgtgacagctggtgggccaaggacagccccctggagaccaagatggctgtgctggccctgctggccaagatcctgcagattgacagctctgtgtccttcaacaccagccacggcagcttccctgaggtgttcaccacctacatcagcctgctggccgacaccaagctggacctgcacctgaagggccaggccgtgaccctgctgcccttcttcaccagcctgaccggcggcagcctggaggagctgcggcgggtgctggagcagctgattgtggcccacttccccatgcagagccgggagttccccccaggcaccccccgcttcaacaactacgtggactgcatgaagaagttcctggatgccctggagctgagccagagccccatgctgctggagctgatgacagaggtgctgtgccgggagcagcagcacgtgatggaggagctgttccagagcagcttccgccgcatcgcccggcggggcagctgtgtgacccaggtgggcctgctggagagcgtgtatgagatgttcaggaaggatgacccccggctgtccttcacccggcagagctttgtggacaggagcctgctgaccctgctgtggcactgcagcctggatgccctgcgggagttcttcagcaccatcgtggtggatgccattgatgtgctgaagagccgcttcaccaagctgaatgaaagcacctttgacacccagatcaccaagaagatgggctactacaagatcctggatgtgatgtacagccggctgcccaaggatgatgtgcacgccaaggagagcaagatcaaccaggtgttccacggcagctgcatcacagagggcaatgagctgaccaagaccctcatcaagctgtgctatgatgccttcacagagaacatggccggggagaaccagctgctggagcggcggcggctgtaccactgtgccgcctacaactgtgccatcagcgtcatctgctgcgtgttcaatgagctgaagttctaccagggcttcctgttcagcgagaagccagagaagaacctgctgatctttgagaacctgattgacctgaagaggcgctacaacttccctgtggaggtggaggtgcccatggagaggaagaagaagtacatcgagatcaggaaggaggcccgggaggccgccaatggagacagtgatggccccagctacatgagcagcctgagctacctggccgacagcaccctgtctgaggagatgagccagtttgacttcagcactggagtgcagagctacagctacagcagccaggaccccaggcctgccaccggccgcttcagaagaagagagcagagggaccccaccgtgcatgatgatgtgctggagctggagatggatgagctgaacagacatgagtgcatggcccccctgacagccctggtgaagcacatgcacaggagcctgggccccccccagggcgaggaggacagcgtgccccgggacctgcccagctggatgaagttcctgcacggcaagctgggcaaccccatcgtgcccctgaacatccgcctcttcctggccaagctggtgatcaacacagaggaggtgttccggccctatgccaagcactggctgagccccctgctgcagctggccgccagcgagaacaacggcggggagggcatccactacatggtggtggagatcgtggccaccatcctgtcctggacaggcctggccacccccaccggggtgcccaaggatgaggtgctggccaaccggctgctgaacttcctgatgaagcacgtgttccaccccaagagagctgtgttccgccacaacctggagatcatcaagaccctggtggagtgctggaaggactgcctgagcatcccctaccgcctcatctttgagaagttcagcggcaaggaccccaacagcaaggacaacagcgtgggcatccagctgctgggcatcgtgatggccaatgacctgcccccctatgacccccagtgtggcatccagagcagcgagtacttccaggccctggtgaacaacatgagctttgtgcgctacaaggaggtgtatgctgctgctgctgaggtgctgggcctcatcctgcgctacgtgatggagaggaagaacatcctggaggagagcctgtgtgagctggtggccaagcagctgaagcagcaccagaacaccatggaggacaagttcatcgtgtgcctgaacaaggtgaccaagagcttcccccccctggccgaccgcttcatgaatgctgtgttcttcctgctgcccaagttccatggagtgctgaagaccctgtgcctggaggtggtgctgtgccgggtggagggcatgacagagctgtacttccagctgaagagcaaggactttgtgcaggtgatgaggcacagagatgatgagcggcagaaggtgtgcctggacatcatctacaagatgatgcccaagctgaagcctgtggagctgcgggagctgctgaaccctgtggtggagtttgtgagccaccccagcaccacctgccgggagcagatgtacaacatcctgatgtggattcatgacaactacagagatcctgagagcgagacagacaatgacagccaggagatcttcaagctggccaaggatgtgctgatccagggcctgattgatgagaaccctggcctgcagctgatcatccggaacttctggagccatgagacccggctgcccagcaacaccctggaccggctgctggccctgaacagcctgtacagccccaagattgaggtgcacttcctgagcctggccaccaacttcctgctggagatgacctccatgagcccagactaccccaaccccatgtttgagcaccccctgtctgaatgtgagttccaggagtacaccatcgacagcgactggaggttccgcagcacagtgctgacccccatgtttgtggagacccaggccagccagggcaccctgcagaccaggacccaggagggcagcctgagcgcccgctggcctgtggccggccagatccgggccacccagcagcagcacgacttcaccctgacccagacagcagatggccgcagcagctttgactggctgaccggcagcagcacagaccccctggtggaccacaccagccccagcagtgacagcctgctgtttgcccacaagaggtctgagcggctgcagagggcccccctgaagtctgtgggccctgactttgggaagaagaggctgggcctgcctggagatgaggtggacaacaaggtgaagggagctgctggccgcacagacctgctgcggctgcggcggcgcttcatgagggaccaggagaagctgagcctgatgtatgccaggaaaggagtggccgagcagaagcgggagaaggagatcaagtctgagctgaagatgaagcaggatgcccaggtggtgctgtaccgcagctaccgccacggggacctgcctgacatccagatcaagcacagcagcctcatcacccccctgcaggccgtggcccagagggaccccatcatcgccaagcagctgttcagcagcctcttcagcggcatcctgaaggagatggacaagttcaagaccctgtctgagaagaacaacatcacccagaagctgctgcaggacttcaaccgcttcctgaacaccaccttctccttcttccccccatttgtgtcctgcatccaggacatcagctgccagcacgccgccctgctgagcctggaccctgctgctgtgtctgctggctgcctggccagcctgcagcagcctgtgggcatccggctgctggaggaggccctgctgcggctgctgcctgctgagctgcctgccaagagggtgcggggcaaggcccggctgcccccagatgtgctgcgctgggtggagctggccaagctgtaccgcagcatcggggagtatgatgtgctgcggggcatcttcaccagcgagatcggcaccaagcagatcacccagagcgccctgctggccgaggcccggagtgactacagcgaggccgccaagcagtatgatgaggccctgaacaagcaggactgggtggatggagagcccacagaggccgagaaggacttctgggagctggccagcctggactgctacaaccacctggccgagtggaagagcctggagtactgcagcacagccagcattgacagtgaaaatcctccagacctgaacaagatctggagcgagcccttctaccaggagacctacctgccctacatgatccgcagcaagctgaagctgctgctgcagggcgaggccgaccagagcctgctgaccttcatcgacaaggccatgcatggagagctgcagaaggccatcctggagctgcactacagccaggagctgagcctgctgtacctgctgcaggatgatgtggaccgggccaagtactacatccagaatggcatccagagcttcatgcagaactacagcagcattgatgtgctgctgcaccagagccggctgaccaagctgcagagcgtgcaggccctgacagagatccaggagttcatctccttcatcagcaagcagggcaacctgagcagccaggtgcccctgaagaggctgctgaacacctggaccaaccgctacccagatgccaagatggaccccatgaacatctgggatgacatcatcaccaaccgctgcttcttcctgagcaagattgaggagaagctgacccccctgcctgaggacaacagcatgaatgtggaccaggatggagaccccagcgacaggatggaggtgcaggagcaggaggaggacatcagcagcctcatccgcagctgcaagttctccatgaagatgaagatgattgacagcgccaggaagcagaacaacttcagcctggccatgaagctgctgaaggagctgcacaaggagagcaagaccagagatgactggctggtgtcctgggtgcagagctactgccgcctgagccactgccgcagccgcagccagggctgcagcgagcaggtgctgactgtgctgaagacagtgtccctgctggatgagaacaacgtgtcctcctacctgagcaagaacatcctggccttccgggaccagaacatcctgctgggcaccacctaccgcatcatcgccaatgccctgagcagcgagcccgcctgcctggccgagattgaggaggacaaggcccggcgcatcctggagctgagcggcagcagcagtgaagattctgagaaggtgattgctggcctgtaccagagggccttccagcacctgtctgaggccgtgcaggccgctgaggaggaggcccagcccccatcctggagctgtggccctgctgctggggtgattgatgcctacatgaccctggccgacttctgtgaccagcagctgaggaaggaggaggagaatgcctctgtgattgattctgctgagctgcaggcctacccagccctggtggtggagaagatgctgaaggccctgaagctgaacagcaatgaggcccggctgaagttcccccggctgctgcagatcatcgagcgctacccagaggagaccctgagcctgatgaccaaggagatcagctctgtgccctgctggcagttcatctcctggatcagccacatggtggccctgctggacaaggaccaggccgtggccgtgcagcacagcgtggaggagatcacagacaactacccccaggccatcgtgtaccccttcatcatcagcagcgagagctacagcttcaaggacaccagcacaggccacaagaacaaggagtttgtggcccgcatcaagagcaagctggaccagggcggcgtcatccaggacttcatcaatgccctggaccagctgagcaaccctgagctgctcttcaaggactggagcaatgatgtgcgggcagagctggccaagacccctgtgaacaagaagaacatcgagaagatgtatgaaagaatgtatgctgccctgggggaccccaaggcccctggcctgggcgccttccggaggaagttcatccagaccttcggcaaggagtttgacaagcactttggaaaaggaggcagcaagctgctgaggatgaagctgagtgacttcaatgacatcaccaacatgctgctgctgaagatgaacaaggacagcaagcccccaggcaacctgaaggaatgtagcccctggatgtctgacttcaaggtggagttcctgagaaatgagctggagatccctggccagtatgatggccggggcaagcccctgcctgagtaccacgtgagaattgctggctttgatgagcgggtgacagtgatggccagcctgcggcggcccaagaggatcatcatccggggccatgatgagcgggagcaccccttcctggtgaagggaggagaggacctgcggcaggaccagagggtggagcagctgttccaggtgatgaatggcatcctggcccaggacagcgcctgcagccagagggccctgcagctgcggacctacagcgtggtgcccatgaccagccggctgggcctcatcgagtggctggagaacacagtgaccctgaaggacctgctgctgaacaccatgagccaggaggagaaggccgcctacctgagtgacccccgggccccaccctgtgagtacaaggactggctgaccaagatgtctgggaagcatgatgtgggcgcctacatgctgatgtacaagggggccaacagaacagagaccgtgaccagcttcaggaagcgggagagcaaggtgcctgctgacctgctgaagagggcctttgtgaggatgagcaccagccctgaggccttcctggccctgcggagccactttgccagcagccacgccctgatctgcatcagccactggatcctgggcattggagacagacacctgaacaacttcatggtggccatggagactggaggagtgattggaattgactttggacatgcctttggaagtgccacccagttcctgcctgtgcctgagctgatgcccttccggctgacccggcagttcatcaacctgatgctgcccatgaaggagaccggcctgatgtacagcatcatggtgcacgccctgcgggccttcagaagtgaccccggcctgctgaccaacaccatggatgtgtttgtgaaggagcccagctttgactggaagaactttgagcagaagatgctgaagaagggcggctcctggatccaggagatcaacgtggccgagaagaactggtacccccggcagaagatctgctacgccaagaggaagctggccggggccaacccagctgtgatcacctgtgatgagctgctgctgggccacgagaaggccccagccttccgggactatgtggccgtggcccggggcagcaaggaccacaacatccgggcccaggagcctgagagcggcctgtctgaggagacccaggtgaagtgcctgatggaccaggccacagaccccaacatcctgggccgcacctgggagggctgggagccctggatgtag

SEQ ID NO: 21345 - DNA, 12291 bp, Artificial Sequence
  Description of Artificial Sequence: Synthetic coding sequence
atggccggcagcggggccggcgtgcgctgcagcctgctgcggctgcaggagaccctgtctgctgctgacagatgtggggccgccctggccggccaccagctgatccggggcctgggccaggagtgtgtgctgagcagcagccctgctgtgctggccctgcagaccagcctggtgttcagccgggactttggcctgctggtgtttgtgaggaagagcctgaacagcattgagttccgggagtgccgggaggagatcctgaagttcctgtgcatcttcctggagaagatgggccagaagatcgccccctacagcgtggagatcaagaacacctgcacctctgtgtacaccaaggaccgggccgccaagtgcaagatcccagccctggacctgctgatcaagctgctgcagaccttccgcagcagccggctgatggatgagttcaagattggagagctgttcagcaagttctatggagagctggccctgaagaagaagatcccagacacagtgctggagaaggtgtatgagctgctgggcctgctgggggaggtgcaccccagcgagatgatcaacaatgctgagaacctcttccgggccttcctgggggagctgaagacccagatgaccagcgctgtgcgggagcccaagctgcctgtgctggccggctgcctgaagggcctgagcagcctgctgtgcaacttcaccaagtccatggaggaggacccccagaccagccgggagatcttcaactttgtgctgaaggccatccggccccagattgacctgaagagatatgctgtgcccagcgctggcctgcggctgtttgccctgcacgccagccagttcagcacctgcctgctggacaactacgtgtccctgtttgaggtgctgctgaagtggtgtgcccacaccaacgtggagctgaagaaggccgccctgagcgccctggagagcttcctgaagcaggtgagcaacatggtggccaagaatgctgagatgcacaagaacaagctgcagtacttcatggagcagttctacggcatcatcagaaatgtggacagcaacaacaaggagctgagcatcgccatccggggctacggcctgtttgctggcccctgcaaggtgatcaatgccaaggatgtggacttcatgtatgtggagctgatccagcgctgcaagcagatgttcctgacccagacagacacaggagatgacagagtgtaccagatgcccagcttcctgcagagcgtggcctctgtgctgctgtacctggacacagtgcctgaggtgtacacccctgtgctggagcacctggtggtgatgcagattgacagcttcccccagtacagccccaagatgcagctggtgtgctgccgggccatcgtgaaggtgttcctggccctggccgccaagggccctgtgctgaggaactgcatcagcacagtggtgcaccagggcctcatccgcatctgcagcaagcctgtggtgctgcccaagggccctgagagcgagagcgaggaccaccgggccagcggggaggtgaggacaggcaagtggaaggtgcccacctacaaggactatgtggacctcttccgccacctgctgagcagtgaccagatgatggacagcatcctggctgatgaggccttcttctctgtgaacagcagcagcgagagcctgaaccacctgctgtatgatgaatttgtgaagtctgtgctgaagatcgtggagaagctggacctgaccctggagatccagacagtgggggagcaggagaatggagatgaggcccctggggtgtggatgatccccaccagtgaccctgctgccaacctgcacccagccaagcccaaggacttcagcgccttcatcaacctggtggagttctgccgggagatcctgcctgagaagcaggccgagttctttgagccctgggtgtacagcttctcctatgagctgatcctgcagagcacccggctgcccctcatcagcggcttctacaagctgctgagcatcaccgtgagaaatgccaagaagatcaagtactttgaaggagtgagccccaagagcctgaagcacagccctgaggaccctgagaagtacagctgctttgccctgtttgtgaagtttgggaaggaggtggccgtgaagatgaagcagtacaaggatgagctgctggccagctgcctgaccttcctgctgagcctgccccacaacatcatcgagctggatgtgcgggcctacgtgcctgccctgcagatggccttcaagctgggcctgagctacacccccctggccgaggtgggcctgaatgccctggaggagtggagcatctacatcgacagacatgtgatgcagccctactacaaggacatcctgccctgcctggatggctacctgaagaccagcgccctgagtgatgagaccaagaacaactgggaggtgtctgccctgagcagagctgcccagaagggcttcaacaaggtggtgctgaagcacctgaagaagaccaagaacctgagcagcaatgaggccatcagcctggaggagatccgcatccgggtggtgcagatgctgggcagcctgggcggccagatcaacaagaacctgctgactgtgaccagcagtgatgagatgatgaagagctatgtggcctgggaccgggagaagaggctgagctttgctgtgcccttccgggagatgaagcctgtgatcttcctggatgtgttcctgccccgggtgacagagctggccctgacagccagtgaccggcagaccaaggtggccgcctgtgagctgctgcacagcatggtgatgttcatgctgggcaaggccacccagatgcctgagggcggccagggcgccccacccatgtaccagctgtacaagaggaccttccctgtgctgctgcggctggcctgtgatgtggaccaggtgacccggcagctgtatgagcccctggtgatgcagctgatccactggttcaccaacaacaagaagtttgagagccaggacacagtggccctgctggaggccatcctggatggcatcgtggaccctgtggacagcaccctgcgggacttctgtggccgctgcatccgggagttcctgaagtggagcatcaagcagatcaccccccagcagcaggagaagagccctgtgaacaccaagagcctcttcaagaggctgtacagcctggccctgcaccccaatgccttcaagaggctgggcgccagcctggccttcaacaacatctaccgggagttccgggaggaggagagcctggtggagcagtttgtgtttgaggccctggtgatctacatggagagcctggccctggcccacgcagatgagaagagcctgggcaccatccagcagtgctgtgatgccatcgaccacctgtgccgcatcatcgagaagaagcacgtgtccctgaacaaggccaagaagaggcggctgccccggggcttcccccccagcgccagcctgtgcctgctggacctggtgaagtggctgctggcccactgcggccggccccagacagagtgccgccacaagagcattgagctgttctacaagtttgtgcccctgctgcccggcaacagaagccccaacctgtggctgaaggatgtgctgaaggaggagggcgtgtccttcctgatcaacacctttgagggcggcggctgcggccagcccagcggcatcctggcccagcccaccctgctgtaccggggccccttcagcctgcaggccaccctgtgctggctggacctgctgctggccgccctggagtgctacaacaccttcatcggggagaggacagtgggcgccctgcaggtgctgggcacagaggcccagagcagcctgctgaaggctgtggccttcttcctggagagcatcgccatgcatgacatcatcgctgctgagaagtgcttcggcaccggggctgctggcaacagaaccagcccccaggagggggagcgctacaactacagcaaatgtactgtggtggtgcgcatcatggagttcaccaccaccctgctgaacaccagccctgagggctggaagctgctgaagaaggacctgtgcaacacccacctgatgagggtgctggtgcagaccctgtgtgagcccgccagcatcggcttcaacattggagatgtgcaggtgatggcccacctgcctgatgtgtgtgtgaacctgatgaaggccctgaagatgagcccctacaaggacatcctggagacccacctgcgggagaagatcacagcccagagcattgaggagctgtgtgctgtgaacctgtatggcccagatgcccaggtggacaggagccggctggccgctgtggtgtctgcctgcaagcagctgcaccgggccggcctgctgcacaacatcctgcccagccagagcacagacctgcaccacagcgtgggcacagagctgctgagcctggtgtacaagggcatcgcccctggagatgagcggcagtgcctgcccagcctggacctgagctgcaagcagctggccagcggcctgctggagctggcctttgccttcggcggcctgtgtgagcggctggtgtccctgctgctgaacccagctgtgctgagcacagccagcctgggcagcagccagggcagcgtcatccacttcagccacggggagtacttctacagcctcttcagcgagaccatcaacacagagctgctgaagaacctggacctggccgtgctggagctgatgcagagctctgtggacaacaccaagatggtgtctgctgtgctgaatggcatgctggaccagagcttccgggagcgggccaaccagaagcaccagggcctgaagctggccaccaccatcctgcagcactggaagaagtgtgacagctggtgggccaaggacagccccctggagaccaagatggctgtgctggccctgctggccaagatcctgcagattgacagctctgtgtccttcaacaccagccacggcagcttccctgaggtgttcaccacctacatcagcctgctggccgacaccaagctggacctgcacctgaagggccaggccgtgaccctgctgcccttcttcaccagcctgaccggcggcagcctggaggagctgcggcgggtgctggagcagctgattgtggcccacttccccatgcagagccgggagttccccccaggcaccccccgcttcaacaactacgtggactgcatgaagaagttcctggatgccctggagctgagccagagccccatgctgctggagctgatgacagaggtgctgtgccgggagcagcagcacgtgatggaggagctgttccagagcagcttccgccgcatcgcccggcggggcagctgtgtgacccaggtgggcctgctggagagcgtgtatgagatgttcaggaaggatgacccccggctgtccttcacccggcagagctttgtggacaggagcctgctgaccctgctgtggcactgcagcctggatgccctgcgggagttcttcagcaccatcgtggtggatgccattgatgtgctgaagagccgcttcaccaagctgaatgaaagcacctttgacacccagatcaccaagaagatgggctactacaagatcctggatgtgatgtacagccggctgcccaaggatgatgtgcacgccaaggagagcaagatcaaccaggtgttccacggcagctgcatcacagagggcaatgagctgaccaagaccctcatcaagctgtgctatgatgccttcacagagaacatggccggggagaaccagctgctggagcggcggcggctgtaccactgtgccgcctacaactgtgccatcagcgtcatctgctgcgtgttcaatgagctgaagttctaccagggcttcctgttcagcgagaagccagagaagaacctgctgatctttgagaacctgattgacctgaagaggcgctacaacttccctgtggaggtggaggtgcccatggagaggaagaagaagtacatcgagatcaggaaggaggcccgggaggccgccaatggagacagtgatggccccagctacatgagcagcctgagctacctggccgacagcaccctgtctgaggagatgagccagtttgacttcagcactggagtgcagagctacagctacagcagccaggaccccaggcctgccaccggccgcttcagaagaagagagcagagggaccccaccgtgcatgatgatgtgctggagctggagatggatgagctgaacagacatgagtgcatggcccccctgacagccctggtgaagcacatgcacaggagcctgggccccccccagggcgaggaggacagcgtgccccgggacctgcccagctggatgaagttcctgcacggcaagctgggcaaccccatcgtgcccctgaacatccgcctcttcctggccaagctggtgatcaacacagaggaggtgttccggccctatgccaagcactggctgagccccctgctgcagctggccgccagcgagaacaacggcggggagggcatccactacatggtggtggagatcgtggccaccatcctgtcctggacaggcctggccacccccaccggggtgcccaaggatgaggtgctggccaaccggctgctgaacttcctgatgaagcacgtgttccaccccaagagagctgtgttccgccacaacctggagatcatcaagaccctggtggagtgctggaaggactgcctgagcatcccctaccgcctcatctttgagaagttcagcggcaaggaccccaacagcaaggacaacagcgtgggcatccagctgctgggcatcgtgatggccaatgacctgcccccctatgacccccagtgtggcatccagagcagcgagtacttccaggccctggtgaacaacatgagctttgtgcgctacaaggaggtgtatgctgctgctgctgaggtgctgggcctcatcctgcgctacgtgatggagaggaagaacatcctggaggagagcctgtgtgagctggtggccaagcagctgaagcagcaccagaacaccatggaggacaagttcatcgtgtgcctgaacaaggtgaccaagagcttcccccccctggccgaccgcttcatgaatgctgtgttcttcctgctgcccaagttccatggagtgctgaagaccctgtgcctggaggtggtgctgtgccgggtggagggcatgacagagctgtacttccagctgaagagcaaggactttgtgcaggtgatgaggcacagagatgatgagcggcagaaggtgtgcctggacatcatctacaagatgatgcccaagctgaagcctgtggagctgcgggagctgctgaaccctgtggtggagtttgtgagccaccccagcaccacctgccgggagcagatgtacaacatcctgatgtggattcatgacaactacagagatcctgagagcgagacagacaatgacagccaggagatcttcaagctggccaaggatgtgctgatccagggcctgattgatgagaaccctggcctgcagctgatcatccggaacttctggagccatgagacccggctgcccagcaacaccctggaccggctgctggccctgaacagcctgtacagccccaagattgaggtgcacttcctgagcctggccaccaacttcctgctggagatgacctccatgagcccagactaccccaaccccatgtttgagcaccccctgtctgaatgtgagttccaggagtacaccatcgacagcgactggaggttccgcagcacagtgctgacccccatgtttgtggagacccaggccagccagggcaccctgcagaccaggacccaggagggcagcctgagcgcccgctggcctgtggccggccagatccgggccacccagcagcagcacgacttcaccctgacccagacagcagatggccgcagcagctttgactggctgaccggcagcagcacagaccccctggtggaccacaccagccccagcagtgacagcctgctgtttgcccacaagaggtctgagcggctgcagagggcccccctgaagtctgtgggccctgactttgggaagaagaggctgggcctgcctggagatgaggtggacaacaaggtgaagggagctgctggccgcacagacctgctgcggctgcggcggcgcttcatgagggaccaggagaagctgagcctgatgtatgccaggaaaggagtggccgagcagaagcgggagaaggagatcaagtctgagctgaagatgaagcaggatgcccaggtggtgctgtaccgcagctaccgccacggggacctgcctgacatccagatcaagcacagcagcctcatcacccccctgcaggccgtggcccagagggaccccatcatcgccaagcagctgttcagcagcctcttcagcggcatcctgaaggagatggacaagttcaagaccctgtctgagaagaacaacatcacccagaagctgctgcaggacttcaaccgcttcctgaacaccaccttctccttcttccccccatttgtgtcctgcatccaggacatcagctgccagcacgccgccctgctgagcctggaccctgctgctgtgtctgctggctgcctggccagcctgcagcagcctgtgggcatccggctgctggaggaggccctgctgcggctgctgcctgctgagctgcctgccaagagggtgcggggcaaggcccggctgcccccagatgtgctgcgctgggtggagctggccaagctgtaccgcagcatcggggagtatgatgtgctgcggggcatcttcaccagcgagatcggcaccaagcagatcacccagagcgccctgctggccgaggcccggagtgactacagcgaggccgccaagcagtatgatgaggccctgaacaagcaggactgggtggatggagagcccacagaggccgagaaggacttctgggagctggccagcctggactgctacaaccacctggccgagtggaagagcctggagtactgcagcacagccagcattgacagtgaaaatcctccagacctgaacaagatctggagcgagcccttctaccaggagacctacctgccctacatgatccgcagcaagctgaagctgctgctgcagggcgaggccgaccagagcctgctgaccttcatcgacaaggccatgcatggagagctgcagaaggccatcctggagctgcactacagccaggagctgagcctgctgtacctgctgcaggatgatgtggaccgggccaagtactacatccagaatggcatccagagcttcatgcagaactacagcagcattgatgtgctgctgcaccagagccggctgaccaagctgcagagcgtgcaggccctgacagagatccaggagttcatctccttcatcagcaagcagggcaacctgagcagccaggtgcccctgaagaggctgctgaacacctggaccaaccgctacccagatgccaagatggaccccatgaacatctgggatgacatcatcaccaaccgctgcttcttcctgagcaagattgaggagaagctgacccccctgcctgaggacaacagcatgaatgtggaccaggatggagaccccagcgacaggatggaggtgcaggagcaggaggaggacatcagcagcctcatccgcagctgcaagttctccatgaagatgaagatgattgacagcgccaggaagcagaacaacttcagcctggccatgaagctgctgaaggagctgcacaaggagagcaagaccagagatgactggctggtgtcctgggtgcagagctactgccgcctgagccactgccgcagccgcagccagggctgcagcgagcaggtgctgactgtgctgaagacagtgtccctgctggatgagaacaacgtgtcctcctacctgagcaagaacatcctggccttccgggaccagaacatcctgctgggcaccacctaccgcatcatcgccaatgccctgagcagcgagcccgcctgcctggccgagattgaggaggacaaggcccggcgcatcctggagctgagcggcagcagcagtgaagattctgagaaggtgattgctggcctgtaccagagggccttccagcacctgtctgaggccgtgcaggccgctgaggaggaggcccagcccccatcctggagctgtggccctgctgctggggtgattgatgcctacatgaccctggccgacttctgtgaccagcagctgaggaaggaggaggagaatgcctctgtgattgattctgctgagctgcaggcctacccagccctggtggtggagaagatgctgaaggccctgaagctgaacagcaatgaggcccggctgaagttcccccggctgctgcagatcatcgagcgctacccagaggagaccctgagcctgatgaccaaggagatcagctctgtgccctgctggcagttcatctcctggatcagccacatggtggccctgctggacaaggaccaggccgtggccgtgcagcacagcgtggaggagatcacagacaactacccccaggccatcgtgtaccccttcatcatcagcagcgagagctacagcttcaaggacaccagcacaggccacaagaacaaggagtttgtggcccgcatcaagagcaagctggaccagggcggcgtcatccaggacttcatcaatgccctggaccagctgagcaaccctgagctgctcttcaaggactggagcaatgatgtgcgggcagagctggccaagacccctgtgaacaagaagaacatcgagaagatgtatgaaagaatgtatgctgccctgggggaccccaaggcccctggcctgggcgccttccggaggaagttcatccagaccttcggcaaggagtttgacaagcactttggaaaaggaggcagcaagctgctgaggatgaagctgagtgacttcaatgacatcaccaacatgctgctgctgaagatgaacaaggacagcaagcccccaggcaacctgaaggaatgtagcccctggatgtctgacttcaaggtggagttcctgagaaatgagctggagatccctggccagtatgatggccggggcaagcccctgcctgagtaccacgtgagaattgctggctttgatgagcgggtgacagtgatggccagcctgcggcggcccaagaggatcatcatccggggccatgatgagcgggagcaccccttcctggtgaagggaggagaggacctgcggcaggaccagagggtggagcagctgttccaggtgatgaatggcatcctggcccaggacagcgcctgcagccagagggccctgcagctgcggacctacagcgtggtgcccatgaccagcagtgacccccgggccccaccctgtgagtacaaggactggctgaccaagatgtctgggaagcatgatgtgggcgcctacatgctgatgtacaagggggccaacagaacagaaacagtgaccagcttcaggaagcgggagagcaaggtgcctgctgacctgctgaagagggcctttgtgaggatgagcaccagccctgaggccttcctggccctgcggagccactttgccagcagccacgccctgatctgcatcagccactggatcctgggcatcggggacagacacctgaacaacttcatggtggccatggagaccggcggcgtcatcggcatcgactttggccacgccttcggcagcgccacccagttcctgcctgtgcctgagctgatgcccttccggctgacccggcagttcatcaacctgatgctgcccatgaaggagaccggcctgatgtacagcatcatggtgcacgccctgcgggccttcagaagtgaccccggcctgctgaccaacaccatggatgtgtttgtgaaggagcccagctttgactggaagaactttgagcagaagatgctgaagaagggcggctcctggatccaggagatcaacgtggccgagaagaactggtacccccggcagaagatctgctacgccaagaggaagctggccggggccaacccagctgtgatcacctgtgatgagctgctgctgggccacgagaaggccccagccttccgggactatgtggccgtggcccggggcagcaaggaccacaacatccgggcccaggagcctgagagcggcctgtctgaggagacccaggtgaagtgcctgatggaccaggccacagaccccaacatcctgggccgcacctgggagggctgggagccctggatgtag

SEQ ID NO: 21346 - DNA, 444 bp, Artificial Sequence
  Description of Artificial Sequence: Synthetic coding sequence
atggccgcccagaggctgggcaagagggtgctgagcaagctgcagagccccagccgggcccggggccctgggggcagccctgggggcctgcagaagagacatgcccgggtgacagtgaagtatgacagaagagagctgcagaggcggctggatgtggagaagtggattgatggccgcctggaggagctgtaccggggcatggaggccgacatgccagatgagatcaacattgatgagctgctggagctggagagcgaggaggagaggagcaggaagatccagggcctgctgaagagctgtgggaagcctgtggaggacttcatccaggagctgctggccaagctgcagggcctgcaccggcagcccggcctgcggcagcccagccccagccatgatggcagcctgagccccctgcaggaccgggccaggacagcccacccctag

SEQ ID NO: 21347 - DNA, 363 bp, Artificial Sequence
  Description of Artificial Sequence: Synthetic coding sequence
atggccgcccagaggctgggcaagagggtgctgagcaagctgcagagccccagccgggcccggggccctgggggcagccctgggggcctgcagaagagacatgcccgggtgacagtgaagtatgacagaagagagctgcagaggcggctggatgtggagaagtggattgatggccgcctggaggagctgtaccggggcatgggcctgctgaagagctgtgggaagcctgtggaggacttcatccaggagctgctggccaagctgcagggcctgcaccggcagcccggcctgcggcagcccagccccagccatgatggcagcctgagccccctgcaggaccgggccaggacagcccacccctag

SEQ ID NO: 21348 - DNA, 2025 bp, Artificial Sequence
  Description of Artificial Sequence: Synthetic coding sequence
atggcccctggccaggccccccaccaggccaccccctggagagatgcccaccccttcttcctgctgagccctgtgatgggcctgctgagccgggcctggagccggctgcggggcctgggccccctggagccctggctggtggaggccgtgaagggagctgccctggtggaggccggcctggagggggaggcccggacccccctggccatcccccacaccccctggggcagaagacctgaggaggaggccgaggacagcggcggccctggagaagatcgggagaccctgggcctgaagaccagcagcagcctgcctgaggcctggggcctgctggatgatgatgatggcatgtacggggagcgggaggccacctctgtgccccggggccagggcagccagtttgctgatggccagagggcccccctgagccccagcctgctgatccgcaccctgcagggcagtgacaagaaccctggagaggagaaggccgaggaggagggcgtggccgaggaggagggcgtgaacaagttctcctacccacccagccaccgggagtgctgcccagctgtggaggaggaggatgatgaggaggccgtgaagaaggaggcccacaggaccagcaccagcgccctgagccctggcagcaagcccagcacctgggtgtcctgccctggagaggaggagaaccaggccacagaggacaagaggacagagaggagcaaaggagccaggaagacctctgtgagccccaggagcagcggcagtgaccccaggtcctgggagtaccgcagcggggaggccagcgaggagaaggaggagaaggcccacaaggagactggaaaaggagaggccgcccctggcccccagagcagcgccccagcccagaggccccagctgaagtcctggtggtgccagcccagtgatgaggaggagggggaggtgaaggccctgggcgctgctgagaaggatggagaggctgaatgtcctccctgcatccccccacccagcgccttcctgaaggcctgggtgtactggccaggagaggacacagaggaggaggaggatgaggaggaggatgaggacagcgacagcggcagtgatgaggaggagggggaggccgaggccagcagcagcaccccagccaccggggtcttcctgaagtcctgggtgtaccagcctggagaggacacagaggaggaggaggatgaagattctgacaccggcagcgcagaagatgagcgggaggccgagaccagcgccagcaccccaccagccagcgccttcctgaaggcctgggtgtacagacctggagaggacacagaggaggaggaggatgaagatgtggacagcgaggacaaggaggatgattctgaggccgccctgggggaggccgagagtgacccccaccccagccacccagaccagagggcccacttccggggctggggctacagacctgggaaggagacagaggaggaggaggccgctgaggactggggcgaggccgagccctgccccttccgggtggccatctacgtgcctggagagaagcccccaccaccctgggccccaccccggctgcccctgcggctgcagaggcggctgaagaggcctgagacccccacccatgaccctgaccctgagacccccctgaaggccaggaaggtgcgcttcagcgagaaggtgacagtgcacttcctggccgtgtgggccggccctgcccaggccgcccggcagggcccctgggagcagctggcccgggacaggagcagatttgcccggcgcatcacccaggcccaggaggagctgagcccctgcctgaccccagctgcccgggcccgggcctgggcccggctgaggaacccccccctggcccccatcccagccctgacccagaccctgcccagcagctctgtgcccagcagccctgtgcagaccacccccctgagccaggccgtggccacccccagccgcagcagcgctgctgctgctgctgccctggacctgagcggccggcggggctag

SEQ ID NO: 21349 - DNA, 1545 bp, Artificial Sequence
  Description of Artificial Sequence: Synthetic coding sequence
atgaaggccgaggaggagggcgtggccgaggaggagggcgtgaacaagttctcctacccacccagccaccgggagtgctgcccagctgtggaggaggaggatgatgaggaggccgtgaagaaggaggcccacaggaccagcaccagcgccctgagccctggcagcaagcccagcacctgggtgtcctgccctggagaggaggagaaccaggccacagaggacaagaggacagagaggagcaaaggagccaggaagacctctgtgagccccaggagcagcggcagtgaccccaggtcctgggagtaccgcagcggggaggccagcgaggagaaggaggagaaggcccacaaggagactggaaaaggagaggccgcccctggcccccagagcagcgccccagcccagaggccccagctgaagtcctggtggtgccagcccagtgatgaggaggagggggaggtgaaggccctgggcgctgctgagaaggatggagaggctgaatgtcctccctgcatccccccacccagcgccttcctgaaggcctgggtgtactggccaggagaggacacagaggaggaggaggatgaggaggaggatgaggacagcgacagcggcagtgatgaggaggagggggaggccgaggccagcagcagcaccccagccaccggggtcttcctgaagtcctgggtgtaccagcctggagaggacacagaggaggaggaggatgaagattctgacaccggcagcgcagaagatgagcgggaggccgagaccagcgccagcaccccaccagccagcgccttcctgaaggcctgggtgtacagacctggagaggacacagaggaggaggaggatgaagatgtggacagcgaggacaaggaggatgattctgaggccgccctgggggaggccgagagtgacccccaccccagccacccagaccagagggcccacttccggggctggggctacagacctgggaaggagacagaggaggaggaggccgctgaggactggggcgaggccgagccctgccccttccgggtggccatctacgtgcctggagagaagcccccaccaccctgggccccaccccggctgcccctgcggctgcagaggcggctgaagaggcctgagacccccacccatgaccctgaccctgagacccccctgaaggccaggaaggtgcgcttcagcgagaaggtgacagtgcacttcctggccgtgtgggccggccctgcccaggccgcccggcagggcccctgggagcagctggcccgggacaggagcagatttgcccggcgcatcacccaggcccaggaggagctgagcccctgcctgaccccagctgcccgggcccgggcctgggcccggctgaggaacccccccctggcccccatcccagccctgacccagaccctgcccagcagctctgtgcccagcagccctgtgcagaccacccccctgagccaggccgtggccacccccagccgcagcagcgctgctgctgctgctgccctggacctgagcggccggcggggctag

SEQ ID NO: 21350 - DNA, 1899 bp, Artificial Sequence
  Description of Artificial Sequence: Synthetic coding sequence
atgccctggctggtggaggccgtgaagggagctgccctggtggaggccggcctggagggggaggcccggacccccctggccatcccccacaccccctggggcagaagacctgaggaggaggccgaggacagcggcggccctggagaagatcgggagaccctgggcctgaagaccagcagcagcctgcctgaggcctggggcctgctggatgatgatgatggcatgtacggggagcgggaggccacctctgtgccccggggccagggcagccagtttgctgatggccagagggcccccctgagccccagcctgctgatccgcaccctgcagggcagtgacaagaaccctggagaggagaaggccgaggaggagggcgtggccgaggaggagggcgtgaacaagttctcctacccacccagccaccgggagtgctgcccagctgtggaggaggaggatgatgaggaggccgtgaagaaggaggcccacaggaccagcaccagcgccctgagccctggcagcaagcccagcacctgggtgtcctgccctggagaggaggagaaccaggccacagaggacaagaggacagagaggagcaaaggagccaggaagacctctgtgagccccaggagcagcggcagtgaccccaggtcctgggagtaccgcagcggggaggccagcgaggagaaggaggagaaggcccacaaggagactggaaaaggagaggccgcccctggcccccagagcagcgccccagcccagaggccccagctgaagtcctggtggtgccagcccagtgatgaggaggagggggaggtgaaggccctgggcgctgctgagaaggatggagaggctgaatgtcctccctgcatccccccacccagcgccttcctgaaggcctgggtgtactggccaggagaggacacagaggaggaggaggatgaggaggaggatgaggacagcgacagcggcagtgatgaggaggagggggaggccgaggccagcagcagcaccccagccaccggggtcttcctgaagtcctgggtgtaccagcctggagaggacacagaggaggaggaggatgaagattctgacaccggcagcgcagaagatgagcgggaggccgagaccagcgccagcaccccaccagccagcgccttcctgaaggcctgggtgtacagacctggagaggacacagaggaggaggaggatgaagatgtggacagcgaggacaaggaggatgattctgaggccgccctgggggaggccgagagtgacccccaccccagccacccagaccagagggcccacttccggggctggggctacagacctgggaaggagacagaggaggaggaggccgctgaggactggggcgaggccgagccctgccccttccgggtggccatctacgtgcctggagagaagcccccaccaccctgggccccaccccggctgcccctgcggctgcagaggcggctgaagaggcctgagacccccacccatgaccctgaccctgagacccccctgaaggccaggaaggtgcgcttcagcgagaaggtgacagtgcacttcctggccgtgtgggccggccctgcccaggccgcccggcagggcccctgggagcagctggcccgggacaggagcagatttgcccggcgcatcacccaggcccaggaggagctgagcccctgcctgaccccagctgcccgggcccgggcctgggcccggctgaggaacccccccctggcccccatcccagccctgacccagaccctgcccagcagctctgtgcccagcagccctgtgcagaccacccccctgagccaggccgtggccacccccagccgcagcagcgctgctgctgctgctgccctggacctgagcggccggcggggctag

SEQ ID NO: 21351 - DNA, 1671 bp, Artificial Sequence
  Description of Artificial Sequence: Synthetic coding sequence
atggccggggccagcgagctgggcactggacctggagctgctggaggagatggagatgacagcctgtaccccatcgctgtgctgattgatgagctgagaaatgaagatgtgcagctgcggctgaacagcatcaagaagctgagcaccatcgccctggccctgggcgtggagaggaccaggtctgagctgctgcccttcctgacagacaccatctatgatgaagatgaggtgctgctggccctggccgagcagctgggcaacttcaccggcctggtgggcggccctgactttgcccactgcctgctgccccccctggagaacctggccaccgtggaggagaccgtggtgcgggacaaggctgtggagagcctgcggcagatcagccaggagcacacccctgtggccctggaggcctactttgtgcccctggtgaagaggctggccagcggggactggttcaccagcaggaccagcgcctgtggcctcttctctgtgtgctacccccgggccagcaatgctgtgaaggccgagatccggcagcagttccgcagcctgtgcagtgatgacacccccatggtgcggcgggctgctgccagcaagctgggggagtttgccaaggtgctggagctggacagcgtgaagtcagaaattgtgcccctcttcaccagcctggccagtgatgagcaggacagcgtgcggctgctggccgtggaggcctgtgtgtccatcgcccagctgctgagccaggatgacctggagaccctggtgatgcccaccctgcggcaggccgctgaggacaagtcctggagggtgcgctacatggtggccgaccgcttcagcgagctgcagaaggccatgggccccaagatcaccctgaatgacctgatcccagccttccagaacctgctgaaggactgtgaggccgaggtgcgggctgctgctgcccacaaggtgaaggagctgggggagaacctgcccatcgaggaccgggagaccatcatcatgaaccagatcctgccctacatcaagtgcccagatgtgcggctgaacatcatcagcaacctggactgtgtgaatgaagtcatcggcatccggcagctgagccagagcctgctgcctgccatcgtggagctggccgaggatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccaacaacctgatgaagctggtgcagaagtttggaacagagtgggcccagaacaccatcgtgcccaaggtgctggtgatggccaatgaccccaactacctgcacaggatgaccaccctcttctgcatcaatgccctgtctgaggcctgtggccaggagatcaccaccaagcagatgctgcccatcgtgctgaagatggccggggaccaggtggccaacgtgcgcttcaacgtggccaagagcctgcagaagattggccccatcctggacaccaatgccctgcagggcgaggtgaagcctgtgctgcagaagctgggccaggatgaggacatggatgtgaagtactttgcccaggaggccatctctgtgctggccctggcctag

SEQ ID NO: 21352 - DNA, 1770 bp, Artificial Sequence
  Description of Artificial Sequence: Synthetic coding sequence
atggctgctgctgatggagatgacagcctgtaccccatcgctgtgctgattgatgagctgagaaatgaagatgtgcagctgcggctgaacagcatcaagaagctgagcaccatcgccctggccctgggcgtggagaggaccaggtctgagctgctgcccttcctgacagacaccatctatgatgaagatgaggtgctgctggccctggccgagcagctgggcaccttcaccaccctggtgggcggcccagaatatgtgcactgcctgctgccccccctggagagcctggccaccgtggaggagaccgtggtgcgggacaaggctgtggagagcctgcgggccatcagccatgagcacagccccagcgacctggaggcccactttgtgcccctggtgaagaggctggccggcggggactggttcaccagcaggaccagcgcctgtggcctcttctctgtgtgctacccccgggtgagcagcgctgtgaaggccgagctgcggcagtacttcaggaacctgtgcagtgatgacacccccatggtgcggcgggctgctgccagcaagctgggggagtttgccaaggtgctggagctggacaacgtgaagtctgagatcatccccatgttcagcaacctggccagtgatgagcaggacagcgtgcggctgctggccgtggaggcctgtgtgaacatcgcccagctgctgccccaggaggacctggaggccctggtgatgcccaccctgcggcaggccgctgaggacaagtcctggagggtgcgctacatggtggccgacaagttcacagagctgcagaaggctgtgggccctgagatcaccaagacagacctggtgcctgccttccagaacctgatgaaggactgtgaggccgaggtgcgggctgctgccagccacaaggtgaaggagttctgtgagaacctgtctgctgactgcagagaaaatgtcatcatgagccagatcctgccctgcatcaaggagctggtgtctgatgccaaccagcacgtgaagagcgccctggccagcgtcatcatgggcctgagccccatcctgggcaaggacaacaccatcgagcacctgctgcccctcttcctggcccagctgaaggatgagtgcccagaggtgcggctgaacatcatcagcaacctggactgtgtgaatgaggtgattggcatccggcagctgagccagagcctgctgcctgccatcgtggagctggctgaagatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccagcaacctgaagaagctggtggagaagtttgggaaggagtgggcccacgccaccatcatccccaaggtgctggccatgtctggggaccccaactacctgcacaggatgaccaccctcttctgcatcaacgtgctgtctgaggtgtgtggccaggacatcaccaccaagcacatgctgcccaccgtgctgaggatggccggggaccctgtggccaacgtgcgcttcaacgtggccaagagcctgcagaagattggccccatcctggacaacagcaccctgcagagcgaggtgaagcccatcctggagaagctgacccaggaccaggatgtggatgtgaagtactttgcccaggaggccctgactgtgctgagcctggcctag

SEQ ID NO: 21353 - DNA, 1740 bp, Artificial Sequence
  Description of Artificial Sequence: Synthetic coding sequence
atggctgctgctgatggagatgacagcctgtaccccatcgctgtgctgattgatgagctgagaaatgaagatgtgcagctgcggctgaacagcatcaagaagctgagcaccatcgccctggccctgggcgtggagaggaccaggtctgagctgctgcccttcctgacagacaccatctatgatgaagatgaggtgctgctggccctggccgagcagctgggcaccttcaccaccctggtgggcggcccagaatatgtgcactgcctgctgccccccctggagagcctggccaccgtggagagcctgcgggccatcagccatgagcacagccccagcgacctggaggcccactttgtgcccctggtgaagaggctggccggcggggactggttcaccagcaggaccagcgcctgtggcctcttctctgtgtgctacccccgggtgagcagcgctgtgaaggccgagctgcggcagtacttcaggaacctgtgcagtgatgacacccccatggtgcggcgggctgctgccagcaagctgggggagtttgccaaggtgctggagctggacaacgtgaagtctgagatcatccccatgttcagcaacctggccagtgatgagcaggacagcgtgcggctgctggccgtggaggcctgtgtgaacatcgcccagctgctgccccaggaggacctggaggccctggtgatgcccaccctgcggcaggccgctgaggacaagtcctggagggtgcgctacatggtggccgacaagttcacagagctgcagaaggctgtgggccctgagatcaccaagacagacctggtgcctgccttccagaacctgatgaaggactgtgaggccgaggtgcgggctgctgccagccacaaggtgaaggagttctgtgagaacctgtctgctgactgcagagaaaatgtcatcatgagccagatcctgccctgcatcaaggagctggtgtctgatgccaaccagcacgtgaagagcgccctggccagcgtcatcatgggcctgagccccatcctgggcaaggacaacaccatcgagcacctgctgcccctcttcctggcccagctgaaggatgagtgcccagaggtgcggctgaacatcatcagcaacctggactgtgtgaatgaggtgattggcatccggcagctgagccagagcctgctgcctgccatcgtggagctggctgaagatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccagcaacctgaagaagctggtggagaagtttgggaaggagtgggcccacgccaccatcatccccaaggtgctggccatgtctggggaccccaactacctgcacaggatgaccaccctcttctgcatcaacgtgctgtctgaggtgtgtggccaggacatcaccaccaagcacatgctgcccaccgtgctgaggatggccggggaccctgtggccaacgtgcgcttcaacgtggccaagagcctgcagaagattggccccatcctggacaacagcaccctgcagagcgaggtgaagcccatcctggagaagctgacccaggaccaggatgtggatgtgaagtactttgcccaggaggccctgactgtgctgagcctggcctag

SEQ ID NO: 21354 - DNA, 471 bp, Artificial Sequence
  Description of Artificial Sequence: Synthetic coding sequence
atggctgctgctgatggagatgacagcctgtaccccatcgctgtgctgattgatgagctgagaaatgaagatgtgcagctgcggctgaacagcaacctgaagaagctggtggagaagtttgggaaggagtgggcccacgccaccatcatccccaaggtgctggccatgtctggggaccccaactacctgcacaggatgaccaccctcttctgcatcaacgtgctgtctgaggtgtgtggccaggacatcaccaccaagcacatgctgcccaccgtgctgaggatggccggggaccctgtggccaacgtgcgcttcaacgtggccaagagcctgcagaagattggccccatcctggacaacagcaccctgcagagcgaggtgaagcccatcctggagaagctgacccaggaccaggatgtggatgtgaagtactttgcccaggaggccctgactgtgctgagcctggcctag

SEQ ID NO: 21355 - DNA, 1605 bp, Artificial Sequence
  Description of Artificial Sequence: Synthetic coding sequence
atgaggaccttctcctttgccagcacagccagccgcagctgcccccccagcccctggcccctgggcctgaagggccctgaggtgtccttctgcctgagcctgcagccccccctggagagcctggccaccgtggaggagaccgtggtgcgggacaaggctgtggagagcctgcgggccatcagccatgagcacagccccagcgacctggaggcccactttgtgcccctggtgaagaggctggccggcggggactggttcaccagcaggaccagcgcctgtggcctcttctctgtgtgctacccccgggtgtcctctgctgtgaaggccgagctgcggcagtacttcaggaacctgtgcagtgatgacacccccatggtgagaagagctgctgccagcaagctgggggagtttgccaaggtgctggagctggacaacgtgaagtctgagatcatccccatgttcagcaacctggccagtgatgagcaggacagcgtgcggctgctggccgtggaggcctgtgtgaacatcgcccagctgctgccccaggaggacctggaggccctggtgatgcccaccctgcggcaggccgctgaggacaagtcctggagggtgcgctacatggtggccgacaagttcacagagctgcagaaggctgtgggccctgagatcaccaagacagacctggtgcctgccttccagaacctgatgaaggactgtgaggccgaggtgcgggccgccgccagccacaaggtgaaggagttctgtgagaacctgtctgctgactgccgggagaatgtcatcatgagccagatcctgccctgcatcaaggagctggtgtctgatgccaaccagcacgtgaagagcgccctggccagcgtcatcatgggcctgagccccatcctgggcaaggacaacaccatcgagcacctgctgcccctcttcctggcccagctgaaggatgaatgtcctgaggtgcggctgaacatcatcagcaacctggactgtgtgaatgaagtcatcggcatccggcagctgagccagagcctgctgcctgccatcgtggagctggccgaggatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccagcaacctgaagaagctggtggagaagtttgggaaggagtgggcccacgccaccatcatccccaaggtgctggccatgtctggggaccccaactacctgcacaggatgaccaccctcttctgcatcaacgtgctgtctgaggtgtgtggccaggacatcaccaccaagcacatgctgcccaccgtgctgaggatggccggggaccctgtggccaacgtgcgcttcaacgtggccaagagcctgcagaagattggccccatcctggacaacagcaccctgcagagcgaggtgaagcccatcctggagaagctgacccaggaccaggatgtggatgtgaagtactttgcccaggaggccctgactgtgctgagcctggcctag

SEQ ID NO: 21356 - DNA, 2004 bp, Artificial Sequence
  Description of Artificial Sequence: Synthetic coding sequence
atggccggggccagcgagctgggcactggacctggagctgctggaggagatggagatgacagcctgtaccccatcgctgtgctgattgatgagctgagaaatgaagatgtgcagctgcggctgaacagcatcaagaagctgagcaccatcgccctggccctgggcgtggagaggaccaggtctgagctgctgcccttcctgacagacaccatctatgatgaagatgaggtgctgctggccctggccgagcagctgggcaacttcaccggcctggtgggcggccctgactttgcccactgcctgctgccccccctggagaacctggccaccgtggaggagaccgtggtgcgggacaaggctgtggagagcctgcggcagatcagccaggagcacacccctgtggccctggaggcctactttgtgcccctggtgaagaggctggccagcggggactggttcaccagcaggaccagcgcctgtggcctcttctctgtgtgctacccccgggccagcaatgctgtgaaggccgagatccggcagcagttccgcagcctgtgcagtgatgacacccccatggtgcggcgggctgctgccagcaagctgggggagtttgccaaggtgctggagctggacagcgtgaagtcagaaattgtgcccctcttcaccagcctggccagtgatgagcaggacagcgtgcggctgctggccgtggaggcctgtgtgtccatcgcccagctgctgagccaggatgacctggagaccctggtgatgcccaccctgcggcaggccgctgaggacaagtcctggagggtgcgctacatggtggccgaccgcttcagcgagctgcagaaggccatgggccccaagatcaccctgaatgacctgatcccagccttccagaacctgctgaaggactgtgaggccgaggtgcgggctgctgctgcccacaaggtgaaggagctgggggagaacctgcccatcgaggaccgggagaccatcatcatgaaccagatcctgccctacatcaaggagctggtgtctgacaccaaccagcacgtgaagagcgccctggccagcgtcatcatgggcctgagcaccatcctgggcaaggagaacaccatcgagcacctgctgcccctcttcctggcccagctgaaggatgagtgcccagatgtgcggctgaacatcatcagcaacctggactgtgtgaatgaggtgattggcatccggcagctgagccagagcctgctgcctgccatcgtggagctggctgaagatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccaacaacctgatgaagctggtgcagaagtttggaacagagtgggcccagaacaccatcgtgcccaaggtgctggtgatggccaatgaccccaactacctgcacaggatgaccaccctcttctgcatcaatgccctgtctgaggcctgtggccaggagatcaccaccaagcagatgctgcccatcgtgctgaagatggccggggaccaggtggccaacgtgcgcttcaacgtggccaagagcctgcagaagattggccccatcctggacaccaatgccctgcagggcgaggtgaagcctgtgctgcagaagctgggccaggatgaggacatggatgtgaagtactttgcccaggaggccatctctgtggtggcccagaggctgaggaagctggagttccctgtgaaggacagcggggagcccagcgtgcccagggctgacaagaaccacttcccccggcccaccgtgcctggagaggacatgggcaaaggacctgtgtaccagctgcggggggacacccgggacaccctggcccagctgggcattgctgagctggtgcacttcagccagagcacagactag

SEQ ID NO: 21357 - DNA, 1425 bp, Artificial Sequence
  Description of Artificial Sequence: Synthetic coding sequence
atggccggggccagcgagctgggcactggacctggagctgctggaggagatggagatgacagcctgtaccccatcgctgtgctgattgatgagctgagaaatgaagatgtgcagctgcggctgaacagcatcaagaagctgagcaccatcgccctggccctgggcgtggagaggaccaggtctgagctgctgcccttcctgacagacaccatctatgatgaagatgaggtgctgctggccctggccgagcagctgggcaacttcaccggcctggtgggcggccctgactttgcccactgcctgctggacagcgtgcggctgctggccgtggaggcctgtgtgtccatcgcccagctgctgagccaggatgacctggagaccctggtgatgcccaccctgcggcaggccgctgaggacaagtcctggagggtgcgctacatggtggccgaccgcttcagcgagctgcagaaggccatgggccccaagatcaccctgaatgacctgatcccagccttccagaacctgctgaaggactgtgaggccgaggtgcgggctgctgctgcccacaaggtgaaggagctgggggagaacctgcccattgaagatcgggagaccatcatcatgaaccagatcctgccctacatcaaggagctggtgtctgacaccaaccagcacgtgaagagcgccctggccagcgtcatcatgggcctgagcaccatcctgggcaaggagaacaccatcgagcacctgctgcccctcttcctggcccagctgaaggatgaatgtccagatgtgcggctgaacatcatcagcaacctggactgtgtgaatgaagtcatcggcatccggcagctgagccagagcctgctgcctgccatcgtggagctggccgaggatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccaacaacctgatgaagctggtgcagaagtttggaacagagtgggcccagaacaccatcgtgcccaaggtgctggtgatggccaatgaccccaactacctgcacaggatgaccaccctcttctgcatcaatgccctgtctgaggcctgtggccaggagatcaccaccaagcagatgctgcccatcgtgctgaagatggccggggaccaggtggccaacgtgcgcttcaacgtggccaagagcctgcagaagattggccccatcctggacaccaatgccctgcagggcgaggtgaagcctgtgctgcagaagctgggccaggatgaggacatggatgtgaagtactttgcccaggaggccatctctgtgctggccctggcctag

SEQ ID NO: 21358 - DNA, 1365 bp, Artificial Sequence
  Description of Artificial Sequence: Synthetic coding sequence
atggccggggccagcgagctgggcactggacctggagctgctggaggagatggagatgacagcctgtaccccatcgctgtgctgattgatgagctgagaaatgaagatgtgcagctgcggctgaacagcatcaagaagctgagcaccatcgccctggccctgggcgtggagaggaccaggtctgagctgctgcccttcctgacagacaccatctatgatgaagatgaggtgctgctggccctggccgagcagctgggcaacttcaccggcctggtgggcggccctgactttgcccactgcctgctggacagcgtgcggctgctggccgtggaggcctgtgtgtccatcgcccagctgctgagccaggatgacctggagaccctggtgatgcccaccctgcggcaggccgctgaggacaagtcctggagggtgcgctacatggtggccgaccgcttcagcgagctgcagaaggccatgggccccaagatcaccctgaatgacctgatcccagccttccagaacctgctgaaggactgtgaggccgaggtgcgggctgctgctgcccacaaggtgaaggagctgggggagaacctgcccattgaagatcgggagaccatcatcatgaaccagatcctgccctacatcaaggagctggtgtctgacaccaaccagcacgtgaagagcgccctggccagcgtcatcatgggcctgagcaccatcctgggcaaggagaacaccatcgagcacctgctgcccctcttcctggcccagctgaaggatgaatgtccagatgtgcggctgaacatcatcagcaacctggactgtgtgaatgaagtcatcggcatccggcagctgagccagagcctgctgcctgccatcgtggagctggccgaggatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccaacaacctgatgaagctggtgcagaagtttggaacagagtgggcccagaacaccatcgtgcccaaggtgctggtgatggccaatgaccccaactacctgcacaggatgaccaccctcttctgcatcaatgccctgtctgaggcctgtggccaggagatcaccaccaagcagatgctgcccatcgtgaagaatggccggcggcccagcagcaagtgcagcctgcagtgtggccagatcagcaccaaggactggaccaacagccgctaccagtgcttcaccggccgctctgaggccagcaccacagaggtgcgcagcaggtag

SEQ ID NO: 21359 - DNA, 1812 bp, Artificial Sequence
  Description of Artificial Sequence: Synthetic coding sequence
atggccggggccagcgagctgggcactggacctggagctgctggaggagatggagatgacagcctgtaccccatcgctgtgctgattgatgagctgagaaatgaagatgtgcagccccccctggagaacctggccaccgtggaggagaccgtggtgcgggacaaggctgtggagagcctgcggcagatcagccaggagcacacccctgtggccctggaggcctactttgtgcccctggtgaagaggctggccagcggggactggttcaccagcaggaccagcgcctgtggcctcttctctgtgtgctacccccgggccagcaatgctgtgaaggccgagatccggcagcagttccgcagcctgtgcagtgatgacacccccatggtgcggcgggctgctgccagcaagctgggggagtttgccaaggtgctggagctggacagcgtgaagtcagaaattgtgcccctcttcaccagcctggccagtgatgagcaggacagcgtgcggctgctggccgtggaggcctgtgtgtccatcgcccagctgctgagccaggatgacctggagaccctggtgatgcccaccctgcggcaggccgctgaggacaagtcctggagggtgcgctacatggtggccgaccgcttcagcgagctgcagaaggccatgggccccaagatcaccctgaatgacctgatcccagccttccagaacctgctgaaggactgtgaggccgaggtgcgggctgctgctgcccacaaggtgaaggagctgggggagaacctgcccatcgaggaccgggagaccatcatcatgaaccagatcctgccctacatcaaggagctggtgtctgacaccaaccagcacgtgaagagcgccctggccagcgtcatcatgggcctgagcaccatcctgggcaaggagaacaccatcgagcacctgctgcccctcttcctggcccagctgaaggatgagtgcccagatgtgcggctgaacatcatcagcaacctggactgtgtgaatgaggtgattggcatccggcagctgagccagagcctgctgcctgccatcgtggagctggctgaagatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccaacaacctgatgaagctggtgcagaagtttggaacagagtgggcccagaacaccatcgtgcccaaggtgctggtgatggccaatgaccccaactacctgcacaggatgaccaccctcttctgcatcaatgccctgtctgaggcctgtggccaggagatcaccaccaagcagatgctgcccatcgtgctgaagatggccggggaccaggtggccaacgtgcgcttcaacgtggccaagagcctgcagaagattggccccatcctggacaccaatgccctgcagggcgaggtgaagcctgtgctgcagaagctgggccaggatgaggacatggatgtgaagtactttgcccaggaggccatctctgtggtggcccagaggctgaggaagctggagttccctgtgaaggacagcggggagcccagcgtgcccagggctgacaagaaccacttcccccggcccaccgtgcctggagaggacatgggcaaaggacctgtgtaccagctgcggggggacacccgggacaccctggcccagctgggcattgctgagctggtgcacttcagccagagcacagactag

SEQ ID NO: 21360 - DNA, 1323 bp, Artificial Sequence
  Description of Artificial Sequence: Synthetic coding sequence
atgatgcagctgaccttctggctgcgggtgcccccacccttcagccacttcaagaggcagttccgcagcctgtgcagtgatgacacccccatggtgagaagagctgctgccagcaagctgggggagtttgccaaggtgctggagctggacagcgtgaagtctgagatcgtgcccctcttcaccagcctggccagtgatgagcaggacagcgtgcggctgctggccgtggaggcctgtgtgtccatcgcccagctgctgagccaggatgacctggagaccctggtgatgcccaccctgcggcaggccgctgaggacaagtcctggagggtgcgctacatggtggccgaccgcttcagcgagctgcagaaggccatgggccccaagatcaccctgaatgacctgatcccagccttccagaacctgctgaaggactgtgaggccgaggtgcgggctgctgctgcccacaaggtgaaggagctgggggagaacctgcccattgaagatcgggagaccatcatcatgaaccagatcctgccctacatcaaggagctggtgtctgacaccaaccagcacgtgaagagcgccctggccagcgtcatcatgggcctgagcaccatcctgggcaaggagaacaccatcgagcacctgctgcccctcttcctggcccagctgaaggatgaatgtccagatgtgcggctgaacatcatcagcaacctggactgtgtgaatgaagtcatcggcatccggcagctgagccagagcctgctgcctgccatcgtggagctggccgaggatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccaacaacctgatgaagctggtgcagaagtttggaacagagtgggcccagaacaccatcgtgcccaaggtgctggtgatggccaatgaccccaactacctgcacaggatgaccaccctcttctgcatcaatgccctgtctgaggcctgtggccaggagatcaccaccaagcagatgctgcccatcgtgctgaagatggccggggaccaggtggccaacgtgcgcttcaacgtggccaagagcctgcagaagattggccccatcctggacaccaatgccctgcagggcgaggtgaagcctgtgctgcagaagctgggccaggatgaggacatggatgtgaagtactttgcccaggaggccatctctgtgctggccctggcctag

SEQ ID NO: 21361 - DNA, 1806 bp, Artificial Sequence
  Description of Artificial Sequence: Synthetic coding sequence
atggccggggccagcgagctgggcactggacctggagctgctggaggagatggagatgacagcctgtaccccatcgctgtgctgattgatgagctgagaaatgaagatgtgcagctgcggctgaacagcatcaagaagctgagcaccatcgccctggccctgggcgtggagaggaccaggtctgagctgctgcccttcctgacagacaccatctatgatgaagatgaggtgctgctggccctggccgagcagctgggcaacttcaccggcctggtgggcggccctgactttgcccactgcctgctgccccccctggagaacctggccaccgtggaggagaccgtggtgcgggacaaggctgtggagagcctgcggcagatcagccaggagcacacccctgtggccctggaggcctactttgtgcccctggtgaagaggctggccagcggggactggttcaccagcaggaccagcgcctgtggcctcttctctgtgtgctacccccgggccagcaatgctgtgaaggccgagatccggcagcagttccgcagcctgtgcagtgatgacacccccatggtgcggcgggctgctgccagcaagctgggggagtttgccaaggtgctggagctggacagcgtgaagtcagaaattgtgcccctcttcaccagcctggccagtgatgagcaggacagcgtgcggctgctggccgtggaggcctgtgtgtccatcgcccagctgctgagccaggatgacctggagaccctggtgatgcccaccctgcggcaggccgctgaggacaagtcctggagggtgcgctacatggtggccgaccgcttcagcgagctgcagaaggccatgggccccaagatcaccctgaatgacctgatcccagccttccagaacctgctgaaggactgtgaggccgaggtgcgggctgctgctgcccacaaggtgaaggagctgggggagaacctgcccatcgaggaccgggagaccatcatcatgaaccagatcctgccctacatcaaggagctggtgtctgacaccaaccagcacgtgaagagcgccctggccagcgtcatcatgggcctgagcaccatcctgggcaaggagaacaccatcgagcacctgctgcccctcttcctggcccagctgaaggatgagtgcccagatgtgcggctgaacatcatcagcaacctggactgtgtgaatgaggtgattggcatccggcagctgagccagagcctgctgcctgccatcgtggagctggctgaagatgccaagtggagggtgcggctggccatcatcgagtacatgcccctgctggccggccagctgggcgtggagttctttgatgagaagctgaacagcctgtgcatggcctggctggtggaccacgtgtatgccatccgggaggccgccaccaacaacctgatgaagctggtgcagaagtttggaacagagtgggcccagaacaccatcgtgcccaaggtgctggtgatggccaatgaccccaactacctgcacaggatgaccaccctcttctgcatcaatgccctgtctgaggcctgtggccaggagatcaccaccaagcagatgctgcccatcgtgctgaagatggccggggaccaggtggccaacgtgcgcttcaacgtggccaagagcctgcagaagattggccccatcctggacaccaatgccctgcagggcgaggtgaagcctgtgctgcagaagctgggccaggatgaggacatggatgtgaagtactttgcccaggaggccatctctgtgctggccctggcctag

SEQ ID NO: 21362 - DNA, 1566 bp, Artificial Sequence
  Description of Artificial Sequence: Synthetic coding sequence
atgagcggccgccgcttccacctgagcaccacagacagagtcatcaaggctgtgcccttcccccccacccagaggctgaccttcaaggaggtgtttgaaaatggcaagcccaaggtggatgtgctgaagaaccacctggtgaaggagggccgcctggaggaggaggtggccctgaagatcatcaatgatggagctgccatcctgcggcaggagaagaccatgattgaggtggatgcccccatcaccgtgtgtggggacatccacggccagttctttgacctgatgaagctgtttgaggtgggcggcagccccagcaacacccgctacctgttcctgggggactatgtggaccggggctacttcagcattgaatgtgtgctgtacctgtggagcctgaagatcaaccaccccaagaccctcttcctgctgcggggcaaccacgagtgccgccacctgacagactacttcaccttcaagcaggagtgccgcatcaagtacagcgagcaggtgtatgatgcctgcatggagacctttgactgcctgcccctggccgccctgctgaaccagcagttcctgtgtgtgcatggaggcatgagccctgagatcaccagcctggatgacatcaggaagctggaccgcttcacagagcccccagccttcggccctgtgtgtgacctgctgtggagcgaccccagtgaagattatggaaatgagaagaccctggagcactacacccacaacacagtgcggggctgcagctacttctacagctacccagctgtgtgtgagttcctgcagaacaacaacctgctgagcatcatccgggcccacgaggcccaggatgctggctacaggatgtacaggaagagccaggccaccggcttccccagcctcatcaccatcttcagcgcccccaactacctggatgtgtacaacaacaaggctgctgtgctgaagtatgaaaataatgtgatgaacatccggcagttcaactgcagcccccacccctactggctgcccaacttcatggatgtgttcacctggagcctgccctttgtgggggagaaggtgacagagatgctggtgaatgtgctgaacatctgcagtgatgatgagctgatcagtgatgatgaagctgaggaccactacatccccagctaccagaagggcagcaccaccgtgaggaaggagatcatccggaacaagatccgggccatcggcaagatggcccgggtcttcagcatcctgcggcaggagagcgagagcgtgctgaccctgaagggcctgacccccaccggcaccctgcccctgggcgtgctgagcggcggcaagcagaccattgaaacagccaccgtggaggccgtggaggcccgggaggccatccggggcttcagcctgcagcacaagatccgcagctttgaggaggcccggggcctggaccgcatcaatgaaagaatgccacccaggaaggacagcatccatgctgggggccccatgaagtctgtgaccagcgcccacagccatgctgcccacagaagtgaccagggcaagaaggcccacagctag

SEQ ID NO: 21363 - DNA, 1410 bp, Artificial Sequence
  Description of Artificial Sequence: Synthetic coding sequence
atgtctgagcccaaggccatcgaccccaagctgagcaccacagacagagtggtgaaggctgtgcccttcccccccagccaccggctgacagccaaggaggtgtttgacaatgatggcaagccccgggtggacatcctgaaggcccacctgatgaaggagggccgcctggaggagagcgtggccctgcgcatcatcacagagggcgccagcatcctgcggcaggagaagaacctgctggacattgatgcccctgtgacagtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggccctgaagatcctgtaccccaagaccctcttcctgctgcggggcaaccacgagtgccgccacctgacagagtacttcaccttcaagcaggagtgcaagatcaagtacagcgagcgggtgtatgatgcctgcatggatgcctttgactgcctgcccctggccgccctgatgaaccagcagttcctgtgtgtgcatggaggcctgagccctgagatcaacaccctggatgacatcaggaagctggaccgcttcaaggagcccccagcctacggccccatgtgtgacatcctgtggagcgaccccctggaggactttggaaatgagaagacccaggagcacttcacccacaacacagtgcggggctgcagctacttctacagctacccagctgtgtgtgagttcctgcagcacaacaacctgctgagcatcctgcgggcccacgaggcccaggatgctggctacaggatgtacaggaagagccagaccaccggcttccccagcctcatcaccatcttcagcgcccccaactacctggatgtgtacaacaacaaggtgacagagatgctggtgaatgtgctgaacatctgcagtgatgatgagctgggctctgaagaagatggctttgatggagccacagctgctgccaggaaggaggtgatccggaacaagatccgggccatcggcaagatggcccgggtcttctctgtgctgcgggaggagagcgagagcgtgctgaccctgaagggcctgacccccaccggcatgctgcccagcggcgtgctgagcggcggcaagcagaccctgcagagcgccatcaagggcttcagcccccagcacaagatcaccagctttgaggaggccaagggcctggaccgcatcaatgaaagaatgccacccaggagagatgccatgcccagtgatgccaacctgaacagcatcaacaaggccctgaccagcgagaccaacggcacagacagcaatggcagcaacagcagcaacatccagtag

SEQ ID NO: 21364 - DNA, 1536 bp, Artificial Sequence
  Description of Artificial Sequence: Synthetic coding sequence
atgtctgagcccaaggccatcgaccccaagctgagcaccacagacagagtggtgaaggctgtgcccttcccccccagccaccggctgacagccaaggaggtgtttgacaatgatggcaagccccgggtggacatcctgaaggcccacctgatgaaggagggccgcctggaggagagcgtggccctgcgcatcatcacagagggcgccagcatcctgcggcaggagaagaacctgctggacattgatgcccctgtgacagtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggccctgaagatcctgtaccccaagaccctcttcctgctgcggggcaaccacgagtgccgccacctgacagagtacttcaccttcaagcaggagtgcaagatcaagtacagcgagcgggtgtatgatgcctgcatggatgcctttgactgcctgcccctggccgccctgatgaaccagcagttcctgtgtgtgcatggaggcctgagccctgagatcaacaccctggatgacatcaggaagctggaccgcttcaaggagcccccagcctacggccccatgtgtgacatcctgtggagcgaccccctggaggactttggaaatgagaagacccaggagcacttcacccacaacacagtgcggggctgcagctacttctacagctacccagctgtgtgtgagttcctgcagcacaacaacctgctgagcatcctgcgggcccacgaggcccaggatgctggctacaggatgtacaggaagagccagaccaccggcttccccagcctcatcaccatcttcagcgcccccaactacctggatgtgtacaacaacaaggctgctgtgctgaagtatgaaaataatgtgatgaacatccggcagttcaactgcagcccccacccctactggctgcccaacttcatggatgtgttcacctggagcctgccctttgtgggggagaaggtgacagagatgctggtgaatgtgctgaacatctgcagtgatgatgagctgggctctgaagaagatggctttgatggagccacagctgctgccaggaaggaggtgatccggaacaagatccgggccatcggcaagatggcccgggtcttctctgtgctgcgggaggagagcgagagcgtgctgaccctgaagggcctgacccccaccggcatgctgcccagcggcgtgctgagcggcggcaagcagaccctgcagagcgccatcaagggcttcagcccccagcacaagatcaccagctttgaggaggccaagggcctggaccgcatcaatgaaagaatgccacccaggagagatgccatgcccagtgatgccaacctgaacagcatcaacaaggccctgaccagcgagaccaacggcacagacagcaatggcagcaacagcagcaacatccagtag

SEQ ID NO: 21365 - DNA, 1566 bp, Artificial Sequence
  Description of Artificial Sequence: Synthetic coding sequence
atgtctgagcccaaggccatcgaccccaagctgagcaccacagacagagtggtgaaggctgtgcccttcccccccagccaccggctgacagccaaggaggtgtttgacaatgatggcaagccccgggtggacatcctgaaggcccacctgatgaaggagggccgcctggaggagagcgtggccctgcgcatcatcacagagggcgccagcatcctgcggcaggagaagaacctgctggacattgatgcccctgtgacagtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggccctgaagatcctgtaccccaagaccctcttcctgctgcggggcaaccacgagtgccgccacctgacagagtacttcaccttcaagcaggagtgcaagatcaagtacagcgagcgggtgtatgatgcctgcatggatgcctttgactgcctgcccctggccgccctgatgaaccagcagttcctgtgtgtgcatggaggcctgagccctgagatcaacaccctggatgacatcaggaagctggaccgcttcaaggagcccccagcctacggccccatgtgtgacatcctgtggagcgaccccctggaggactttggaaatgagaagacccaggagcacttcacccacaacacagtgcggggctgcagctacttctacagctacccagctgtgtgtgagttcctgcagcacaacaacctgctgagcatcctgcgggcccacgaggcccaggatgctggctacaggatgtacaggaagagccagaccaccggcttccccagcctcatcaccatcttcagcgcccccaactacctggatgtgtacaacaacaaggctgctgtgctgaagtatgaaaataatgtgatgaacatccggcagttcaactgcagcccccacccctactggctgcccaacttcatggatgtgttcacctggagcctgccctttgtgggggagaaggtgacagagatgctggtgaatgtgctgaacatctgcagtgatgatgagctgggctctgaagaagatggctttgatggagccacagctgctgccaggaaggaggtgatccggaacaagatccgggccatcggcaagatggcccgggtcttctctgtgctgcgggaggagagcgagagcgtgctgaccctgaagggcctgacccccaccggcatgctgcccagcggcgtgctgagcggcggcaagcagaccctgcagagcgccaccgtggaggccatcgaggctgatgaggccatcaagggcttcagcccccagcacaagatcaccagctttgaggaggccaagggcctggaccgcatcaatgaaagaatgccacccaggagagatgccatgcccagtgatgccaacctgaacagcatcaacaaggccctgaccagcgagaccaacggcacagacagcaatggcagcaacagcagcaacatccagtag

SEQ ID NO: 21366 - DNA, 1272 bp, Artificial Sequence
  Description of Artificial Sequence: Synthetic coding sequence
atgaagctgtttgaggtgggcggcagccctgccaacacccgctacctgttcctgggggactatgtggaccggggctacttcagcattgaatgtgtgctgtacctgtgggccctgaagatcctgtaccccaagaccctcttcctgctgcggggcaaccacgagtgccgccacctgacagagtacttcaccttcaagcaggagtgcaagatcaagtacagcgagcgggtgtatgatgcctgcatggatgcctttgactgcctgcccctggccgccctgatgaaccagcagttcctgtgtgtgcatggaggcctgagccctgagatcaacaccctggatgacatcaggaagctggaccgcttcaaggagcccccagcctacggccccatgtgtgacatcctgtggagcgaccccctggaggactttggaaatgagaagacccaggagcacttcacccacaacacagtgcggggctgcagctacttctacagctacccagctgtgtgtgagttcctgcagcacaacaacctgctgagcatcctgcgggcccacgaggcccaggatgctggctacaggatgtacaggaagagccagaccaccggcttccccagcctcatcaccatcttcagcgcccccaactacctggatgtgtacaacaacaaggctgctgtgctgaagtatgaaaataatgtgatgaacatccggcagttcaactgcagcccccacccctactggctgcccaacttcatggatgtgttcacctggagcctgccctttgtgggggagaaggtgacagagatgctggtgaatgtgctgaacatctgcagtgatgatgagctgggctctgaagaagatggctttgatggagccacagctgctgccaggaaggaggtgatccggaacaagatccgggccatcggcaagatggcccgggtcttctctgtgctgcgggaggagagcgagagcgtgctgaccctgaagggcctgacccccaccggcatgctgcccagcggcgtgctgagcggcggcaagcagaccctgcagagcgccaccgtggaggccatcgaggctgatgaggccatcaagggcttcagcccccagcacaagatcaccagctttgaggaggccaagggcctggaccgcatcaatgaaagaatgccacccaggagagatgccatgcccagtgatgccaacctgaacagcatcaacaaggccctgaccagcgagaccaacggcacagacagcaatggcagcaacagcagcaacatccagtag

SEQ ID NO: 21367 - DNA, 870 bp, Artificial Sequence
  Description of Artificial Sequence: Synthetic coding sequence
atgtctgagcccaaggccatcgaccccaagctgagcaccacagacagagtggtgaaggctgtgcccttcccccccagccaccggctgacagccaaggaggtgtttgacaatgatggcaagccccgggtggacatcctgaaggcccacctgatgaaggagggccgcctggaggagagcgtggccctgcgcatcatcacagagggcgccagcatcctgcggcaggagaagaacctgctggacattgatgcccctgtgacagctgctgtgctgaagtatgaaaataatgtgatgaacatccggcagttcaactgcagcccccacccctactggctgcccaacttcatggatgtgttcacctggagcctgccctttgtgggggagaaggtgacagagatgctggtgaatgtgctgaacatctgcagtgatgatgagctgggctctgaagaagatggctttgatggagccacagctgctgccaggaaggaggtgatccggaacaagatccgggccatcggcaagatggcccgggtcttctctgtgctgcgggaggagagcgagagcgtgctgaccctgaagggcctgacccccaccggcatgctgcccagcggcgtgctgagcggcggcaagcagaccctgcagagcgccaccgtggaggccatcgaggctgatgaggccatcaagggcttcagcccccagcacaagatcaccagctttgaggaggccaagggcctggaccgcatcaatgaaagaatgccacccaggagagatgccatgcccagtgatgccaacctgaacagcatcaacaaggccctgaccagcgagaccaacggcacagacagcaatggcagcaacagcagcaacatccagtag

SEQ ID NO: 21368 - DNA, 1365 bp, Artificial Sequence
  Description of Artificial Sequence: Synthetic coding sequence
atgtctgagcccaaggccatcgaccccaagctgagcaccacagacagagtggtgaaggtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggccctgaagatcctgtaccccaagaccctcttcctgctgcggggcaaccatgaatgtcgccacctgacagagtacttcaccttcaagcaggagtgcaagatcaagtacagcgagcgggtgtatgatgcctgcatggatgcctttgactgcctgcccctggccgccctgatgaaccagcagttcctgtgtgtgcacggcggcctgagccctgagatcaacaccctggatgacatcaggaagctggaccgcttcaaggagcccccagcctacggccccatgtgtgacatcctgtggagcgaccccctggaggactttggaaatgagaagacccaggagcacttcacccacaacacagtgcggggctgcagctacttctacagctacccagctgtgtgtgagttcctgcagcacaacaacctgctgagcatcctgcgggcccacgaggcccaggatgctggctacaggatgtacaggaagagccagaccaccggcttccccagcctcatcaccatcttcagcgcccccaactacctggatgtgtacaacaacaaggctgctgtgctgaagtatgagaacaacgtgatgaacatccggcagttcaactgcagcccccacccctactggctgcccaacttcatggatgtgttcacctggagcctgccctttgtgggggagaaggtgacagagatgctggtgaatgtgctgaacatctgcagtgatgatgagctgggcagcgaggaggatggctttgatggagccacagctgctgccaggaaggaggtgatccggaacaagatccgggccatcggcaagatggcccgggtcttctctgtgctgcgggaggagagcgagagcgtgctgaccctgaagggcctgacccccaccggcatgctgcccagcggcgtgctgagcggcggcaagcagaccctgcagagcgccaccgtggaggccattgaagcagatgaggccatcaagggcttcagcccccagcacaagatcaccagctttgaggaggccaagggcctggaccgcatcaatgaaagaatgcccccaagaagagatgccatgcccagtgatgccaacctgaacagcatcaacaaggccctgaccagcgagaccaatggaacagacagcaatggcagcaacagcagcaacatccagtag

SEQ ID NO: 21369 - DNA, 399 bp, Artificial Sequence
  Description of Artificial Sequence: Synthetic coding sequence
atgaaggagggccgcctggaggagagcgtggccctgcgcatcatcacagagggcgccagcatcctgcggcaggagaagaacctgctggacattgatgcccctgtgacagtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggccctgaagatcctgtaccccaagaccctcttcctgctgcggggcaaccacgagtgccgccacctgacagagtacttcaccttcaagcaggagtgcaagatcaagtacagcgagcgggtgtatgatgcctgcatggatgccttctag

SEQ ID NO: 21370 - DNA, 444 bp, Artificial Sequence
  Description of Artificial Sequence: Synthetic coding sequence
atgaaggagggccgcctggaggagagcgtggccctgcgcatcatcacagagggcgccagcatcctgcggcaggagaagaacctgctggacattgatgcccctgtgacagtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggccctgaagatcctgtaccccaagaccctcttcctgctgcggggcaaccacgagtgccgccacctgacagagtacttcaccttcaagcaggagtgcaagatcaagtacagcgagcgggtgtatgatgcctgcatggatgcctttgactgcctgcccctggccgccctgatgaaccagcagttcctgtgctag

SEQ ID NO: 21371 - DNA, 1491 bp, Artificial Sequence
  Description of Artificial Sequence: Synthetic coding sequence
atggccgcccctgagcccgcccgggccgcccctcctcctcctcctcctcctcctcctcctcctggagctgacagagtggtgaaggctgtgcccttcccccccacccaccggctgaccagcgaggaggtgtttgacctggatggcatcccccgggtggatgtgctgaagaaccacctggtgaaggagggccgggtggatgaggagatcgccctgcgcatcatcaatgaaggagctgccatcctgcggcgggagaagaccatgattgaggtggaggcccccatcaccgtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggtgctgaagatcctgtaccccagcaccctcttcctgctgcggggcaaccatgaatgtcgccacctgacagagtacttcaccttcaagcaggagtgcaagatcaagtacagcgagcgggtgtatgaggcctgcatggaggcctttgacagcctgcccctggccgccctgctgaaccagcagttcctgtgtgtgcacggcggcctgagccctgagatccacaccctggatgacatccggcggctggaccgcttcaaggagcccccagccttcggccccatgtgtgacctgctgtggagcgaccccagcgaggactttggaaatgagaagagccaggagcacttcagccacaacacagtgcggggctgcagctacttctacaactacccagctgtgtgtgagttcctgcagaacaacaacctgctgagcatcatccgggcccacgaggcccaggatgctggctacaggatgtacaggaagagccagaccaccggcttccccagcctcatcaccatcttcagcgcccccaactacctggatgtgtacaacaacaaggctgctgtgctgaagtatgagaacaacgtgatgaacatccggcagttcaactgcagcccccacccctactggctgcccaacttcatggatgtgttcacctggagcctgccctttgtgggggagaaggtgacagagatgctggtgaatgtgctgagcatctgcagtgatgatgagctgatgacagaaggagaggaccagtttgatggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcggaaatgatgtgatgcagctggccgtgccccagatggactggggcaccccccacagctttgccaacaacagccacaatgcctgccgggagttcctgctcttcttcagcagctgcctgagcagctag

SEQ ID NO: 21372 - DNA, 1575 bp, Artificial Sequence
  Description of Artificial Sequence: Synthetic coding sequence
atggccgcccctgagcccgcccgggccgcccctcctcctcctcctcctcctcctcctcctcctggagctgacagagtggtgaaggctgtgcccttcccccccacccaccggctgaccagcgaggaggtgtttgacctggatggcatcccccgggtggatgtgctgaagaaccacctggtgaaggagggccgggtggatgaggagatcgccctgcgcatcatcaatgaaggagctgccatcctgcggcgggagaagaccatgattgaggtggaggcccccatcaccgtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggtgctgaagatcctgtaccccagcaccctcttcctgctgcggggcaaccatgaatgtcgccacctgacagagtacttcaccttcaagcaggagtgcaagatcaagtacagcgagcgggtgtatgaggcctgcatggaggcctttgacagcctgcccctggccgccctgctgaaccagcagttcctgtgtgtgcacggcggcctgagccctgagatccacaccctggatgacatccggcggctggaccgcttcaaggagcccccagccttcggccccatgtgtgacctgctgtggagcgaccccagcgaggactttggaaatgagaagagccaggagcacttcagccacaacacagtgcggggctgcagctacttctacaactacccagctgtgtgtgagttcctgcagaacaacaacctgctgagcatcatccgggcccacgaggcccaggatgctggctacaggatgtacaggaagagccagaccaccggcttccccagcctcatcaccatcttcagcgcccccaactacctggatgtgtacaacaacaaggctgctgtgctgaagtatgagaacaacgtgatgaacatccggcagttcaactgcagcccccacccctactggctgcccaacttcatggatgtgttcacctggagcctgccctttgtgggggagaaggtgacagagatgctggtgaatgtgctgagcatctgcagtgatgatgagctgatgacagaaggagaggaccagtttgatggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcgccaccgtggaggccattgaagctgagaaggccatccggggcttcagccccccccaccgcatctgcagctttgaggaggccaagggcctggaccgcatcaatgaaagaatgccacccaggaaggatgctgtgcagcaggacggcttcaacagcctgaacacagcccacgccacagagaaccacggcaccggcaaccacacagcccagtag

SEQ ID NO: 21373 - DNA, 1545 bp, Artificial Sequence
  Description of Artificial Sequence: Synthetic coding sequence
atggccgcccctgagcccgcccgggccgcccctcctcctcctcctcctcctcctcctcctcctggagctgacagagtggtgaaggctgtgcccttcccccccacccaccggctgaccagcgaggaggtgtttgacctggatggcatcccccgggtggatgtgctgaagaaccacctggtgaaggagggccgggtggatgaggagatcgccctgcgcatcatcaatgaaggagctgccatcctgcggcgggagaagaccatgattgaggtggaggcccccatcaccgtgtgtggggacatccacggccagttctttgacctgatgaagctgtttgaggtgggcggcagccctgccaacacccgctacctgttcctgggggactatgtggaccggggctacttcagcattgagcacgtgctgggcacagaggacatcagcatcaacccccacaacaacatcaatgaatgtgtgctgtacctgtgggtgctgaagatcctgtaccccagcaccctcttcctgctgcggggcaaccatgaatgtcgccacctgacagagtacttcaccttcaagcaggagtgcaagatcaagtacagcgagcgggtgtatgaggcctgcatggaggcctttgacagcctgcccctggccgccctgctgaaccagcagttcctgtgtgtgcacggcggcctgagccctgagatccacaccctggatgacatccggcggctggaccgcttcaaggagcccccagccttcggccccatgtgtgacctgctgtggagcgaccccagcgaggactttggaaatgagaagagccaggagcacttcagccacaacacagtgcggggctgcagctacttctacaactacccagctgtgtgtgagttcctgcagaacaacaacctgctgagcatcatccgggcccacgaggcccaggatgctggctacaggatgtacaggaagagccagaccaccggcttccccagcctcatcaccatcttcagcgcccccaactacctggatgtgtacaacaacaaggctgctgtgctgaagtatgagaacaacgtgatgaacatccggcagttcaactgcagcccccacccctactggctgcccaacttcatggatgtgttcacctggagcctgccctttgtgggggagaaggtgacagagatgctggtgaatgtgctgagcatctgcagtgatgatgagctgatgacagaaggagaggaccagtttgatggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcggaaatgatgtgatgcagctggccgtgccccagatggactggggcaccccccacagctttgccaacaacagccacaatgcctgccgggagttcctgctcttcttcagcagctgcctgagcagctag

SEQ ID NO: 21374 - DNA, 591 bp, Artificial Sequence
  Description of Artificial Sequence: Synthetic coding sequence
atgaacatccggcagttcaactgcagcccccacccctactggctgcccaacttcatggatgtgttcacctggagcctgccctttgtgggggagaaggtgacagagatgctggtgaatgtgctgagcatctgcagtgatgatgagctgatgacagaaggagaggaccagtttgatgagcggctcatctacggcaacaagaagggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcgccaccgtggaggccattgaagctgagaaggccatccggggcttcagccccccccaccgcatctgcagctttgaggaggccaagggcctggaccgcatcaatgaaagaatgccacccaggaaggatgctgtgcagcaggacggcttcaacagcctgaacacagcccacgccacagagaaccacggcaccggcaaccacacagcccagtag

SEQ ID NO: 21375 - DNA, 1548 bp, Artificial Sequence
  Description of Artificial Sequence: Synthetic coding sequence
atggccgcccctgagcccgcccgggccgcccctcctcctcctcctcctcctcctcctcctcctggagctgacagagtggtgaaggctgtgcccttcccccccacccaccggctgaccagcgaggaggtgtttgacctggatggcatcccccgggtggatgtgctgaagaaccacctggtgaaggagggccgggtggatgaggagatcgccctgcgcatcatcaatgaaggagctgccatcctgcggcgggagaagaccatgattgaggtggaggcccccatcaccgtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggtgctgaagatcctgtaccccagcaccctcttcctgctgcggggcaaccatgaatgtcgccacctgacagagtacttcaccttcaagcaggagtgcaagatcaagtacagcgagcgggtgtatgaggcctgcatggaggcctttgacagcctgcccctggccgccctgctgaaccagcagttcctgtgtgtgcacggcggcctgagccctgagatccacaccctggatgacatccggcggctggaccgcttcaaggagcccccagccttcggccccatgtgtgacctgctgtggagcgaccccagcgaggactttggaaatgagaagagccaggagcacttcagccacaacacagtgcggggctgcagctacttctacaactacccagctgtgtgtgagttcctgcagaacaacaacctgctgagcatcatccgggcccacgaggcccaggatgctggctacaggatgtacaggaagagccagaccaccggcttccccagcctcatcaccatcttcagcgcccccaactacctggatgtgtacaacaacaaggctgctgtgctgaagtatgagaacaacgtgatgaacatccggcagttcaactgcagcccccacccctactggctgcccaacttcatggatgtgttcacctggagcctgccctttgtgggggagaaggtgacagagatgctggtgaatgtgctgagcatctgcagtgatgatgagctgatgacagaaggagaggaccagtttgatgtgggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcgccatccggggcttcagccccccccaccgcatctgcagctttgaggaggccaagggcctggaccgcatcaatgaaagaatgccacccaggaaggatgctgtgcagcaggacggcttcaacagcctgaacacagcccacgccacagaaaatcatggaactggaaaccacacagcccagtag

SEQ ID NO: 21376 - DNA, 1578 bp, Artificial Sequence
  Description of Artificial Sequence: Synthetic coding sequence
atggccgcccctgagcccgcccgggccgcccctcctcctcctcctcctcctcctcctcctcctggagctgacagagtggtgaaggctgtgcccttcccccccacccaccggctgaccagcgaggaggtgtttgacctggatggcatcccccgggtggatgtgctgaagaaccacctggtgaaggagggccgggtggatgaggagatcgccctgcgcatcatcaatgaaggagctgccatcctgcggcgggagaagaccatgattgaggtggaggcccccatcaccgtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggtgctgaagatcctgtaccccagcaccctcttcctgctgcggggcaaccatgaatgtcgccacctgacagagtacttcaccttcaagcaggagtgcaagatcaagtacagcgagcgggtgtatgaggcctgcatggaggcctttgacagcctgcccctggccgccctgctgaaccagcagttcctgtgtgtgcacggcggcctgagccctgagatccacaccctggatgacatccggcggctggaccgcttcaaggagcccccagccttcggccccatgtgtgacctgctgtggagcgaccccagcgaggactttggaaatgagaagagccaggagcacttcagccacaacacagtgcggggctgcagctacttctacaactacccagctgtgtgtgagttcctgcagaacaacaacctgctgagcatcatccgggcccacgaggcccaggatgctggctacaggatgtacaggaagagccagaccaccggcttccccagcctcatcaccatcttcagcgcccccaactacctggatgtgtacaacaacaaggctgctgtgctgaagtatgagaacaacgtgatgaacatccggcagttcaactgcagcccccacccctactggctgcccaacttcatggatgtgttcacctggagcctgccctttgtgggggagaaggtgacagagatgctggtgaatgtgctgagcatctgcagtgatgatgagctgatgacagaaggagaggaccagtttgatgtgggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcgccaccgtggaggccatcgaggccgagaaggccatccggggcttcagccccccccaccgcatctgcagctttgaggaggccaagggcctggaccgcatcaatgaaagaatgccacccaggaaggatgctgtgcagcaggacggcttcaacagcctgaacacagcccacgccacagaaaatcatggaactggaaaccacacagcccagtag

SEQ ID NO: 21377 - DNA, 561 bp, Artificial Sequence
  Description of Artificial Sequence: Synthetic coding sequence
cacccctactggctgcccaacttcatggatgtgttcacctggagcctgccctttgtgggggagaaggtgacagagatgctggtgaatgtgctgagcatctgcagtgatgatgagctgatgacagaaggagaggaccagtttgatgagcggctcatctacggcaacaagaagggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcgccaccgtggaggccattgaagctgagaaggccatccggggcttcagccccccccaccgcatctgcagctttgaggaggccaagggcctggaccgcatcaatgaaagaatgccacccaggaaggatgctgtgcagcaggacggcttcaacagcctgaacacagcccacgccacagagaaccacggcaccggcaaccacacagcccagtag

SEQ ID NO: 21378 - DNA, 459 bp, Artificial Sequence
  Description of Artificial Sequence: Synthetic coding sequence
atgctggtgaatgtgctgagcatctgcagtgatgatgagctgatgacagaaggagaggaccagtttgatggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcgccaccgtggaggccattgaagctgagaaggccatccggggcttcagccccccccaccgcatctgcagctttgaggaggccaagggcctggaccgcatcaatgaaagaatgccacccaggaaggatgctgtgcagcaggacggcttcaacagcctgaacacagcccacgccacagagaaccacggcaccggcaaccacacagcccagtag

SEQ ID NO: 21379 - DNA, 1236 bp, Artificial Sequence
  Description of Artificial Sequence: Synthetic coding sequence
atgattgaggtggaggcccccatcaccgtgtgtggggacatccacggccagttctttgacctgatgaagctgtttgaggtgggcggcagccctgccaacacccgctacctgttcctgggggactatgtggaccggggctacttcagcattgaatgtgtgctgtacctgtgggtgctgaagatcctgtaccccagcaccctcttcctgctgcggggcaaccatgaatgtcgccacctgacagagtacttcaccttcaagcaggagtgcaagatcaagtacagcgagcgggtgtatgaggcctgcatggaggcctttgacagcctgcccctggccgccctgctgaaccagcagttcctgtgtgtgcacggcggcctgagccctgagatccacaccctggatgacatccggcggctggaccgcttcaaggagcccccagccttcggccccatgtgtgacctgctgtggagcgaccccagcgaggactttggaaatgagaagagccaggagcacttcagccacaacacagtgcggggctgcagctacttctacaactacccagctgtgtgtgagttcctgcagaacaacaacctgctgagcatcatccgggcccacgaggcccaggatgctggctacaggatgtacaggaagagccagaccaccggcttccccagcctcatcaccatcttcagcgcccccaactacctggatgtgtacaacaacaaggctgctgtgctgaagtatgagaacaacgtgatgaacatccggcagttcaactgcagcccccacccctactggctgcccaacttcatggatgtgttcacctggagcctgccctttgtgggggagaaggtgacagagatgctggtgaatgtgctgagcatctgcagtgatgatgagctgatgacagaaggagaggaccagtttgatgtgggcagcgctgctgccaggaaggagatcatccggaacaagatccgggccatcggcaagatggcccgggtcttctctgtgctgcgggaggagagcgagagcgtgctgaccctgaagggcctgacccccaccggcatgctgcccagcggcgtgctggccggcggccggcagaccctgcagagcggaaatgatgtgatgcagctggccgtgccccagatggactggggcaccccccacagctttgccaacaacagccacaatgcctgccgggagttcctgctcttcttcagcagctgcctgagcagctag

SEQ ID NO: 21380 - DNA, 1539 bp, Artificial Sequence
  Description of Artificial Sequence: Synthetic coding sequence
atgagcggccgccgcttccacctgagcaccacagacagagtcatcaaggctgtgcccttcccccccacccagaggctgaccttcaaggaggtgtttgaaaatggcaagcccaaggtggatgtgctgaagaaccacctggtgaaggagggccgcctggaggaggaggtggccctgaagatcatcaatgatggagctgccatcctgcggcaggagaagaccatgattgaggtggatgcccccatcaccgtgtgtggggacatccacggccagttctttgacctgatgaagctgtttgaggtgggcggcagccccagcaacacccgctacctgttcctgggggactatgtggaccggggctacttcagcattgaatgtgtgctgtacctgtggagcctgaagatcaaccaccccaagaccctcttcctgctgcggggcaaccacgagtgccgccacctgacagactacttcaccttcaagcaggagtgccgcatcaagtacagcgagcaggtgtatgatgcctgcatggagacctttgactgcctgcccctggccgccctgctgaaccagcagttcctgtgtgtgcatggaggcatgagccctgagatcaccagcctggatgacatcaggaagctggaccgcttcacagagcccccagccttcggccctgtgtgtgacctgctgtggagcgaccccagtgaagattatggaaatgagaagaccctggagcactacacccacaacacagtgcggggctgcagctacttctacagctacccagctgtgtgtgagttcctgcagaacaacaacctgctgagcatcatccgggcccacgaggcccaggatgctggctacaggatgtacaggaagagccaggccaccggcttccccagcctcatcaccatcttcagcgcccccaactacctggatgtgtacaacaacaaggctgctgtgctgaagtatgaaaataatgtgatgaacatccggcagttcaactgcagcccccacccctactggctgcccaacttcatggatgtgttcacctggagcctgccctttgtgggggagaaggtgacagagatgctggtgaatgtgctgaacatctgcagtgatgatgagctgatcagtgatgatgaagctgagggcagcaccaccgtgaggaaggagatcatccggaacaagatccgggccatcggcaagatggcccgggtcttcagcatcctgcggcaggagagcgagagcgtgctgaccctgaagggcctgacccccaccggcaccctgcccctgggcgtgctgagcggcggcaagcagaccatcgagacagccaccgtggaggccgtggaggcccgggaggccatccggggcttcagcctgcagcacaagatccgcagctttgaggaggcccggggcctggaccgcatcaatgaaagaatgccacccaggaaggacagcatccacgccggcggccccatgaagtctgtgaccagcgcccacagccacgccgcccacagaagtgaccagggcaagaaggcccacagctag

SEQ ID NO: 21381 - DNA, 1509 bp, Artificial Sequence
  Description of Artificial Sequence: Synthetic coding sequence
atgagcggccgccgcttccacctgagcaccacagacagagtcatcaaggctgtgcccttcccccccacccagaggctgaccttcaaggaggtgtttgaaaatggcaagcccaaggtggatgtgctgaagaaccacctggtgaaggagggccgcctggaggaggaggtggccctgaagatcatcaatgatggagctgccatcctgcggcaggagaagaccatgattgaggtggatgcccccatcaccgtgtgtggggacatccacggccagttctttgacctgatgaagctgtttgaggtgggcggcagccccagcaacacccgctacctgttcctgggggactatgtggaccggggctacttcagcattgaatgtgtgctgtacctgtggagcctgaagatcaaccaccccaagaccctcttcctgctgcggggcaaccacgagtgccgccacctgacagactacttcaccttcaagcaggagtgccgcatcaagtacagcgagcaggtgtatgatgcctgcatggagacctttgactgcctgcccctggccgccctgctgaaccagcagttcctgtgtgtgcatggaggcatgagccctgagatcaccagcctggatgacatcaggaagctggaccgcttcacagagcccccagccttcggccctgtgtgtgacctgctgtggagcgaccccagtgaagattatggaaatgagaagaccctggagcactacacccacaacacagtgcggggctgcagctacttctacagctacccagctgtgtgtgagttcctgcagaacaacaacctgctgagcatcatccgggcccacgaggcccaggatgctggctacaggatgtacaggaagagccaggccaccggcttccccagcctcatcaccatcttcagcgcccccaactacctggatgtgtacaacaacaaggctgctgtgctgaagtatgaaaataatgtgatgaacatccggcagttcaactgcagcccccacccctactggctgcccaacttcatggatgtgttcacctggagcctgccctttgtgggggagaaggtgacagagatgctggtgaatgtgctgaacatctgcagtgatgatgagctgatcagtgatgatgaagctgagggcagcaccaccgtgaggaaggagatcatccggaacaagatccgggccatcggcaagatggcccgggtcttcagcatcctgcggcaggagagcgagagcgtgctgaccctgaagggcctgacccccaccggcaccctgcccctgggcgtgctgagcggcggcaagcagaccatcgagacagccatccggggcttcagcctgcagcacaagatccgcagctttgaggaggcccggggcctggaccgcatcaatgaaagaatgccacccaggaaggacagcatccacgccggcggccccatgaagtctgtgaccagcgcccacagccacgccgcccacagaagtgaccagggcaagaaggcccacagctag

SEQ ID NO: 21382 - DNA, 345 bp, Artificial Sequence
  Description of Artificial Sequence: Synthetic coding sequence
atgtactacaagttcagcggcttcacccagaagctggccggggcctgggccagcgaggcctacagcccccagggcctgaagcctgtggtgtccacagaggccccacccatcatctttgccacccccaccaagctgaccagtgacagcacagtgtatgactatgccggcaagaacaaggtgcctgagctgcagaagttcttccagaaggcagatggagtgcctgtgtacctgaagaggggcctgcctgaccagatgctgtaccgcaccaccatggccctgactgtgggcggcaccatctactgcctgattgccctgtacatggccagccagcccaagaacaagtag

SEQ ID NO: 21383 - DNA, 522 bp, Artificial Sequence
  Description of Artificial Sequence: Synthetic coding sequence
atgagcaccatgggaaatgaggccagctacccagctgagatgtgcagccactttgacaatgatgagatcaagaggctgggccgccgcttcaagaagctggacctggacaagagcggcagcctgtctgtggaggagttcatgagcctgcctgagctgcggcacaaccccctggtgagaagagtgattgatgtgtttgacacagatggagatggagaggtggacttcaaggagttcatcctgggcaccagccagttctctgtgaagggagatgaggagcagaagctgcgctttgccttcagcatctatgacatggacaaggatggctacatcagcaatggagagctgttccaggtgctgaagatgatggtgggcaacaacctgacagactggcagctgcagcagctggtggacaagaccatcatcatcctggacaaggatggagatggcaagatcagctttgaggagttctctgctgtggtgcgggacctggagatccacaagaagctggtgctgattgtgtag

SEQ ID NO: 21384 - DNA, 420 bp, Artificial Sequence
  Description of Artificial Sequence: Synthetic coding sequence
atgagcaccatgggaaatgaggccagctacccagctgagatgtgcagccactttgacaatgatgagatcaagaggctgggccgccgcttcaagaagctggacctggacaagagcggcagcctgtctgtggaggagttcatgagcctgcctgagctgcggcacaaccccctggtgagaagagtgattgatgtgtttgacacagatggagatggagaggtggacttcaaggagttcatcctgggcaccagccagttctctgtgaagggagatgaggagcagaagctgcgctttgccttcagcatctatgacatggacaaggatggctacatcagcaatggagagctgttccaggtgctgaagatgatggtgggcaacaacctgacagactggcagctgcagcagctggtgctgattgtgtag

SEQ ID NO: 21385 - DNA, 1818 bp, Artificial Sequence
  Description of Artificial Sequence: Synthetic coding sequence
atggccggcctgtacagcctgggcgtgtctgtgttcagtgaccagggcggcaggaagtacatggaggatgtgacccagatcgtggtggagcctgagcccacagctgaggagaagcccagcccccggcgcagcctgagccagcccctgcccccccggcccagccctgctgccctgcctggaggagaggtgtctgggaagggccctgctgtggccgcccgggaggcccgggaccccctgcctgatgctggggccagccctgcccccagccgctgctgcagaagaagaagctctgtggccttctttgctgtgtgtgatggccatggaggccgggaggccgcccagtttgcccgggagcacctgtggggcttcatcaagaagcagaagggcttcaccagcagcgagcccgccaaggtgtgtgccgccatcaggaagggcttcctggcctgccacctggccatgtggaagaagctggccgagtggcccaagaccatgacaggcctgcccagcaccagcggcaccacagcctctgtggtgatcatccggggcatgaagatgtatgtggcccacgtgggggacagcggcgtggtgctgggcatccaggatgaccccaaggatgactttgtgcgggctgtggaggtgacccaggaccacaagccagagctgcccaaggagcgggagcgcatcgagggcctgggcggctctgtgatgaacaagtctggagtgaacagagtggtgtggaagaggccccggctgacccacaacggccctgtgcggcgcagcacagtgattgaccagatccccttcctggccgtggcccgggccctgggggacctgtggagctatgacttcttctctggagaatttgtggtgtccccagagccagacacctctgtgcacaccctggacccccagaagcacaagtacatcatcctgggcagtgatggcctgtggaacatgatccccccccaggatgccatctccatgtgccaggaccaggaggagaagaagtacctgatgggagagcacggccagagctgtgccaagatgctggtgaacagagccctgggccgctggaggcagaggatgctgcgggctgacaacaccagcgccatcgtcatctgcatcagccctgaggtggacaaccagggcaacttcaccaatgaagatgagctgtacctgaacctgacagacagccccagctacaacagccaggagacctgtgtgatgacccccagcccctgcagcaccccacctgtgaagagcctggaggaggacccctggccccgggtgaacagcaaggaccacatcccagccctggtgcgcagcaatgccttcagcgagaacttcctggaggtgtctgctgagatcgccagagaaaatgtgcagggcgtggtgatccccagcaaggaccctgagcccctggaggagaactgtgccaaggccctgaccctgcgcatccatgacagcctgaacaacagcctgcccatcggcctggtgcccaccaacagcaccaacacagtgatggaccagaagaacctgaagatgagcaccccaggccagatgaaggcccaggagattgaaagaacaccacccaccaacttcaagaggaccctggaggagagcaacagcggccccctgatgaagaagcacagaagaaatggcctgagccgcagcagcggggcccagcctgccagcctgcccaccaccagccagaggaagaacagcgtgaagctgaccatgagaagaaggctgcggggccagaagaagattggcaaccccctgctgcaccagcacaggaagacagtgtgtgtgtgctag

SEQ ID NO: 21386 - DNA, 1293 bp, Artificial Sequence
  Description of Artificial Sequence: Synthetic coding sequence
atggccggcctgtacagcctgggcgtgtctgtgttcagtgaccagggcggcaggaagtacatggaggatgtgacccagatcgtggtggagcctgagcccacagctgaggagaagcccagcccccggcgcagcctgagccagcccctgcccccccggcccagccctgctgccctgcctggaggagaggtgtctgggaagggccctgctgtggccgcccgggaggcccgggaccccctgcctgatgctggggccagccctgcccccagccgctgctgcagaagaagaagctctgtggccttctttgctgtgtgtgatggccatggaggccgggaggccgcccagtttgcccgggagcacctgtggggcttcatcaagaagcagaagggcttcaccagcagcgagcccgccaaggtgtgtgccgccatcaggaagggcttcctggcctgccacctggccatgtggaagaagctggccgagtggcccaagaccatgacaggcctgcccagcaccagcggcaccacagcctctgtggtgatcatccggggcatgaagatgtatgtggcccacgtgggggacagcggcgtggtgctgggcatccaggatgaccccaaggatgactttgtgcgggctgtggaggtgacccaggaccacaagccagagctgcccaaggagcgggagcgcatcgagggcctgggcggctctgtgatgaacaagtctggagtgaacagagtggtgtggaagaggccccggctgacccacaacggccctgtgcggcgcagcacagtgattgaccagatccccttcctggccgtggcccgggccctgggggacctgtggagctatgacttcttctctggagaatttgtggtgtccccagagccagacacctctgtgcacaccctggacccccagaagcacaagtacatcatcctgggcagtgatggcctgtggaacatgatccccccccaggatgccatctccatgtgccaggaccaggaggagaagaagtacctgatgggagagcacggccagagctgtgccaagatgctggtgaacagagccctgggccgctggaggcagaggatgctgcgggctgacaacaccagcgccatcgtcatctgcatcagccctgaggtggacaaccagggcaacttcaccaatgaagatgagctgtacctgaacctgacagacagccccagctacaacagccaggagacctgtgtgatgacccccagcccctgcagcaccccacctgtgaaggactttggatttgagctggacagcaggaagtag

SEQ ID NO: 21387 - DNA, 837 bp, Artificial Sequence
  Description of Artificial Sequence: Synthetic coding sequence
atgtggaagaagctggccgagtggcccaagaccatgacaggcctgcccagcaccagcggcaccacagcctctgtggtgatcatccggggcatgaagatgtatgtggcccacgtgggggacagcggcgtggtgctgggcatccaggatgaccccaaggatgactttgtgcgggctgtggaggtgacccaggaccacaagccagagctgcccaaggagcgggagcgcatcgagggcctgggcggctctgtgatgaacaagtctggagtgaacagagtggtgtggaagaggccccggctgacccacaacggccctgtgcggcgcagcacagtgattgaccagatccccttcctggccgtggcccgggccctgggggacctgtggagctatgacttcttctctggagaatttgtggtgtccccagagccagacacctctgtgcacaccctggacccccagaagcacaagtacatcatcctgggcagtgatggcctgtggaacatgatccccccccaggatgccatctccatgtgccaggaccaggaggagaagaagtacctgatgggagagcacggccagagctgtgccaagatgctggtgaacagagccctgggccgctggaggcagaggatgctgcgggctgacaacaccagcgccatcgtcatctgcatcagccctgaggtggacaaccagggcaacttcaccaatgaagatgagctgtacctgaacctgacagacagccccagctacaacagccaggagacctgtgtgatgacccccagcccctgcagcaccccacctgtgaaggactttggatttgagctggacagcaggaagtag

SEQ ID NO: 21388 - DNA, 3432 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccacagatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcatgactgcacccaggtggagaaggctgacaccaccatctgcctgaagtggaagaacatcgagaccttcacctgtgacacccagaacatcacctaccgcttccagtgtggcaacatgatctttgacaacaaggagatcaagctggagaacctggagcctgagcacgagtacaagtgtgacagcgagatcctgtacaacaaccacaagttcaccaatgccagcaagatcatcaagacagactttggcagccctggagagccccagatcatcttctgccgctctgaggccgcccaccagggcgtcatcacctggaaccccccccagaggagcttccacaacttcaccctgtgctacatcaaggagacagagaaggactgcctgaacctggacaagaacctgatcaagtatgacctgcagaacctgaagccctacaccaagtatgtgctgagcctgcacgcctacatcatcgccaaggtgcagagaaatggatctgctgccatgtgccacttcaccaccaagagcgccccacccagccaggtgtggaacatgacagtgtccatgaccagtgacaacagcatgcacgtgaagtgccggcccccccgggacagaaatggcccccatgagcgctaccacctggaggtggaggccggcaacaccctggtgagaaatgaaagccacaagaactgtgacttccgggtgaaggacctgcagtacagcacagactacaccttcaaggcctacttccacaatggagactacccaggagagcccttcatcctgcaccacagcaccagctacaacagcaaggccctgattgccttcctggccttcctgatcatcgtgaccagcatcgccctgctggtggtgctgtacaagatctatgacctgcacaagaagaggagctgcaacctggatgagcagcaggagctggtggagagagatgatgagaagcagctgatgaatgtggagcccatccacgccgacatcctgctggagacctacaagaggaagattgctgatgagggccgcctcttcctggccgagttccagagcatccccagggtcttcagcaagttccccatcaaggaggccaggaagcccttcaaccagaacaagaaccgctacgtggacatcctgccctatgactacaacagagtggagctgtctgagatcaatggagatgctggcagcaactacatcaatgccagctacattgatggcttcaaggagcccaggaagtacatcgccgcccagggccccagagatgaaacagtggatgacttctggaggatgatctgggagcagaaggccaccgtgattgtgatggtgacccgctgtgaggagggcaacagaaacaagtgtgccgagtactggcccagcatggaggagggcacccgggcctttggagatgtggtggtgaagatcaaccagcacaagcgctgcccagactacatcatccagaagctgaacatcgtgaacaagaaggagaaggccaccggccgggaggtgacccacatccagttcacctcctggccagaccatggagtgcctgaggacccccacctgctgctgaagctgcggaggagagtgaatgccttcagcaacttcttcagcggccccatcgtggtgcactgcagcgctggggtgggccgcacaggcacctacatcggcattgatgccatgctggagggcctggaggccgagaacaaggtggatgtgtatggctacgtggtgaagctgcggcggcagcgctgcctgatggtgcaggtggaggcccagtacatcctgatccaccaggccctggtggagtacaaccagtttggagaaacagaggtgaacctgtctgagctgcacccctacctgcacaacatgaagaagagggacccccccagcgagcccagccccctggaggccgagttccagaggctgcccagctaccgctcctggaggacccagcacatcggcaaccaggaggagaacaagagcaagaacagaaacagcaatgtcatcccctatgactacaacagagtgcccctgaagcatgagctggagatgagcaaggagagcgagcatgacagtgatgagagcagtgatgatgacagcgacagcgaggagcccagcaagtacatcaatgccagcttcatcatgagctactggaagccagaggtgatgattgctgcccagggccccctgaaggagaccatcggggacttctggcagatgatcttccagaggaaggtgaaggtgattgtgatgctgacagagctgaagcatggagaccaggagatctgtgcccagtactggggcgagggcaagcagacctacggggacatcgaggtggacctgaaggacacagacaagagcagcacctacaccctgcgggtgtttgagctgcggcacagcaagaggaaggacagcaggacagtgtaccagtaccagtacaccaactggagcgtggagcagctgcctgctgagcccaaggagctgatctccatgatccaggtggtgaagcagaagctgccccagaagaacagcagcgagggcaacaagcaccacaagagcacccccctgctgatccactgcagagatggcagccagcagacaggcatcttctgtgccctgctgaacctgctggagagcgctgagacagaggaggtggtggacatcttccaggtggtgaaggccctgaggaaggcccggcccggcatggtgtccacctttgagcagtaccagttcctgtatgatgtgattgccagcacctacccagcccagaatggccaggtgaagaagaacaaccaccaggaggacaagattgaatttgacaatgaggtggacaaggtgaagcaggatgccaactgtgtgaaccccctgggcgcccctgagaagctgcctgaggccaaggagcaggccgagggcagcgagcccaccagcggcacagagggccctgagcacagcgtgaatggacctgccagccctgccctgaaccagggcagctag

SEQ ID NO: 21389 - DNA, 105 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccaccgggaagaactag

SEQ ID NO: 21390 - DNA, 447 bp, Artificial Sequence
  Description of Artificial Sequence: Synthetic coding sequence
atggccaggatgaacagacctgcccctgtggaggtgacctacaagaacatgaggttcctgatcacccacaaccccaccaatgccaccctgaacaagttcatcgaggagctgaagaagtatggagtgaccaccatcgtgcgggtgtgtgaggccacctatgacaccaccctggtggagaaggagggcatccacgtgctggactggccctttgatgatggagccccacccagcaaccagatcgtggatgactggctgagcctggtgaagatcaagttccgggaggagcccggctgctgcatcgctgtgcactgtgtggccggcctgggcaggaagagaagaggagccttcaacagcaagcagctgctgtacctggagaagtaccggcccaagatgaggctgcgcttcaaggacagcaatggccacaggaacaactgctgcatccagtag

SEQ ID NO: 21391 - DNA, 447 bp, Artificial Sequence; identical to SEQ ID NO: 21390
  Description of Artificial Sequence: Synthetic coding sequence

SEQ ID NO: 21392 - DNA, 522 bp, Artificial Sequence
  Description of Artificial Sequence: Synthetic coding sequence
atggccaggatgaacagacctgcccctgtggaggtgacctacaagaacatgaggttcctgatcacccacaaccccaccaatgccaccctgaacaagttcatcgaggagctgaagaagtatggagtgaccaccatcgtgcgggtgtgtgaggccacctatgacaccaccctggtggagaaggagggcatccacgtgctggactggccctttgatgatggagccccacccagcaaccagatcgtggatgactggctgagcctggtgaagatcaagttccgggaggagcccggctgctgcatcgctgtgcactgtgtggccggcctgggccgggcccctgtgctggtggccctggccctgattgagggcggcatgaagtatgaagatgctgtgcagttcatccggcagaagagaagaggagccttcaacagcaagcagctgctgtacctggagaagtaccggcccaagatgaggctgcgcttcaaggacagcaatggccacaggaacaactgctgcatccagtag

SEQ ID NO: 21393 - DNA, 1308 bp, Artificial Sequence
  Description of Artificial Sequence: Synthetic coding sequence
atggagatggagaaggagtttgagcagattgacaagagcggctcctgggccgccatctaccaggacatcagacatgaggccagtgacttcccctgccgggtggccaagctgcccaagaacaagaacagaaaccgctacagagatgtgagcccctttgaccacagccgcatcaagctgcaccaggaggacaatgactacatcaatgccagcctcatcaagatggaggaggcccagaggagctacatcctgacccagggccccctgcccaacacctgtggccacttctgggagatggtgtgggagcagaagagccggggcgtggtgatgctgaacagagtgatggagaagggcagcctgaagtgtgcccagtactggccccagaaggaggagaaggagatgatctttgaggacaccaacctgaagctgaccctcatcagcgaggacatcaagagctactacacagtgcggcagctggagctggagaacctgaccacccaggagacccgggagatcctgcacttccactacaccacctggccagactttggagtgcctgagagccctgccagcttcctgaacttcctgttcaaggtgcgggagagcggcagcctgagccctgagcacggccctgtggtggtgcactgcagcgctggcatcggccgcagcggcaccttctgcctggccgacacctgcctgctgctgatggacaagaggaaggaccccagctctgtggacatcaagaaggtgctgctggagatgaggaagttcaggatgggcctcatccagacagctgaccagctgcgcttctcctacctggccgtgattgaaggagccaagttcatcatgggagacagctctgtgcaggaccagtggaaggagctgagccatgaggacctggagcccccacctgagcacatccccccaccaccccggccccccaagaggatcctggagccccacaatggaaaatgtcgggagttcttccccaaccaccagtgggtgaaggaggagacccaggaggacaaggactgccccatcaaggaggagaagggcagccccctgaatgctgccccctatggaattgaatccatgagccaggacacagaggtgcgcagccgggtggtgggcggcagcctgcggggggcccaggccgccagccctgccaagggggagcccagcctgcctgagaaggatgaagatcatgccctgagctactggaagcccttcctggtgaacatgtgtgtggccaccgtgctgacagctggggcctacctgtgctaccgcttcctgttcaacagcaacacctag

SEQ ID NO: 21394 - DNA, 1089 bp, Artificial Sequence
  Description of Artificial Sequence: Synthetic coding sequence
atggaggaggcccagaggagctacatcctgacccagggccccctgcccaacacctgtggccacttctgggagatggtgtgggagcagaagagcagaggagtggtgatgctgaacagagtgatggagaagggcagcctgaagtgtgcccagtactggccccagaaggaggagaaggagatgatctttgaggacaccaacctgaagctgaccctcatcagcgaggacatcaagagctactacacagtgcggcagctggagctggagaacctgaccacccaggagacccgggagatcctgcacttccactacaccacctggccagactttggagtgcctgagagccctgccagcttcctgaacttcctgttcaaggtgcgggagagcggcagcctgagccctgagcacggccctgtggtggtgcactgcagcgctggcatcggccgcagcggcaccttctgcctggccgacacctgcctgctgctgatggacaagaggaaggaccccagctctgtggacatcaagaaggtgctgctggagatgaggaagttcaggatgggcctcatccagacagctgaccagctgcgcttctcctacctggccgtcatcgagggcgccaagttcatcatgggagacagctctgtgcaggaccagtggaaggagctgagccatgaggacctggagcccccacctgagcacatccccccaccacccaggcctcccaagaggatcctggagccccacaacgggaagtgccgggagttcttccccaaccaccagtgggtgaaggaggagacccaggaggacaaggactgccccatcaaggaggagaagggcagccccctgaatgctgccccctacggcatcgagagcatgagccaggacacagaggtgcgcagccgggtggtgggcggcagcctgcggggggcccaggccgccagccctgccaagggggagcccagcctgcctgagaaggatgaggaccacgccctgagctactggaagcccttcctggtgaacatgtgtgtggccaccgtgctgacagctggggcctacctgtgctaccgcttcctgttcaacagcaacacctag

SEQ ID NO: 21395 - DNA, 1782 bp, Artificial Sequence
  Description of Artificial Sequence: Synthetic coding sequence
atgaccagccgccgctggttccaccccaacatcaccggggtggaggccgagaacctgctgctgacccggggcgtggatggcagcttcctggcccggcccagcaagagcaaccctggggacttcaccctgtctgtgagaagaaatggagctgtgacccacatcaagatccagaacacaggagactactatgacctgtatggaggagagaagtttgccaccctggccgagctggtgcagtactacatggagcaccacggccagctgaaggagaagaatggagatgtgattgagctgaagtaccccctgaactgtgccgaccccaccagcgagcgctggttccacggccacctgagcggcaaggaggccgagaagctgctgacagagaagggcaagcacggcagcttcctggtgcgggagagccagagccaccctggggactttgtgctgtctgtgaggactggagatgacaagggggagagcaatgatggcaagagcaaggtgacccacgtgatgatccgctgccaggagctgaagtatgatgtgggcggcggggagagatttgacagcctgacagacctggtggagcactacaagaagaaccccatggtggagaccctgggcaccgtgctgcagctgaagcagcccctgaacaccacccgcatcaatgctgctgagattgagagccgggtgcgggagctgagcaagctggccgagaccacagacaaggtgaagcagggcttctgggaggagtttgagaccctgcagcagcaggagtgcaagctgctgtacagcaggaaggagggccagaggcaggagaacaagaacaagaaccgctacaagaacatcctgccctttgaccacaccagggtggtgctgcatgatggagaccccaatgaacctgtgtctgactacatcaatgccaacatcatcatgcctgagtttgagaccaagtgcaacaacagcaagcccaagaagagctacatcgccacccagggctgcctgcagaacacagtgaatgacttctggaggatggtgttccaggagaacagccgggtgattgtgatgaccaccaaggaggtggagcggggcaagagcaaatgtgtgaagtactggccagatgaatatgccctgaaggagtatggagtgatgagggtgagaaatgtgaaggagagcgctgcccatgactacaccctgcgggagctgaagctgagcaaggtgggccagggcaacacagagaggacagtgtggcagtaccacttccgcacctggccagaccacggcgtgcccagcgaccccggcggcgtgctggacttcctggaggaggtgcaccacaagcaggagagcatcatggatgctggccctgtggtggtgcactgcagcgctggcattggaagaacaggcaccttcatcgtcatcgacatcctgattgacatcatccgggagaagggcgtggactgtgacattgatgtgcccaagaccatccagatggtgcgcagccagaggagcggcatggtgcagacagaggcccagtaccgcttcatctacatggctgtgcagcactacatcgagaccctgcagaggagaattgaggaggagcagaagagcaagaggaagggccacgagtacaccaacatcaagtacagcctggccgaccagaccagcggggaccagagccccctgcccccctgcacccccaccccaccctgtgccgagatgagggaggacagcgcccgggtgtatgaaaatgtgggcctgatgcagcagcagaagagcttcagatag

SEQ ID NO: 21396 - DNA, 651 bp, Artificial Sequence
  Description of Artificial Sequence: Synthetic coding sequence
atgaccagccgccgctggttccaccccaacatcaccggggtggaggccgagaacctgctgctgacccggggcgtggatggcagcttcctggcccggcccagcaagagcaaccctggggacttcaccctgtctgtgagaagaaatggagctgtgacccacatcaagatccagaacacaggagactactatgacctgtatggaggagagaagtttgccaccctggccgagctggtgcagtactacatggagcaccacggccagctgaaggagaagaatggagatgtgattgagctgaagtaccccctgaactgtgccgaccccaccagcgagcgctggttccacggccacctgagcggcaaggaggccgagaagctgctgacagagaagggcaagcacggcagcttcctggtgcgggagagccagagccaccctggggactttgtgctgtctgtgaggactggagatgacaagggggagagcaatgatggcaagagcaaggtgacccacgtgatgatccgctgccaggagctgaagtatgatgtgggcggcggggagagatttgacagcctgacagacctggtggagcactacaagaagaaccccatggtggagaccctgggcaccgtgctgcagctgaagcagcccctgtag

SEQ ID NO: 21397 - DNA, 1383 bp, Artificial Sequence
  Description of Artificial Sequence: Synthetic coding sequence
atgaccagccgccgctggttccaccccaacatcaccggggtggaggccgagaacctgctgctgacccggggcgtggatggcagcttcctggcccggcccagcaagagcaaccctggggacttcaccctgtctgtgagaagaaatggagctgtgacccacatcaagatccagaacacaggagactactatgacctgtatggaggagagaagtttgccaccctggccgagctggtgcagtactacatggagcaccacggccagctgaaggagaagaatggagatgtgattgagctgaagtaccccctgaactgtgccgaccccaccagcgagcgctggttccacggccacctgagcggcaaggaggccgagaagctgctgacagagaagggcaagcacggcagcttcctggtgcgggagagccagagccaccctggggactttgtgctgtctgtgaggactggagatgacaagggggagagcaatgatggcaagagcaaggtgacccacgtgatgatccgctgccaggagctgaagtatgatgtgggcggcggggagagatttgacagcctgacagacctggtggagcactacaagaagaaccccatggtggagaccctgggcaccgtgctgcagctgaagcagcccctgaacaccacccgcatcaatgctgctgagattgagagccgggtgcgggagctgagcaagctggccgagaccacagacaaggtgaagcagggcttctgggaggagtttgagaccctgcagcagcaggagtgcaagctgctgtacagcaggaaggagggccagaggcaggagaacaagaacaagaaccgctacaagaacatcctgccctttgaccacaccagggtggtgctgcatgatggagaccccaatgaacctgtgtctgactacatcaatgccaacatcatcatgcctgagtttgagaccaagtgcaacaacagcaagcccaagaagagctacatcgccacccagggctgcctgcagaacacagtgaatgacttctggaggatggtgttccaggagaacagccgggtgattgtgatgaccaccaaggaggtggagcggggcaagagcaaatgtgtgaagtactggccagatgaatatgccctgaaggagtatggagtgatgagggtgagaaatgtgaaggagagcgctgcccatgactacaccctgcgggagctgaagctgagcaaggtgggccagggcaacacagagaggacagtgtggcagtaccacttccgcacctggccagaccacggcgtgcccagcgaccccggcggcgtgctggacttcctggaggaggtgcaccacaagcaggagagcatcatggatgctggccctgtggtggtgcactgcaggtag

SEQ ID NO: 21398 - DNA, 723 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccaccggccacctgcaggccgaggagcagggcagccagagcaagagccccaacctgaagagccgggaggccgacagcagcgccttctcctggtggcccaaggcccgggagcccctgaccaaccactggaggctgaccacagccaagatgcccagcgtgcccctgagcagtgaccccctgcccacccacaccacagccttcagccctgccagcacctttgaaagagaaaatgacttcagcgagaccaccaccagcctgagcccagacaacaccagcacccaggtgtccccagacagcctggacaatgccagcgccttcaacaccaccggggtgtcctctgtgcagaccccccacctgcccacccacgccgacagccagacccccagcgctggaacagacacccagaccttcagcggcagcgctgccaatgccaagctgaaccccaccccaggcagcaatgccatcagtgatgtgcctggagagaggagcacagccagcaccttccccacagatcctgtgagccccctgaccaccaccctgagcctggcccaccacagcagcgctgccctgcctgcccggaccagcaacaccaccatcacagccaacaccagtgatgcctacctgaatgccagctag

SEQ ID NO: 21399 - DNA, 3432 bp, Artificial Sequence; identical to SEQ ID NO: 21388
  Description of Artificial Sequence: Synthetic coding sequence

SEQ ID NO: 21400 - DNA, 3771 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccaccggcctgaccacagccaagatgcccagcgtgcccctgagcagtgaccccctgcccacccacaccacagccttctccccagccagcacctttgagcgggagaatgacttcagcgagaccaccaccagcctgagcccagacaacaccagcacccaggtgtccccagacagcctggacaatgccagcgccttcaacaccactggagtgtcctctgtgcagaccccccacctgcccacccatgctgacagccagaccccatctgctggaacagacacccagaccttcagcggcagcgctgccaatgccaagctgaaccccaccccaggcagcaatgccatcagtgatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcatgactgcacccaggtggagaaggctgacaccaccatctgcctgaagtggaagaacatcgagaccttcacctgtgacacccagaacatcacctaccgcttccagtgtggcaacatgatctttgacaacaaggagatcaagctggagaacctggagcctgagcacgagtacaagtgtgacagcgagatcctgtacaacaaccacaagttcaccaatgccagcaagatcatcaagacagactttggcagccctggagagccccagatcatcttctgccgctctgaggccgcccaccagggcgtcatcacctggaaccccccccagaggagcttccacaacttcaccctgtgctacatcaaggagacagagaaggactgcctgaacctggacaagaacctgatcaagtatgacctgcagaacctgaagccctacaccaagtatgtgctgagcctgcacgcctacatcatcgccaaggtgcagagaaatggcagcgctgccatgtgccacttcaccaccaagagcgccccacccagccaggtgtggaacatgacagtgtccatgaccagtgacaacagcatgcacgtgaagtgcaggcctccccgggacagaaatggcccccatgagcgctaccacctggaggtggaggccggcaacaccctggtgagaaatgaaagccacaagaactgtgacttccgggtgaaggacctgcagtacagcacagactacaccttcaaggcctacttccacaacggggactacccaggagagcccttcatcctgcaccacagcaccagctacaacagcaaggccctgattgccttcctggccttcctgatcatcgtgaccagcatcgccctgctggtggtgctgtacaagatctatgacctgcacaagaagaggagctgcaacctggatgagcagcaggagctggtggagagagatgatgagaagcagctgatgaatgtggagcccatccatgctgacatcctgctggagacctacaagaggaagattgctgatgagggccgcctcttcctggccgagttccagagcatccccagggtcttcagcaagttccccatcaaggaggccaggaagcccttcaaccagaacaagaacagatatgtggacatcctgccctatgactacaacagagtggagctgtctgagatcaatggagatgctggcagcaactacatcaatgccagctacattgatggcttcaaggagcccaggaagtacatcgccgcccagggccccagagatgagaccgtggatgacttctggaggatgatctgggagcagaaggccaccgtcatcgtgatggtgacccgctgtgaggagggcaacagaaataaatgtgccgagtactggcccagcatggaggagggcacccgggcctttggagatgtggtggtgaagatcaaccagcacaagcgctgcccagactacatcatccagaagctgaacatcgtgaacaagaaggagaaggccaccggccgggaggtgacccacatccagttcacctcctggccagaccacggcgtgcctgaggacccccacctgctgctgaagctgcggcggcgggtgaatgccttcagcaacttcttcagcggccccatcgtggtgcactgcagcgctggggtgggccgcacaggcacctacatcggcattgatgccatgctggagggcctggaggccgagaacaaggtggatgtgtatggctacgtggtgaagctgcggcggcagcgctgcctgatggtgcaggtggaggcccagtacatcctgatccaccaggccctggtggagtacaaccagtttggagaaacagaggtgaacctgtctgagctgcacccctacctgcacaacatgaagaagagggaccccccatctgagcccagccccctggaggccgagttccagaggctgcccagctaccgctcctggaggacccagcacatcggcaaccaggaggagaacaagagcaagaacagaaacagcaatgtcatcccctatgactacaacagagtgcccctgaagcatgagctggagatgagcaaggagagcgagcatgacagtgatgagagcagtgatgatgacagcgacagcgaggagcccagcaagtacatcaatgccagcttcatcatgagctactggaagccagaggtgatgattgctgcccagggccccctgaaggagaccatcggggacttctggcagatgatcttccagaggaaggtgaaggtgattgtgatgctgacagagctgaagcacggggaccaggagatctgtgcccagtactggggcgagggcaagcagacctatggagacatcgaggtggacctgaaggacacagacaagagcagcacctacaccctgcgggtgtttgagctgcggcacagcaagaggaaggacagcaggacagtgtaccagtaccagtacaccaactggagcgtggagcagctgcctgctgagcccaaggagctgatctccatgatccaggtggtgaagcagaagctgccccagaagaacagcagcgagggcaacaagcaccacaagagcacccccctgctgatccactgcagagatggcagccagcagacaggcatcttctgtgccctgctgaacctgctggagagcgctgagacagaggaggtggtggacatcttccaggtggtgaaggccctgaggaaggcccggcccggcatggtgtccacctttgagcagtaccagttcctgtatgatgtgattgccagcacctacccagcccagaatggccaggtgaagaagaacaaccaccaggaggacaagattgaatttgacaatgaggtggacaaggtgaagcaggatgccaactgtgtgaaccccctgggcgcccctgagaagctgcctgaggccaaggagcaggccgagggcagcgagcccaccagcggcacagagggccctgagcacagcgtgaatggacctgccagccctgccctgaaccagggcagctag

SEQ ID NO: 21401 - DNA, 2208 bp, Artificial Sequence
  Description of Artificial Sequence: Synthetic coding sequence
atgaccatgtacctgtggctgaagctgctggccttcggctttgccttcctggacacagaggtgtttgtgacaggccagagccccacccccagccccactggagtgtcctctgtgcagaccccccacctgcccacccatgctgacagccagaccccatctgctggaacagacacccagaccttcagcggcagcgctgccaatgccaagctgaaccccaccccaggcagcaatgccatcagtgatgtgcctggagagaggagcacagccagcaccttccccacagatcctgtgagccccctgaccaccaccctgagcctggcccaccacagcagcgctgccctgcctgcccggaccagcaacaccaccatcacagccaacaccagtgatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcatgactgcacccaggtggagaaggctgacaccaccatctgcctgaagtggaagaacatcgagaccttcacctgtgacacccagaacatcacctaccgcttccagtgtggcaacatgatctttgacaacaaggagatcaagctggagaacctggagcctgagcacgagtacaagtgtgacagcgagatcctgtacaacaaccacaagttcaccaatgccagcaagatcatcaagacagactttggcagccctggagagccccagatcatcttctgccgctctgaggccgcccaccagggcgtcatcacctggaaccccccccagaggagcttccacaacttcaccctgtgctacatcaaggagacagagaaggactgcctgaacctggacaagaacctgatcaagtatgacctgcagaacctgaagccctacaccaagtatgtgctgagcctgcacgcctacatcatcgccaaggtgcagagaaatggcagcgctgccatgtgccacttcaccaccaagagcgccccacccagccaggtgtggaacatgacagtgtccatgaccagtgacaacagcatgcacgtgaagtgcaggcctccccgggacagaaatggcccccatgagcgctaccacctggaggtggaggccggcaacaccctggtgagaaatgaaagccacaagaactgtgacttccgggtgaaggacctgcagtacagcacagactacaccttcaaggcctacttccacaacggggactacccaggagagcccttcatcctgcaccacagcaccagctacaacagcaaggccctgattgccttcctggccttcctgatcatcgtgaccagcatcgccctgctggtggtgctgtacaagatctatgacctgcacaagaagaggagctgcaacctggatgagcagcaggagctggtggagagagatgatgagaagcagctgatgaatgtggagcccatccatgctgacatcctgctggagacctacaagaggaagattgctgatgagggccgcctcttcctggccgagttccagagcatccccagggtcttcagcaagttccccatcaaggaggccaggaagcccttcaaccagaacaagaacagatatgtggacatcctgccctatgactacaacagagtggagctgtctgagatcaatggagatgctggcagcaactacatcaatgccagctacattgatggcttcaaggagcccaggaagtacatcgccgcccagggccccagagatgagaccgtggatgacttctggaggatgatctgggagcagaaggccaccgtcatcgtgatggtgacccgctgtgaggagggcaacagaaataaatgtgccgagtactggcccagcatggaggagggcacccgggcctttggagatgtggtggtgaagatcaaccagcacaagcgctgcccagactacatcatccagaagctgaacatcgtgaactag

SEQ ID NO: 21402 - DNA, 2202 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccactggagtgtcctctgtgcagaccccccacctgcccacccatgctgacagccagaccccatctgctggaacagacacccagaccttcagcggcagcgctgccaatgccaagctgaaccccaccccaggcagcaatgccatcagtgatgtgcctggagagaggagcacagccagcaccttccccacagatcctgtgagccccctgaccaccaccctgagcctggcccaccacagcagcgctgccctgcctgcccggaccagcaacaccaccatcacagccaacaccagtgatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcatgactgcacccaggtggagaaggctgacaccaccatctgcctgaagtggaagaacatcgagaccttcacctgtgacacccagaacatcacctaccgcttccagtgtggcaacatgatctttgacaacaaggagatcaagctggagaacctggagcctgagcacgagtacaagtgtgacagcgagatcctgtacaacaaccacaagttcaccaatgccagcaagatcatcaagacagactttggcagccctggagagccccagatcatcttctgccgctctgaggccgcccaccagggcgtcatcacctggaaccccccccagaggagcttccacaacttcaccctgtgctacatcaaggagacagagaaggactgcctgaacctggacaagaacctgatcaagtatgacctgcagaacctgaagccctacaccaagtatgtgctgagcctgcacgcctacatcatcgccaaggtgcagagaaatggcagcgctgccatgtgccacttcaccaccaagagcgccccacccagccaggtgtggaacatgacagtgtccatgaccagtgacaacagcatgcacgtgaagtgcaggcctccccgggacagaaatggcccccatgagcgctaccacctggaggtggaggccggcaacaccctggtgagaaatgaaagccacaagaactgtgacttccgggtgaaggacctgcagtacagcacagactacaccttcaaggcctacttccacaacggggactacccaggagagcccttcatcctgcaccacagcaccagctacaacagcaaggccctgattgccttcctggccttcctgatcatcgtgaccagcatcgccctgctggtggtgctgtacaagatctatgacctgcacaagaagaggagctgcaacctggatgagcagcaggagctggtggagagagatgatgagaagcagctgatgaatgtggagcccatccatgctgacatcctgctggagacctacaagaggaagattgctgatgagggccgcctcttcctggccgagttccagagcatccccagggtcttcagcaagttccccatcaaggaggccaggaagcccttcaaccagaacaagaacagatatgtggacatcctgccctatgactacaacagagtggagctgtctgagatcaatggagatgctggcagcaactacatcaatgccagctacattgatggcttcaaggagcccaggaagtacatcgccgcccagggccccagagatgagaccgtggatgacttctggaggatgatctgggagcagaaggccaccgtcatcgtgatggtgacccgctgtgaggagggcaacagaaataaatgtgccgagtactggcccagcatggaggagggcacccgggcctttggagatgtggtggtgaagatcaaccagcacaagcgctgcccagactacatcatccagaagctgaacatcgtgaactag

SEQ ID NO: 21403 - DNA, 3921 bp, Artificial Sequence
  Description of Artificial Sequence: Synthetic coding sequence
atgaccatgtacctgtggctgaagctgctggccttcggctttgccttcctggacacagaggtgtttgtgacaggccagagccccacccccagccccaccggcctgaccacagccaagatgcccagcgtgcccctgagcagtgaccccctgcccacccacaccacagccttctccccagccagcacctttgagcgggagaatgacttcagcgagaccaccaccagcctgagcccagacaacaccagcacccaggtgtccccagacagcctggacaatgccagcgccttcaacaccactggagtgtcctctgtgcagaccccccacctgcccacccatgctgacagccagaccccatctgctggaacagacacccagaccttcagcggcagcgctgccaatgccaagctgaaccccaccccaggcagcaatgccatcagtgatgtgcctggagagaggagcacagccagcaccttccccacagatcctgtgagccccctgaccaccaccctgagcctggcccaccacagcagcgctgccctgcctgcccggaccagcaacaccaccatcacagccaacaccagtgatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcatgactgcacccaggtggagaaggctgacaccaccatctgcctgaagtggaagaacatcgagaccttcacctgtgacacccagaacatcacctaccgcttccagtgtggcaacatgatctttgacaacaaggagatcaagctggagaacctggagcctgagcacgagtacaagtgtgacagcgagatcctgtacaacaaccacaagttcaccaatgccagcaagatcatcaagacagactttggcagccctggagagccccagatcatcttctgccgctctgaggccgcccaccagggcgtcatcacctggaaccccccccagaggagcttccacaacttcaccctgtgctacatcaaggagacagagaaggactgcctgaacctggacaagaacctgatcaagtatgacctgcagaacctgaagccctacaccaagtatgtgctgagcctgcacgcctacatcatcgccaaggtgcagagaaatggcagcgctgccatgtgccacttcaccaccaagagcgccccacccagccaggtgtggaacatgacagtgtccatgaccagtgacaacagcatgcacgtgaagtgcaggcctccccgggacagaaatggcccccatgagcgctaccacctggaggtggaggccggcaacaccctggtgagaaatgaaagccacaagaactgtgacttccgggtgaaggacctgcagtacagcacagactacaccttcaaggcctacttccacaacggggactacccaggagagcccttcatcctgcaccacagcaccagctacaacagcaaggccctgattgccttcctggccttcctgatcatcgtgaccagcatcgccctgctggtggtgctgtacaagatctatgacctgcacaagaagaggagctgcaacctggatgagcagcaggagctggtggagagagatgatgagaagcagctgatgaatgtggagcccatccatgctgacatcctgctggagacctacaagaggaagattgctgatgagggccgcctcttcctggccgagttccagagcatccccagggtcttcagcaagttccccatcaaggaggccaggaagcccttcaaccagaacaagaacagatatgtggacatcctgccctatgactacaacagagtggagctgtctgagatcaatggagatgctggcagcaactacatcaatgccagctacattgatggcttcaaggagcccaggaagtacatcgccgcccagggccccagagatgagaccgtggatgacttctggaggatgatctgggagcagaaggccaccgtcatcgtgatggtgacccgctgtgaggagggcaacagaaataaatgtgccgagtactggcccagcatggaggagggcacccgggcctttggagatgtggtggtgaagatcaaccagcacaagcgctgcccagactacatcatccagaagctgaacatcgtgaacaagaaggagaaggccaccggccgggaggtgacccacatccagttcacctcctggccagaccacggcgtgcctgaggacccccacctgctgctgaagctgcggcggcgggtgaatgccttcagcaacttcttcagcggccccatcgtggtgcactgcagcgctggggtgggccgcacaggcacctacatcggcattgatgccatgctggagggcctggaggccgagaacaaggtggatgtgtatggctacgtggtgaagctgcggcggcagcgctgcctgatggtgcaggtggaggcccagtacatcctgatccaccaggccctggtggagtacaaccagtttggagaaacagaggtgaacctgtctgagctgcacccctacctgcacaacatgaagaagagggaccccccatctgagcccagccccctggaggccgagttccagaggctgcccagctaccgctcctggaggacccagcacatcggcaaccaggaggagaacaagagcaagaacagaaacagcaatgtcatcccctatgactacaacagagtgcccctgaagcatgagctggagatgagcaaggagagcgagcatgacagtgatgagagcagtgatgatgacagcgacagcgaggagcccagcaagtacatcaatgccagcttcatcatgagctactggaagccagaggtgatgattgctgcccagggccccctgaaggagaccatcggggacttctggcagatgatcttccagaggaaggtgaaggtgattgtgatgctgacagagctgaagcacggggaccaggagatctgtgcccagtactggggcgagggcaagcagacctatggagacatcgaggtggacctgaaggacacagacaagagcagcacctacaccctgcgggtgtttgagctgcggcacagcaagaggaaggacagcaggacagtgtaccagtaccagtacaccaactggagcgtggagcagctgcctgctgagcccaaggagctgatctccatgatccaggtggtgaagcagaagctgccccagaagaacagcagcgagggcaacaagcaccacaagagcacccccctgctgatccactgcagagatggcagccagcagacaggcatcttctgtgccctgctgaacctgctggagagcgctgagacagaggaggtggtggacatcttccaggtggtgaaggccctgaggaaggcccggcccggcatggtgtccacctttgagcagtaccagttcctgtatgatgtgattgccagcacctacccagcccagaatggccaggtgaagaagaacaaccaccaggaggacaagattgaatttgacaatgaggtggacaaggtgaagcaggatgccaactgtgtgaaccccctgggcgcccctgagaagctgcctgaggccaaggagcaggccgagggcagcgagcccaccagcggcacagagggccctgagcacagcgtgaatggacctgccagccctgccctgaaccagggcagctag

SEQ ID NO: 21404 - DNA, 441 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccacagatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcactag

SEQ ID NO: 21405 - DNA, 351 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccaccggcctgaccacagccaagatgcccagcgtgcccctgagcagtgaccccctgcccacccacaccacagccttctccccagccagcacctttgagcgggagaatgacttcagcgagaccaccaccagcctgagcccagacaacaccagcacccaggtgtccccagacagcctggacaatgccagcgccttcaacaccactggagtgtcctctgtgcagaccccccacctgcccacccatgctgacagccagaccccctag

SEQ ID NO: 21406 - DNA, 3915 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccaccggcctgaccacagccaagatgcccagcgtgcccctgagcagtgaccccctgcccacccacaccacagccttctccccagccagcacctttgagcgggagaatgacttcagcgagaccaccaccagcctgagcccagacaacaccagcacccaggtgtccccagacagcctggacaatgccagcgccttcaacaccactggagtgtcctctgtgcagaccccccacctgcccacccatgctgacagccagaccccatctgctggaacagacacccagaccttcagcggcagcgctgccaatgccaagctgaaccccaccccaggcagcaatgccatcagtgatgtgcctggagagaggagcacagccagcaccttccccacagatcctgtgagccccctgaccaccaccctgagcctggcccaccacagcagcgctgccctgcctgcccggaccagcaacaccaccatcacagccaacaccagtgatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcatgactgcacccaggtggagaaggctgacaccaccatctgcctgaagtggaagaacatcgagaccttcacctgtgacacccagaacatcacctaccgcttccagtgtggcaacatgatctttgacaacaaggagatcaagctggagaacctggagcctgagcacgagtacaagtgtgacagcgagatcctgtacaacaaccacaagttcaccaatgccagcaagatcatcaagacagactttggcagccctggagagccccagatcatcttctgccgctctgaggccgcccaccagggcgtcatcacctggaaccccccccagaggagcttccacaacttcaccctgtgctacatcaaggagacagagaaggactgcctgaacctggacaagaacctgatcaagtatgacctgcagaacctgaagccctacaccaagtatgtgctgagcctgcacgcctacatcatcgccaaggtgcagagaaatggcagcgctgccatgtgccacttcaccaccaagagcgccccacccagccaggtgtggaacatgacagtgtccatgaccagtgacaacagcatgcacgtgaagtgcaggcctccccgggacagaaatggcccccatgagcgctaccacctggaggtggaggccggcaacaccctggtgagaaatgaaagccacaagaactgtgacttccgggtgaaggacctgcagtacagcacagactacaccttcaaggcctacttccacaacggggactacccaggagagcccttcatcctgcaccacagcaccagctacaacagcaaggccctgattgccttcctggccttcctgatcatcgtgaccagcatcgccctgctggtggtgctgtacaagatctatgacctgcacaagaagaggagctgcaacctggatgagcagcaggagctggtggagagagatgatgagaagcagctgatgaatgtggagcccatccatgctgacatcctgctggagacctacaagaggaagattgctgatgagggccgcctcttcctggccgagttccagagcatccccagggtcttcagcaagttccccatcaaggaggccaggaagcccttcaaccagaacaagaacagatatgtggacatcctgccctatgactacaacagagtggagctgtctgagatcaatggagatgctggcagcaactacatcaatgccagctacattgatggcttcaaggagcccaggaagtacatcgccgcccagggccccagagatgagaccgtggatgacttctggaggatgatctgggagcagaaggccaccgtcatcgtgatggtgacccgctgtgaggagggcaacagaaataaatgtgccgagtactggcccagcatggaggagggcacccgggcctttggagatgtggtggtgaagatcaaccagcacaagcgctgcccagactacatcatccagaagctgaacatcgtgaacaagaaggagaaggccaccggccgggaggtgacccacatccagttcacctcctggccagaccacggcgtgcctgaggacccccacctgctgctgaagctgcggcggcgggtgaatgccttcagcaacttcttcagcggccccatcgtggtgcactgcagcgctggggtgggccgcacaggcacctacatcggcattgatgccatgctggagggcctggaggccgagaacaaggtggatgtgtatggctacgtggtgaagctgcggcggcagcgctgcctgatggtgcaggtggaggcccagtacatcctgatccaccaggccctggtggagtacaaccagtttggagaaacagaggtgaacctgtctgagctgcacccctacctgcacaacatgaagaagagggaccccccatctgagcccagccccctggaggccgagttccagaggctgcccagctaccgctcctggaggacccagcacatcggcaaccaggaggagaacaagagcaagaacagaaacagcaatgtcatcccctatgactacaacagagtgcccctgaagcatgagctggagatgagcaaggagagcgagcatgacagtgatgagagcagtgatgatgacagcgacagcgaggagcccagcaagtacatcaatgccagcttcatcatgagctactggaagccagaggtgatgattgctgcccagggccccctgaaggagaccatcggggacttctggcagatgatcttccagaggaaggtgaaggtgattgtgatgctgacagagctgaagcacggggaccaggagatctgtgcccagtactggggcgagggcaagcagacctatggagacatcgaggtggacctgaaggacacagacaagagcagcacctacaccctgcgggtgtttgagctgcggcacagcaagaggaaggacagcaggacagtgtaccagtaccagtacaccaactggagcgtggagcagctgcctgctgagcccaaggagctgatctccatgatccaggtggtgaagcagaagctgccccagaagaacagcagcgagggcaacaagcaccacaagagcacccccctgctgatccactgcagagatggcagccagcagacaggcatcttctgtgccctgctgaacctgctggagagcgctgagacagaggaggtggtggacatcttccaggtggtgaaggccctgaggaaggcccggcccggcatggtgtccacctttgagcagtaccagttcctgtatgatgtgattgccagcacctacccagcccagaatggccaggtgaagaagaacaaccaccaggaggacaagattgaatttgacaatgaggtggacaaggtgaagcaggatgccaactgtgtgaaccccctgggcgcccctgagaagctgcctgaggccaaggagcaggccgagggcagcgagcccaccagcggcacagagggccctgagcacagcgtgaatggacctgccagccctgccctgaaccagggcagctag

SEQ ID NO: 21407 - DNA, 1797 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccactggagtgtcctctgtgcagaccccccacctgcccacccatgctgacagccagaccccatctgctggaacagacacccagaccttcagcggcagcgctgccaatgccaagctgaaccccaccccaggcagcaatgccatcagtgatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcatgactgcacccaggtggagaaggctgacaccaccatctgcctgaagtggaagaacatcgagaccttcacctgtgacacccagaacatcacctaccgcttccagtgtggcaacatgatctttgacaacaaggagatcaagctggagaacctggagcctgagcacgagtacaagtgtgacagcgagatcctgtacaacaaccacaagttcaccaatgccagcaagatcatcaagacagactttggcagccctggagagccccagatcatcttctgccgctctgaggccgcccaccagggcgtcatcacctggaaccccccccagaggagcttccacaacttcaccctgtgctacatcaaggagacagagaaggactgcctgaacctggacaagaacctgatcaagtatgacctgcagaacctgaagccctacaccaagtatgtgctgagcctgcacgcctacatcatcgccaaggtgcagagaaatggcagcgctgccatgtgccacttcaccaccaagagcgccccacccagccaggtgtggaacatgacagtgtccatgaccagtgacaacagcatgcacgtgaagtgcaggcctccccgggacagaaatggcccccatgagcgctaccacctggaggtggaggccggcaacaccctggtgagaaatgaaagccacaagaactgtgacttccgggtgaaggacctgcagtacagcacagactacaccttcaaggcctacttccacaacggggactacccaggagagcccttcatcctgcaccacagcaccagctacaacagcaaggccctgattgccttcctggccttcctgatcatcgtgaccagcatcgccctgctggtggtgctgtacaagatctatgacctgcacaagaagaggagctgcaacctggatgagcagcaggagctggtggagagagatgatgagaagcagctgatgaatgtggagcccatccatgctgacatcctgctggagacctacaagaggaagattgctgatgagggccgcctcttcctggccgagttccagagcatccccagggtcttcagcaagttccccatcaaggaggccaggaagcccttcaaccagaacaagaacagatatgtggacatcctgccctatgactacaacagagtggagctgtctgagatcaatggagatgctggcagcaactacatcaatgccagctacattgattag

SEQ ID NO: 21408 - DNA, 2271 bp, Artificial Sequence
  Description of Artificial Sequence: Synthetic coding sequence
atgtacctgtggctgaagctgctggccttcggctttgccttcctggacacagaggtgtttgtgacaggccagagccccacccccagccccaccggcctgaccacagccaagatgcccagcgtgcccctgagcagtgaccccctgcccacccacaccacagccttctccccagccagcacctttgagcgggagaatgacttcagcgagaccaccaccagcctgagcccagacaacaccagcacccaggtgtccccagacagcctggacaatgccagcgccttcaacaccactggagtgtcctctgtgcagaccccccacctgcccacccatgctgacagccagaccccatctgctggaacagacacccagaccttcagcggcagcgctgccaatgccaagctgaaccccaccccaggcagcaatgccatcagtgatgcctacctgaatgccagcgagaccaccaccctgagccccagcggcagcgctgtgatcagcaccaccaccatcgccaccacccccagcaagcccacctgtgatgagaagtatgccaacatcaccgtggactacctgtacaacaaggagaccaagctgttcaccgccaagctgaatgtgaatgaaaatgtggagtgtggcaacaacacctgcaccaacaatgaggtgcacaacctgacagagtgcaagaatgcctctgtgtccatcagccacaacagctgcacagccccagacaagaccctcatcctggatgtgcccccaggagtggagaagttccagctgcatgactgcacccaggtggagaaggctgacaccaccatctgcctgaagtggaagaacatcgagaccttcacctgtgacacccagaacatcacctaccgcttccagtgtggcaacatgatctttgacaacaaggagatcaagctggagaacctggagcctgagcacgagtacaagtgtgacagcgagatcctgtacaacaaccacaagttcaccaatgccagcaagatcatcaagacagactttggcagccctggagagccccagatcatcttctgccgctctgaggccgcccaccagggcgtcatcacctggaaccccccccagaggagcttccacaacttcaccctgtgctacatcaaggagacagagaaggactgcctgaacctggacaagaacctgatcaagtatgacctgcagaacctgaagccctacaccaagtatgtgctgagcctgcacgcctacatcatcgccaaggtgcagagaaatggcagcgctgccatgtgccacttcaccaccaagagcgccccacccagccaggtgtggaacatgacagtgtccatgaccagtgacaacagcatgcacgtgaagtgcaggcctccccgggacagaaatggcccccatgagcgctaccacctggaggtggaggccggcaacaccctggtgagaaatgaaagccacaagaactgtgacttccgggtgaaggacctgcagtacagcacagactacaccttcaaggcctacttccacaacggggactacccaggagagcccttcatcctgcaccacagcaccagctacaacagcaaggccctgattgccttcctggccttcctgatcatcgtgaccagcatcgccctgctggtggtgctgtacaagatctatgacctgcacaagaagaggagctgcaacctggatgagcagcaggagctggtggagagagatgatgagaagcagctgatgaatgtggagcccatccatgctgacatcctgctggagacctacaagaggaagattgctgatgagggccgcctcttcctggccgagttccagagcatccccagggtcttcagcaagttccccatcaaggaggccaggaagcccttcaaccagaacaagaacagatatgtggacatcctgccctatgactacaacagagtggagctgtctgagatcaatggagatgctggcagcaactacatcaatgccagctacattgatggcttcaaggagcccaggaagtacatcgccgcccagggccccagagatgagaccgtggatgacttctggaggatgatctgggagcagaaggccaccgtcatcgtgatggtgacccgctgtgaggagggcaacagaaataaatgtgccgagtactggcccagcatggaggagggcacccgggcctttggagatgtggtggtgaagatcaaccagcacaagcgctgcccagactacatcatccagaagctgaacatcgtgaacaagcagaagagcaagtag

SEQ ID NO: 21409 - DNA, 1662 bp, Artificial Sequence
  Description of Artificial Sequence: Synthetic coding sequence
agtgactacatgatcatcaagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcacccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggcctgccactacaccagcctgcactggaactggtgccgctacatcagtgaccccaacgtggactgcccagaccccagaaatgctgaggtgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgtccttccagaacccagcccagatgctgcctgccagcggccgcctgcccaaccagccctgcccagagcgggagaactacagctttgccaccttctag

SEQ ID NO: 21410 - DNA, 2931 bp, Artificial Sequence
  Description of Artificial Sequence: Synthetic coding sequence
cgctccttcatcatcctgaaggccatcgtgtcccagcccccaggccctgtgctgagcggcatggagatgctgctgatgagcggctatgagctgcgcatccgctacctgcccaagggcttcctgaaccagttcacagaggacaagcccaccctgaacttcttctaccagcaggtgaagagtgactacatgctggagattgctgaccaggtggaccaggagatcgccctgaagctgggctgcctggagatccgccgcagctactgggagatgagaggaaatgccctggagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgatgagatccctggagctgagacagatgattatgcagagatcattgatgaggaggacacctacaccatgcccagcatcaagagctactgcattgatgtggcccgggactatgagatccagcgggagagaattgagctgggccgctgcattggagagggccagtttggagatgtgcaccagggcatctacatgagccctgagaacccagccctggccgtggccatcaagacctgcaagaactgcaccagtgacagcgtgcgggagaagttcctgcaggaggccctgaccatgaggcagtttgaccacccccacatcgtgaagctgattggagtcatcacagaaaatcctgtgtggatcatcatggagctgtgcaccctgggggagctgcggagcttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcatggagtgaagcccttccagggcgtgaagaacaatgatgtgattggaagaattgaaaatggagagcggctgcccatgccacccaactgcccccccaccctgtacagcctgatgaccaagtgctgggcctatgaccccagccggcggccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagcaggcctggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgaccgggaggatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagcccctgcggctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21411 - DNA, 3024 bp, Artificial Sequence
  Description of Artificial Sequence: Synthetic coding sequence
aaggccgagtatgaccgctacctggccagcagcaagatcatggccgccgcctacctggaccccaacctgaaccacacccccaaggagtggaagtatgagctgcgcatccgctacctgcccaagggcttcctgaaccagttcacagaggacaagcccaccctgaacttcttctaccagcaggtgaagagtgactacatgctggagattgctgaccaggtggaccaggagatcgccctgaagctgggctgcctggagatcagaagaagctactgggagatgagaggaaatgccctggagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctggagtgagccactgccagcacaaggtgaagaaggcccggcgcttcctgcccctggtgttctgcagccatgacccccccagcacagatgagatctctggagatgaaacagatgattatgcagagatcattgatgaggaggacacctacaccatgcccagcatcaagagctactgcattgatgtggcccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagcccctgcggctgcagccccaggagatcagccccccacccacagccaacctggacaggagcaatgacaaggtgtatgaaaatgtgacaggcctggtgaaggctgtgattgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21412 - DNA, 3198 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtggaagtatgagctgcgcatccgctacctgcccaagggcttcctgaaccagttcacagaggacaagcccaccctgaacttcttctaccagcaggtgaagagtgactacatgctggagattgctgaccaggtggaccaggagatcgccctgaagctgggctgcctggagatcagaagaagctactgggagatgagaggaaatgccctggagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcacccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccaggcaaggaggagaagaactgggccgagagaaatcctgctgccccacccaagaagccacccaggcctggggcccctggccacctgggcagcctggccagcctgagcagccctgctgacagctacaatgaaggagtgaagcccaaccagctgcagccccaggagatcagccccccacccacagccaacctggacaggagcaatgacaaggtgtatgaaaatgtgacaggcctggtgaaggctgtgattgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21413 - DNA, 2253 bp, Artificial Sequence
  Description of Artificial Sequence: Synthetic coding sequence
atggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctggagtgagccactgccagcacaaggtgaagaaggcccggcgcttcctgcccctggtgttctgcagccatgacccccccagcacagatgagatctctggagatgaaacagatgattatgcagagatcattgatgaggaggacacctacaccatgcccagcacccgggactatgagatccagcgggagagaattgagctgggccgctgcattggagagggccagtttggagatgtgcaccagggcatctacatgagccctgagaacccagccctggccgtggccatcaagacctgcaagaactgcaccagtgacagcgtgcgggagaagttcctgcaggaggccctgaccatgaggcagtttgaccacccccacatcgtgaagctgattggagtcatcacagaaaatcctgtgtggatcatcatggagctgtgcaccctgggggagctgcggagcttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcatggagtgaagcccttccagggcgtgaagaacaatgatgtgattggaagaattgaaaatggagagcggctgcccatgccacccaactgcccccccaccctgtacagcctgatgaccaagtgctgggcctatgaccccagccggcggccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagcaggcctggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgaccgggaggatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagccctgccgcctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21414 - DNA, 1089 bp, Artificial Sequence
  Description of Artificial Sequence: Synthetic coding sequence
atgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21415 - DNA, 354 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccatag

SEQ ID NO: 21416 - DNA, 3291 bp, Artificial Sequence
  Description of Artificial Sequence: Synthetic coding sequence
atgctgctggagctggccggccaggaggccctgaagccagctggggccatctacatggagaagagcggctgcagccccttccctgtgtgctgggccaaggagtatgaccgctacctggccagcagcaagatcatggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtggaagtatgagctgcgcatccgctacctgcccaagggcttcctgaaccagttcacagaggacaagcccaccctgaacttcttctaccagcaggtgaagagtgactacatgctggagattgctgaccaggtggaccaggagatcgccctgaagctgggctgcctggagatcagaagaagctactgggagatgagaggaaatgccctggagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcacccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21417 - DNA, 3291 bp, Artificial Sequence; identical to SEQ ID NO: 21416
  Description of Artificial Sequence: Synthetic coding sequence

SEQ ID NO: 21418 - DNA, 2043 bp, Artificial Sequence
  Description of Artificial Sequence: Synthetic coding sequence
atgaagtaccaggaggtgcgctgcctgaccagcttcaacatctctgtgtccttccctgctgagacagatgattatgcagagatcattgatgaggaggacacctacaccatgcccagcacccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21419 - DNA, 3054 bp, Artificial Sequence
  Description of Artificial Sequence: Synthetic coding sequence
tgatatgaccgctacctggccagcagcaagatcatggccgccgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtggaagtatgagctgcgcatccgctacctgcccaagggcttcctgaaccagttcacagaggacaagcccaccctgaacttcttctaccagcaggtgaagagtgactacatgctggagattgctgaccaggtggaccaggagatcgccctgaagctgggctgcctggagatccgccgcagctactgggagatgagaggaaatgccctggagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcacccgggactatgagatccagcgggagagaattgagctgggccgctgcattggagagggccagtttggagatgtgcaccagggcatctacatgagccctgagaacccagccctggccgtggccatcaagacctgcaagaactgcaccagtgacagcgtgcgggagaagttcctgcaggaggccctgaccatgaggcagtttgaccacccccacatcgtgaagctgattggagtcatcacagaaaatcctgtgtggatcatcatggagctgtgcaccctgggggagctgcggagcttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcatggagtgaagcccttccagggcgtgaagaacaatgatgtgattggaagaattgaaaatggagagcggctgcccatgccacccaactgcccccccaccctgtacagcctgatgaccaagtgctgggcctatgaccccagccggcggccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagcaggcctggctaccccagccccaggagcagcgagggcttctaccccagcccccagcacatggtgcagaccaaccactaccaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgaccgggaggatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagctgcagccccaggagatcagccccccacccacagccaacctggacaggagcaatgacaaggtgtatgaaaatgtgacaggcctggtgaaggctgtgattgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21420 - DNA, 354 bp, Artificial Sequence; identical to SEQ ID NO: 21415
  Description of Artificial Sequence: Synthetic coding sequence

SEQ ID NO: 21421 - DNA, 471 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtggaagtatgagctgcgcatccgctacctgcccaagggcttcctgaaccagttcacagaggacaagcccaccctgaacttcttctaccagcaggtgaagagtgactacatgtag

SEQ ID NO: 21422 - DNA, 3159 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtggaagtatgagctgcgcatccgctacctgcccaagggcttcctgaaccagttcacagaggacaagcccaccctgaacttcttctaccagcaggtgaagagtgactacatgctggagattgctgaccaggtggaccaggagatcgccctgaagctgggctgcctggagatcagaagaagctactgggagatgagaggaaatgccctggagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcacccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21423 - DNA, 198 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgaggtag

SEQ ID NO: 21424 - DNA, 324 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgtag

SEQ ID NO: 21425 - DNA, 360 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtag

SEQ ID NO: 21426 - DNA, 2262 bp, Artificial Sequence
  Description of Artificial Sequence: Synthetic coding sequence
gctgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctggagtgagccactgccagcacaaggtgaagaaggcccggcgcttcctgcccctggtgttctgcagccatgacccccccagcacagatgagatctctggagatgaaacagatgattatgcagagatcattgatgaggaggacacctacaccatgcccagcacccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagccctggaggctgcagccccaggagatcagccccccacccacagccaacctggacaggagcaatgacaaggtgtatgaaaatgtgacaggcctggtgaaggctgtgattgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21427 - DNA, 3159 bp, Artificial Sequence; identical to SEQ ID NO: 21422
  Description of Artificial Sequence: Synthetic coding sequence

SEQ ID NO: 21428 - DNA, 2175 bp, Artificial Sequence
  Description of Artificial Sequence: Synthetic coding sequence
attgctgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcaagagctatggaattgatgaggcccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21429 - DNA, 363 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtggtag

SEQ ID NO: 21430 - DNA, 156 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctag

SEQ ID NO: 21431 - DNA, 3021 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtggaagtatgagctgcgcatccgctacctgcccaagggcttcctgaaccagttcacagaggacaagcccaccctgaacttcttctaccagcaggtgaagagtgactacatgctggagattgctgaccaggtggaccaggagatcgccctgaagctgggctgcctggagatcagaagaagctactgggagatgagaggaaatgccctggagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcacccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21432 - DNA, 2163 bp, Artificial Sequence
  Description of Artificial Sequence: Synthetic coding sequence
atggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcaagagctatggaattgatgaggcccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccagaccctgctgccccacccaagaagccacccaggcctggggcccctggccacctgggcagcctggccagcctgagcagccctgctgacagctacaatgaaggagtgaagctgcagccccaggagatcagccccccacccacagccaacctggacaggagcaatgacaaggtgtatgaaaatgtgacaggcctggtgaaggccgtcatcgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21433 - DNA, 3198 bp, Artificial Sequence
  Description of Artificial Sequence: Synthetic coding sequence
atggctgctgcctacctggaccccaacctgaaccacacccccaacagcagcaccaagacccacctgggcaccggcatggagaggagccctggggccatggagcgggtgctgaaggtgttccactactttgagagcaacagcgagcccaccacctgggccagcatcatcagacatggagatgccacagatgtgcggggcatcatccagaagatcgtggacagccacaaggtgaagcacgtggcctgctacggcttccggctgagccacctgcggtctgaggaggtgcactggctgcacgtggacatgggcgtgtcctctgtgcgggagaagtatgagctggcccaccccccagaggagtggaagtatgagctgcgcatccgctacctgcccaagggcttcctgaaccagttcacagaggacaagcccaccctgaacttcttctaccagcaggtgaagagtgactacatgctggagattgctgaccaggtggaccaggagatcgccctgaagctgggctgcctggagatcagaagaagctactgggagatgagaggaaatgccctggagaagaagagcaactatgaggtgctggagaaggatgtgggcctgaagcgcttcttccccaagagcctgctggacagcgtgaaggccaagaccctgaggaagctgatccagcagaccttccggcagtttgccaacctgaaccgggaggagagcatcctgaagttctttgagatcctgagccctgtgtacagatttgacaaggagtgcttcaagtgtgccctgggcagctcctggatcatctctgtggagctggccatcggccctgaggagggcatctcctacctgacagacaagggctgcaaccccacccacctggccgacttcacccaggtgcagaccatccagtacagcaacagcgaggacaaggacaggaagggcatgctgcagctgaagattgctggggcccctgagcccctgactgtgacagcccccagcctgaccatcgccgagaacatggctgacctgattgatggctactgccgcctggtgaatggcaccagccagagcttcatcatccggccccagaaggagggggagcgggccctgcccagcatccccaagctggccaacagcgagaagcagggcatgaggacccatgctgtgtctgtgtctgaaacagatgattatgcagagatcattgatgaggaggacacctacaccatgcccagcacccgggactatgagatccagcgggagcgcatcgagctgggccgctgcatcggggagggccagtttggagatgtgcaccagggcatctacatgagcccagaaaatcctgccctggccgtggccatcaagacctgcaagaactgcaccagtgacagcgtgcgggagaagttcctgcaggaggccctgaccatgaggcagtttgaccacccccacatcgtgaagctgattggagtcatcacagagaaccctgtgtggatcatcatggagctgtgcaccctgggggagctgcgctccttcctgcaggtgaggaagtacagcctggacctggccagcctcatcctgtatgcctaccagctgagcacagccctggcctacctggagagcaagagatttgtgcaccgggacattgctgccagaaatgtgctggtgagcagcaatgactgtgtgaagctgggggactttggcctgagccgctacatggaggacagcacctactacaaggccagcaagggcaagctgcccatcaagtggatggcccctgagagcatcaacttccgccgcttcaccagcgccagtgatgtgtggatgtttggagtgtgcatgtgggagatcctgatgcacggcgtgaagcccttccagggcgtgaagaacaatgatgtgattggaagaattgaaaatggagagcggctgcccatgccacccaactgcccccccaccctgtacagcctgatgaccaagtgctgggcctatgaccccagcagaagaccccgcttcacagagctgaaggcccagctgagcaccatcctggaggaggagaaggcccagcaggaggagaggatgaggatggagagccggcggcaggccaccgtgtcctgggacagcggcggcagtgatgaggccccacccaagcccagccggcccggctaccccagccccaggagcagcgagggcttctaccccagcccccagcacatggtgcagaccaaccactaccaggtgtctggctacccaggcagccacggcatcacagccatggccggcagcatctacccaggccaggccagcctgctggaccagacagacagctggaaccaccggccccaggagatcgccatgtggcagcccaacgtggaggacagcacagtgctggacctgcggggcatcggccaggtgctgcccacccacctgatggaggagcggctcatccggcagcagcaggagatggaggaggaccagcgctggctggagaaggaggagcgcttcctgaagccagatgtgcggctgagccggggcagcattgacagagaagatggcagcctgcagggccccatcggcaaccagcacatctaccagcctgtgggcaagccaggcaaggaggagaagaactgggccgagagaaatcctgctgccccacccaagaagccacccaggcctggggcccctggccacctgggcagcctggccagcctgagcagccctgctgacagctacaatgaaggagtgaagccctggaggctgcagccccaggagatcagccccccacccacagccaacctggacaggagcaatgacaaggtgtatgaaaatgtgacaggcctggtgaaggctgtgattgagatgagcagcaagatccagcctgcccctcctgaggagtatgtgcccatggtgaaggaggtgggcctggccctgcggaccctgctggccaccgtggatgagaccatccccctgctgcctgccagcacccaccgggagattgagatggcccagaagctgctgaacagcgacctgggggagctgatcaacaagatgaagctggcccagcagtatgtgatgaccagcctgcagcaggagtacaagaagcagatgctgacagctgcccacgccctggccgtggatgccaagaacctgctggatgtgattgaccaggcccggctgaagatgctgggccagacccggccccactag

SEQ ID NO: 21434 - DNA, 2904 bp, Artificial Sequence
  Description of Artificial Sequence: Synthetic coding sequence
atgtctggagtgtctgagcccctgagccgggtgaagctgggcaccctgcggcggcctgagggccctgctgagcccatggtggtggtgcctgtggatgtggagaaggaggatgtgcgcatcctgaaggtgtgcttctacagcaacagcttcaaccctgggaagaacttcaagctggtgaagtgcaccgtgcagacagagatccgggagatcatcaccagcatcctgctgagcggccgcatcggccccaacatccggctggccgagtgctacggcctgcggctgaagcacatgaagagtgatgagatccactggctgcacccccagatgacagtgggggaggtgcaggacaagtatgaatgtctgcacgtggaggccgagtggaggtatgacctgcagatccgctacctgcctgaggacttcatggagagcctgaaggaggacaggaccaccctgctgtacttctaccagcagctgagaaatgactacatgcagagatatgccagcaaggtgtctgagggcatggccctgcagctgggctgcctggagctgcggcgcttcttcaaggacatgccccacaatgccctggacaagaagagcaactttgagctgctggagaaggaggtgggcctggacctcttcttccccaagcagatgcaggagaacctgaagcccaagcagttcaggaagatgatccagcagaccttccagcagtatgccagcctgcgggaggaggagtgtgtgatgaagttcttcaacaccctggccggctttgccaacatcgaccaggagacctaccgctgtgagctgatccagggctggaacatcaccgtggacctggtgattggccccaagggcatccggcagctgaccagccaggatgccaagcccacctgcctggccgagttcaagcagatccgcagcatccgctgcctgcccctggaggagggccaggccgtgctgcagctgggcatcgagggcgccccccaggccctgagcatcaagaccagcagcctggccgaggccgagaacatggctgacctgattgatggctactgccgcctgcagggcgagcaccagggcagcctcatcatccaccccaggaaggatggagagaagaggaacagcctgccccagatccccatgctgaacctggaggcccggcgcagccacctgtctgagagctgcagcattgaaagtgacatctatgcagagatcccagatgagaccctgcggcggcctgggggcccccagtatggcatcgccagagaagatgtggtgctgaaccgcatcctgggggagggcttcttcggggaggtgtatgagggcgtgtacaccaaccacaagggggagaagatcaacgtggccgtgaagacctgcaagaaggactgcaccctggacaacaaggagaagttcatgtctgaggccgtcatcatgaagaacctggaccacccccacatcgtgaagctgattggcatcatcgaggaggagcccacctggatcatcatggagctgtacccctatggagagctgggccactacctggagaggaacaagaacagcctgaaggtgctgaccctggtgctgtacagcctgcagatctgcaaggccatggcctacctggagagcatcaactgtgtgcaccgggacattgctgtgaggaacatcctggtggccagcccagaatgtgtgaagctgggggactttggcctgagccgctacattgaagatgaggactactacaaggcctctgtgacccggctgcccatcaagtggatgagccctgagagcatcaacttccgccgcttcaccacagccagtgatgtgtggatgtttgctgtgtgcatgtgggagatcctgagctttgggaagcagcccttcttctggctggagaacaaggatgtgattggagtgctggagaagggggaccggctgcccaagccagacctgtgcccccctgtgctgtacaccctgatgacccgctgctgggactatgaccccagcgaccggccccgcttcacagagctggtgtgcagcctgagtgatgtgtaccagatggagaaggacatcgccatggagcaggagagaaatgcccgctaccgcacccccaagatcctggagcccacagccttccaggagcccccacccaagcccagccggcccaagtaccggcccccaccccagaccaacctgctggcccccaagctgcagttccaggaggaggacttcatccagcccagcagccgggaggaggcccagcagctgtgggaggccgagaaggtgaagatgaggcagatcctggacaagcagcagaagcagatggtggaggactaccagtggctgcggcaggaggagaagagcctggaccccatggtgtacatgaatgacaagagccccctgaccccagagaaggaggtgggctacctggagttcaccggccccccccagaagccaccccggctgggcgcccagagcatccagcccacagccaacctggacagaacagatgacctggtgtacctgaatgtgatggagctggtgcgggctgtgctggagctgaagaatgagctgtgccagctgcccccagagggctacgtggtggtggtgaagaatgtgggcctgaccctgaggaagctgattggctctgtggatgacctgctgcccagcctgcccagcagcagcaggacagaaattgagggcacccagaagctgctgaacaaggacctggccgagctgatcaacaagatgaggctggcccagcagaatgctgtgaccagcctgtctgaggagtgcaagaggcagatgctgacagccagccacaccctggccgtggatgccaagaacctgctggatgctgtggaccaggccaaggtgctggccaacctggcccaccccccagctgagtag

SEQ ID NO: 21435 - DNA, 3030 bp, Artificial Sequence
  Description of Artificial Sequence: Synthetic coding sequence
atgtctggagtgtctgagcccctgagccgggtgaagctgggcaccctgcggcggcctgagggccctgctgagcccatggtggtggtgcctgtggatgtggagaaggaggatgtgcgcatcctgaaggtgtgcttctacagcaacagcttcaaccctgggaagaacttcaagctggtgaagtgcaccgtgcagacagagatccgggagatcatcaccagcatcctgctgagcggccgcatcggccccaacatccggctggccgagtgctacggcctgcggctgaagcacatgaagagtgatgagatccactggctgcacccccagatgacagtgggggaggtgcaggacaagtatgaatgtctgcacgtggaggccgagtggaggtatgacctgcagatccgctacctgcctgaggacttcatggagagcctgaaggaggacaggaccaccctgctgtacttctaccagcagctgagaaatgactacatgcagagatatgccagcaaggtgtctgagggcatggccctgcagctgggctgcctggagctgcggcgcttcttcaaggacatgccccacaatgccctggacaagaagagcaactttgagctgctggagaaggaggtgggcctggacctcttcttccccaagcagatgcaggagaacctgaagcccaagcagttcaggaagatgatccagcagaccttccagcagtatgccagcctgcgggaggaggagtgtgtgatgaagttcttcaacaccctggccggctttgccaacatcgaccaggagacctaccgctgtgagctgatccagggctggaacatcaccgtggacctggtgattggccccaagggcatccggcagctgaccagccaggatgccaagcccacctgcctggccgagttcaagcagatccgcagcatccgctgcctgcccctggaggagggccaggccgtgctgcagctgggcatcgagggcgccccccaggccctgagcatcaagaccagcagcctggccgaggccgagaacatggctgacctgattgatggctactgccgcctgcagggcgagcaccagggcagcctcatcatccaccccaggaaggatggagagaagaggaacagcctgccccagatccccatgctgaacctggaggcccggcgcagccacctgtctgagagctgcagcattgaaagtgacatctatgcagagatcccagatgagaccctgcggcggcctgggggcccccagtatggcatcgccagagaagatgtggtgctgaaccgcatcctgggggagggcttcttcggggaggtgtatgagggcgtgtacaccaaccacaagggggagaagatcaacgtggccgtgaagacctgcaagaaggactgcaccctggacaacaaggagaagttcatgtctgaggccgtcatcatgaagaacctggaccacccccacatcgtgaagctgattggcatcatcgaggaggagcccacctggatcatcatggagctgtacccctatggagagctgggccactacctggagaggaacaagaacagcctgaaggtgctgaccctggtgctgtacagcctgcagatctgcaaggccatggcctacctggagagcatcaactgtgtgcaccgggacattgctgtgaggaacatcctggtggccagcccagaatgtgtgaagctgggggactttggcctgagccgctacattgaagatgaggactactacaaggcctctgtgacccggctgcccatcaagtggatgagccctgagagcatcaacttccgccgcttcaccacagccagtgatgtgtggatgtttgctgtgtgcatgtgggagatcctgagctttgggaagcagcccttcttctggctggagaacaaggatgtgattggagtgctggagaagggggaccggctgcccaagccagacctgtgcccccctgtgctgtacaccctgatgacccgctgctgggactatgaccccagcgaccggccccgcttcacagagctggtgtgcagcctgagtgatgtgtaccagatggagaaggacatcgccatggagcaggagagaaatgcccgctaccgcacccccaagatcctggagcccacagccttccaggagcccccacccaagcccagccggcccaagtaccggcccccaccccagaccaacctgctggcccccaagctgcagttccaggtgcctgagggcctgtgtgccagcagccccaccctgaccagccccatggagtaccccagccctgtgaacagcctgcacaccccacccctgcaccgccacaacgtgttcaagaggcacagcatgagggaggaggacttcatccagcccagcagccgggaggaggcccagcagctgtgggaggccgagaaggtgaagatgaggcagatcctggacaagcagcagaagcagatggtggaggactaccagtggctgcggcaggaggagaagagcctggaccccatggtgtacatgaatgacaagagccccctgaccccagagaaggaggtgggctacctggagttcaccggccccccccagaagccaccccggctgggcgcccagagcatccagcccacagccaacctggacagaacagatgacctggtgtacctgaatgtgatggagctggtgcgggctgtgctggagctgaagaatgagctgtgccagctgcccccagagggctacgtggtggtggtgaagaatgtgggcctgaccctgaggaagctgattggctctgtggatgacctgctgcccagcctgcccagcagcagcaggacagaaattgagggcacccagaagctgctgaacaaggacctggccgagctgatcaacaagatgaggctggcccagcagaatgctgtgaccagcctgtctgaggagtgcaagaggcagatgctgacagccagccacaccctggccgtggatgccaagaacctgctggatgctgtggaccaggccaaggtgctggccaacctggcccaccccccagctgagtag

SEQ ID NO: 21436 - DNA, 3030 bp, Artificial Sequence; identical to SEQ ID NO: 21435
  Description of Artificial Sequence: Synthetic coding sequence

SEQ ID NO: 21437 - DNA, 2904 bp, Artificial Sequence; identical to SEQ ID NO: 21434
  Description of Artificial Sequence: Synthetic coding sequence

SEQ ID NO: 21438 - DNA, 2904 bp, Artificial Sequence; identical to SEQ ID NO: 21434
  Description of Artificial Sequence: Synthetic coding sequence

SEQ ID NO: 21439 - DNA, 2409 bp, Artificial Sequence
  Description of Artificial Sequence: Synthetic coding sequence
ctgctgcctgagaggatgtctggagtgtctgagcccctgagccgggtgaagctgggcaccctgcggcggcctgagggccctgctgagcccatggtggtggtgcctgtggatgtggagaaggaggatgtgcgcatcctgaaggtgtgcttctacagcaacagcttcaaccctgggaagaacttcaagctggtgaagtgcaccgtgcagacagagatccgggagatcatcaccagcatcctgctgagcggcagaattggccccaacatccggctggctgaatgttatggcctgcggctgaagcacatgaagagtgatgagatccactggctgcacccccagatgacagtgggggaggtgcaggacaagtatgagtgcctgcacgtggaggccgagtggaggtatgacctgcagatccgctacctgcctgaggacttcatggagagcctgaaggaggacaggaccaccctgctgtacttctaccagcagctgagaaatgactacatgcagagatatgccagcaaggtgtctgagggcatggccctgcagctgggctgcctggagctgcggcgcttcttcaaggacatgccccacaatgccctggacaagaagagcaactttgagctgctggagaaggaggtgggcctggacctcttcttccccaagcagatgcaggagaacctgaagcccaagcagttcaggaagatgatccagcagaccttccagcagtatgccagcctgcgggaggaggagtgtgtgatgaagttcttcaacaccctggccggctttgccaacatcgaccaggagacctaccgctgtgagctgatccagggctggaacatcaccgtggacctggtgattggccccaagggcatccggcagctgaccagccaggatgccaagcccacctgcctggccgagttcaagcagatccgcagcatccgctgcctgcccctggaggagggccaggccgtgctgcagctgggcattgaaggagccccccaggccctgagcatcaagaccagcagcctggccgaggccgagaacatggctgacctgattgatggctactgccgcctgcagggcgagcaccagggcagcctcatcatccaccccaggaaggatggagagaagaggaacagcctgccccagatccccatgctgaacctggaggcccggcgcagccacctgtctgagagctgcagcattgaaagtgacatctatgcagagatcccagatgagaccctgcggcggcctgggggcccccagtatggaattgcccgggaggatgtggtgctgaaccgcatcctgggggagggcttctttggagaggtgtatgaaggagtgtacaccaaccacaagggggagaagatcaacgtggccgtgaagacctgcaagaaggactgcaccctggacaacaaggagaagttcatgtctgaggccgtcatcatgaagaacctggaccacccccacatcgtgaagctgattggcatcatcgaggaggagcccacctggatcatcatggagctgtacccctacggggagctgggccactacctggagaggaacaagaacagcctgaaggtgctgaccctggtgctgtacagcctgcagatctgcaaggccatggcctacctggagagcatcaactgtgtgcaccgggacattgctgtgaggaacatcctggtggccagcccagaatgtgtgaagctgggggactttggcctgagccgctacattgaagatgaggactactacaaggcctctgtgacccggctgcccatcaagtggatgagccctgagagcatcaacttccgccgcttcaccacagccagtgatgtgtggatgtttgctgtgtgcatgtgggagatcctgagctttgggaagcagcccttcttctggctggagaacaaggatgtgattggagtgctggagaagggggaccggctgcccaagccagacctgtgcccccctgtgctgtacaccctgatgacccgctgctgggactatgaccccagcgaccggccccgcttcacagagctggtgtgcagcctgagtgatgtgtaccagatggagaaggacatcgccatggagcaggagagaaatgcccgctaccgcacccccaagatcctggagcccacagccttccaggagcccccacccaagcccagccggcccaagtacagacctccaccccagaccaacctgctggcccccaagctgcagttccaggtgcctgagggcctgtgtgccagcagccccaccctgaccagccccatggagtaccccagccctgtgaacagcctgcacaccccacccctgcaccgccacaacgtgttcaagaggcacagcatgagggaggaggacttcatccagcccagcagccggggccctgctgctgtgggcggctag

SEQ ID NO: 21440 - DNA, 3030 bp, Artificial Sequence; identical to SEQ ID NO: 21435
  Description of Artificial Sequence: Synthetic coding sequence

SEQ ID NO: 21441 - DNA, 969 bp, Artificial Sequence
  Description of Artificial Sequence: Synthetic coding sequence
atggctgaccgggacagcggcagcgagcagggcggggccgccctgggcagcggcggcagcctgggccaccctggcagcggcagcggcagcggcggcggcggcggcggcggcggcggcggcggcggcagcggcggcggcggcggcggggcccctgggggcctgcagcacgagacccaggagctggccagcaagagggtggacatccagaacaagcgcttctacctggatgtgaagcagaatgccaagggccgcttcctgaagattgctgaggtgggcgccggcggcaacaagagccggctgaccctgtccatgtctgtggccgtggagttccgggactacctgggggacttcatcgagcactacgcccagctgggccccagccagcccccagacctggcccaggcccaggatgagccccggcgggccctgaagtctgagttcctggtgagagaaaataggaagtactacatggacctgaaggagaaccagaggggccgcttcctgcgcatccggcagacagtgaacagaggccctggcctgggcagcacccagggccagaccatcgccctgcctgcccagggcctcatcgagttcagagatgccctggccaagctgattgatgattatggagtggaggaggagcctgctgagctgcctgagggcaccagcctgactgtggacaacaagcgcttcttctttgatgtgggcagcaacaagtatggagtcttcatgagggtgtctgaggtgaagcccacctacagaaacagcatcaccgtgccctacaaggtgtgggccaagtttggccacaccttctgcaagtacagcgaggagatgaagaagatccaggagaagcagcgggagaagagagctgcctgtgagcagctgcaccagcagcagcagcagcagcaggaggagacagctgctgccaccctgctgctgcagggcgaggaggagggggaggaggactag

SEQ ID NO: 21442 - DNA, 588 bp, Artificial Sequence
  Description of Artificial Sequence: Synthetic coding sequence
atgggccgggccagagatgccatcctggatgccctggagaacctgacagctgaggagctgaagaagttcaagctgaagctgctgtctgtgcccctgcgggagggctacggccgcatccccaggggggccctgctgtccatggatgccctggacctgacagacaagctggtgtccttctacctggagacctacggggctgagctgacagccaacgtgctgcgggacatgggcctgcaggagatggccggccagctgcaggccgccacccaccagggcagcggggccgccccagctggcatccaggccccaccccagagcgctgccaagccaggcctgcacttcatcgaccagcaccgggccgccctgattgcccgggtgaccaacgtggagtggctgctggatgccctgtatggcaaggtgctgacagatgagcagtaccaggccgtgcgggcagagcccaccaaccccagcaagatgaggaagctgttctccttcaccccagcctggaactggacctgcaaggacctgctgctgcaggccctgcgggagagccagagctacctggtggaggacctggagaggagctag

SEQ ID NO: 21443 - DNA, 531 bp, Artificial Sequence
  Description of Artificial Sequence: Synthetic coding sequence
atgggccgggccagagatgccatcctggatgccctggagaacctgacagctgaggagctgaagaagttcaagctgaagctgctgtctgtgcccctgcgggagggctacggccgcatccccaggggggccctgctgtccatggatgccctggacctgacagacaagctggtgtccttctacctggagacctacggggctgagctgacagccaacgtgctgcgggacatgggcctgcaggagatggccggccagctgcaggccgccacccaccagggcctgcacttcatcgaccagcacagagctgccctgattgcccgggtgaccaacgtggagtggctgctggatgccctgtatggcaaggtgctgacagatgagcagtaccaggccgtgcgggcagagcccaccaaccccagcaagatgaggaagctgttctccttcaccccagcctggaactggacctgcaaggacctgctgctgcaggccctgcgggagagccagagctacctggtggaggacctggagaggagctag

SEQ ID NO: 21444 - DNA, 408 bp, Artificial Sequence
  Description of Artificial Sequence: Synthetic coding sequence
atgggccgggccagagatgccatcctggatgccctggagaacctgacagctgaggagctgaagaagttcaagctgcaggccgccacccaccagggcagcggggccgccccagctggcatccaggccccaccccagagcgctgccaagccaggcctgcacttcatcgaccagcaccgggccgccctgattgcccgggtgaccaacgtggagtggctgctggatgccctgtatggcaaggtgctgacagatgagcagtaccaggccgtgcgggcagagcccaccaaccccagcaagatgaggaagctgttctccttcaccccagcctggaactggacctgcaaggacctgctgctgcaggccctgcgggagagccagagctacctggtggaggacctggagaggagctag

SEQ ID NO: 21445 - DNA, 1311 bp, Artificial Sequence
  Description of Artificial Sequence: Synthetic coding sequence
atgaggctggcccggctgctgcggggggccgccctggccggccctggccctggcctgcgggccgccggcttcagccgctccttcagcagtgacagcggcagcagccctgccagcgagcggggcgtgcccggccaggtggacttctacgcccgcttcagccccagccccctgtccatgaagcagttcctggactttggatctgtgaatgcctgtgagaagaccagcttcatgttcctgcggcaggagctgcctgtgcggctggccaacatcatgaaggagatcagcctgctgcctgacaacctgctgcggacccccagcgtgcagctggtgcagagctggtacatccagagcctgcaggagctgctggacttcaaggacaagtctgcagaagatgccaaggccatctatgacttcacagacaccgtcatccgcatccggaacagacacaatgatgtgatccccaccatggcccagggcgtgattgagtacaaggagagctttggagtggaccctgtgaccagccagaatgtgcagtacttcctggaccgcttctacatgagccgcatcagcatccgcatgctgctgaaccagcacagcctgctgtttggaggcaagggcaagggcagccccagccacaggaagcacatcggcagcatcaaccccaactgcaatgtgctggaggtgatcaaggatggctatgaaaatgcccggcggctgtgtgacctgtactacatcaacagccctgagctggagctggaggagctgaatgccaagagccctggccagcccatccaggtggtgtatgtgcccagccacctgtaccacatggtgtttgagctgttcaagaatgccatgagggccaccatggagcaccacgccaacagaggagtgtacccacccatccaggtgcacgtgaccctgggcaatgaagacctgactgtgaagatgtctgaccggggcggcggcgtgcccctgaggaagattgacaggctcttcaactacatgtacagcacagccccccggccccgggtggagaccagcagagctgtgcccctggccggcttcggctacggcctgcccatcagccggctgtatgcccagtacttccagggcgacctgaagctgtacagcctggagggctatggaacagatgctgtgatctacatcaaggccctgagcacagacagcattgagcggctgcctgtgtacaacaaggccgcctggaagcactacaacaccaaccatgaagcagatgactggtgtgtgcccagccgggagcccaaggacatgaccaccttccgcagcgcctag

SEQ ID NO: 21446 - DNA, 1371 bp, Artificial Sequence
  Description of Artificial Sequence: Synthetic coding sequence
atgaggctggcccggctgctgcggggggccgccctggccggccctggccctggcctgcgggccgccggcttcagccgctccttcagcagtgacagcggcagcagccctgccagcgagcggggcgtgcccggccaggtggacttctacgcccgcttcagccccagccccctgtccatgaagcagttcctggactttggatctgtgaatgcctgtgagaagaccagcttcatgttcctgcggcaggagctgcctgtgcggctggccaacatcatgaaggagatcagcctgctgcctgacaacctgctgcggacccccagcgtgcagctggtgcagagctggtacatccagagcctgcaggagctgctggacttcaaggacaagtctgcagaagatgccaaggccatctatgaaagacccaggaggacctggctgcaggtgagcagcctgtgctgcatggcctgcaagatgatcttcacagacaccgtcatccgcatccggaacagacacaatgatgtgatccccaccatggcccagggcgtgattgagtacaaggagagctttggagtggaccctgtgaccagccagaatgtgcagtacttcctggaccgcttctacatgagccgcatcagcatccgcatgctgctgaaccagcacagcctgctgtttggaggcaagggcaagggcagccccagccacaggaagcacatcggcagcatcaaccccaactgcaatgtgctggaggtgatcaaggatggctatgaaaatgcccggcggctgtgtgacctgtactacatcaacagccctgagctggagctggaggagctgaatgccaagagccctggccagcccatccaggtggtgtatgtgcccagccacctgtaccacatggtgtttgagctgttcaagaatgccatgagggccaccatggagcaccacgccaacagaggagtgtacccacccatccaggtgcacgtgaccctgggcaatgaagacctgactgtgaagatgtctgaccggggcggcggcgtgcccctgaggaagattgacaggctcttcaactacatgtacagcacagccccccggccccgggtggagaccagcagagctgtgcccctggccggcttcggctacggcctgcccatcagccggctgtatgcccagtacttccagggcgacctgaagctgtacagcctggagggctatggaacagatgctgtgatctacatcaaggccctgagcacagacagcattgagcggctgcctgtgtacaacaaggccgcctggaagcactacaacaccaaccatgaagcagatgactggtgtgtgcccagccgggagcccaaggacatgaccaccttccgcagcgcctag

SEQ ID NO: 21447 - DNA, 1311 bp, Artificial Sequence; identical to SEQ ID NO: 21445
  Description of Artificial Sequence: Synthetic coding sequence

SEQ ID NO: 21448 - DNA, 1083 bp, Artificial Sequence
  Description of Artificial Sequence: Synthetic coding sequence
atgttcctgcggcaggagctgcctgtgcggctggccaacatcatgaaggagatcagcctgctgcctgacaacctgctgcggacccccagcgtgcagctggtgcagagctggtacatccagagcctgcaggagctgctggacttcaaggacaagtctgcagaagatgccaaggccatctatgacttcacagacaccgtcatccgcatccggaacagacacaatgatgtgatccccaccatggcccagggcgtgattgagtacaaggagagctttggagtggaccctgtgaccagccagaatgtgcagtacttcctggaccgcttctacatgagccgcatcagcatccgcatgctgctgaaccagcacagcctgctgtttggaggcaagggcaagggcagccccagccacaggaagcacatcggcagcatcaaccccaactgcaatgtgctggaggtgatcaaggatggctatgaaaatgcccggcggctgtgtgacctgtactacatcaacagccctgagctggagctggaggagctgaatgccaagagccctggccagcccatccaggtggtgtatgtgcccagccacctgtaccacatggtgtttgagctgttcaagaatgccatgagggccaccatggagcaccacgccaacagaggagtgtacccacccatccaggtgcacgtgaccctgggcaatgaagacctgactgtgaagatgtctgaccggggcggcggcgtgcccctgaggaagattgacaggctcttcaactacatgtacagcacagccccccggccccgggtggagaccagcagagctgtgcccctggccggcttcggctacggcctgcccatcagccggctgtatgcccagtacttccagggcgacctgaagctgtacagcctggagggctatggaacagatgctgtgatctacatcaaggccctgagcacagacagcattgagcggctgcctgtgtacaacaaggccgcctggaagcactacaacaccaaccatgaagcagatgactggtgtgtgcccagccgggagcccaaggacatgaccaccttccgcagcgcctag

SEQ ID NO: 21449 - DNA, 846 bp, Artificial Sequence
  Description of Artificial Sequence: Synthetic coding sequence
atggcccagggcgtcatcgagtacaaggagagctttggagtggaccctgtgaccagccagaatgtgcagtacttcctggaccgcttctacatgagccgcatcagcatccgcatgctgctgaaccagcacagcctgctgtttggaggcaagggcaagggcagccccagccacaggaagcacatcggcagcatcaaccccaactgcaatgtgctggaggtgatcaaggatggctatgaaaatgcccggcggctgtgtgacctgtactacatcaacagccctgagctggagctggaggagctgaatgccaagagccctggccagcccatccaggtggtgtatgtgcccagccacctgtaccacatggtgtttgagctgttcaagaatgccatgagggccaccatggagcaccacgccaacagaggagtgtacccacccatccaggtgcacgtgaccctgggcaatgaagacctgactgtgaagatgtctgacagaggaggaggagtgcccctgaggaagattgacaggctcttcaactacatgtacagcacagccccccggccccgggtggagaccagcagagctgtgcccctggccggcttcggctacggcctgcccatcagccggctgtatgcccagtacttccagggcgacctgaagctgtacagcctggagggctacggcacagatgctgtgatctacatcaaggccctgagcacagacagcattgaaaggctgcctgtgtacaacaaggccgcctggaagcactacaacaccaaccacgaggctgatgactggtgtgtgcccagccgggagcccaaggacatgaccaccttccgcagcgcctag

SEQ ID NO: 21450 - DNA, 1032 bp, Artificial Sequence
  Description of Artificial Sequence: Synthetic coding sequence
atgaaggagatcaacctgctgcctgacagagtgctgagcacccccagcgtgcagctggtgcagagctggtacgtgcagagcctgctggacatcatggagttcctggacaaggaccctgaggaccacaggaccctgagccagttcacagatgccctggtgaccatccggaacagacacaatgatgtggtgcccaccatggcccagggcgtgctggagtacaaggacacctatggagatgatcctgtgagcaaccagaacatccagtacttcctggaccgcttctacctgagccgcatcagcatccgcatgctgatcaaccagcacaccctcatctttgatggcagcaccaacccagcccaccccaagcacatcggcagcattgaccccaactgcaatgtgtctgaggtggtgaaggatgcctatgacatggccaagctgctgtgtgacaagtactacatggccagcccagacctggagatccaggagatcaatgctgccaacagcaagcagcccatccacatggtgtatgtgcccagccacctgtaccacatgctgtttgagctgttcaagaatgccatgagggccaccgtggagagccatgagagcagcctcatcctgccccccatcaaggtgatggtggccctgggggaggaggacctgagcatcaagatgtctgaccggggcggcggcgtgcccctgaggaagattgaaagactcttctcctacatgtacagcacagcccccaccccccagcccggcaccggcggcacccccctggccggcttcggctacggcctgcccatcagccggctgtatgccaagtacttccagggcgacctgcagctgttctccatggagggcttcggcacagatgctgtgatctacctgaaggccctgagcacagattctgtggagcggctgcctgtgtacaacaagagcgcctggaggcactaccagaccatccaggaggccggggactggtgtgtgcccagcacagagcccaagaacaccagcacctacagagtgtcctag

SEQ ID NO: 21451 - DNA, 1224 bp, Artificial Sequence
  Description of Artificial Sequence: Synthetic coding sequence
atgcgctgggtgtgggccctgctgaagaatgccagcctggccggggcccccaagtacatcgagcacttcagcaagttcagccccagccccctgtccatgaagcagttcctggactttggcagcagcaatgcctgtgagaagaccagcttcaccttcctgcggcaggagctgcctgtgcggctggccaacatcatgaaggagatcaacctgctgcctgacagagtgctgagcacccccagcgtgcagctggtgcagagctggtacgtgcagagcctgctggacatcatggagttcctggacaaggaccctgaggaccacaggaccctgagccagttcacagatgccctggtgaccatccggaacagacacaatgatgtggtgcccaccatggcccagggcgtgctggagtacaaggacacctatggagatgatcctgtgagcaaccagaacatccagtacttcctggaccgcttctacctgagccgcatcagcatccgcatgctgatcaaccagcacaccctcatctttgatggcagcaccaacccagcccaccccaagcacatcggcagcattgaccccaactgcaatgtgtctgaggtggtgaaggatgcctatgacatggccaagctgctgtgtgacaagtactacatggccagcccagacctggagatccaggagatcaatgctgccaacagcaagcagcccatccacatggtgtatgtgcccagccacctgtaccacatgctgtttgagctgttcaagaatgccatgagggccaccgtggagagccatgagagcagcctcatcctgccccccatcaaggtgatggtggccctgggggaggaggacctgagcatcaagatgtctgaccggggcggcggcgtgcccctgaggaagattgaaagactcttctcctacatgtacagcacagcccccaccccccagcccggcaccggcggcacccccctggccggcttcggctacggcctgcccatcagccggctgtatgccaagtacttccagggcgacctgcagctgttctccatggagggcttcggcacagatgctgtgatctacctgaaggccctgagcacagattctgtggagcggctgcctgtgtacaacaagagcgcctggaggcactaccagaccatccaggaggccggggactggtgtgtgcccagcacagagcccaagaacaccagcacctacagagtgtcctag

SEQ ID NO: 21452 - DNA, 849 bp, Artificial Sequence
  Description of Artificial Sequence: Synthetic coding sequence
atgcccctgctgacccagcagatccaggatgaagatgaccagtacagcctggtggccagcctggacaacgtgaggaacctgagcaccatcctgaaggccatccacttccgggagcacgccacctgctttgccaccaagaatggcatcaaggtgacagtggagaatgccaagtgtgtgcaggccaatgccttcatccaggccggcatcttccaggagttcaaggtgcaggaggagagcgtgaccttccgcatcaacctgactgtgctgctggactgcctgagcatcttcggcagcagccccatgcctggcaccctgacagccctgaggatgtgctaccagggctacggctaccccctgatgctgttcctggaggagggcggcgtggtgacagtgtgcaagatcaacacccaggagcctgaggagaccctggactttgacttctgcagcaccaacgtcatcaacaagatcatcctgcagagcgagggcctgcgggaggccttcagcgagctggacatgaccagcgaggtgctgcagatcaccatgagcccagacaagccctacttccggctgagcacctttggaaatgccggcagcagccacctggactaccccaaggacagcgacctgatggaggccttccactgcaaccagacccaggtgaaccgctacaagatcagcctgctgaagcccagcaccaaggccctggtgctgagctgcaaggtgtccatcagaacagacaacagaggcttcctgagcctgcagtacatgatcagaaatgaagatggccagatctgctttgtggagtactactgctgcccagatgaggaggtgcctgagagcgagagctag

SEQ ID NO: 21453 - DNA, 849 bp, Artificial Sequence; identical to SEQ ID NO: 21452
  Description of Artificial Sequence: Synthetic coding sequence

SEQ ID NO: 21454 - DNA, 741 bp, Artificial Sequence
  Description of Artificial Sequence: Synthetic coding sequence
atgcccctgctgacccagcagatccaggatgaagatgaccagtacagcctggtggccagcctggacaacgtgaggaacctgagcaccatcctgaaggccatccacttccgggagcacgccacctgctttgccaccaagaatggcatcaaggtgacagtggagaatgccaagtgtgtgcaggccaatgccttcatccagggcaccctgacagccctgaggatgtgctaccagggctacggctaccccctgatgctgttcctggaggagggcggcgtggtgacagtgtgcaagatcaacacccaggagcctgaggagaccctggactttgacttctgcagcaccaacgtcatcaacaagatcatcctgcagagcgagggcctgcgggaggccttcagcgagctggacatgaccagcgaggtgctgcagatcaccatgagcccagacaagccctacttccggctgagcacctttggaaatgccggcagcagccacctggactaccccaaggacagcgacctgatggaggccttccactgcaaccagacccaggtgaaccgctacaagatcagcctgctgaagcccagcaccaaggccctggtgctgagctgcaaggtgtccatcagaacagacaacagaggcttcctgagcctgcagtacatgatcagaaatgaagatggccagatctgctttgtggagtactactgctgcccagatgaggaggtgcctgagagcgagagctag

SEQ ID NO: 21455 - DNA, 1755 bp, Artificial Sequence
  Description of Artificial Sequence: Synthetic coding sequence
atgaaccagcacgagctggccgtgcacaagaagaagattgaggaggtggagacctggctgaaggcccaggtgctggagcggcagcccaagcagggcggcagcatcctgctgatcactggacctcctggctgtgggaagaccaccaccctgaagatcctgagcaaggagcacggcatccaggtgcaggagtggatcaaccctgtgctgcctgacttccagaaggatgacttcaagggcatgttcaacacagagagcagcttccacatgttcccctaccagagccagattgctgtgttcaaggagttcctgctgcgggccaccaagtacaacaagctgcagatgctgggagatgacctgaggacagacaagaagatcatcctggtggaggacctgcccaaccagttctacagagacagccacaccctgcacgaggtgctgaggaaatatgtgcgcatcggccgctgccccctcatcttcatcatcagtgacagcctgagcggggacaacaaccagaggctgctcttccccaaggagatccaggaggagtgcagcatcagcaacatctccttcaaccctgtggcccccaccatcatgatgaagttcctgaacagaattgtgaccatcgaggccaacaagaatggaggcaagatcaccgtgcctgacaagaccagcctggagctgctgtgccagggctgcagcggggacatccgcagcgccatcaacagcctgcagttcagcagcagcaaaggagagaacaacctgcggcccaggaagaagggcatgagcctgaagagtgatgctgtgctgagcaagagcaagaggaggaagaagccagacagagtgtttgagaaccaggaggtgcaggccatcggcggcaaggatgtgtccctcttcctgttccgggccctgggcaagatcctgtactgcaagagggccagcctgacagagctggacagcccccggctgcccagccacctgtctgaatatgagcgggacaccctgctggtggagcctgaggaggtggtggagatgagccacatgcctggggacctcttcaacctgtacctgcaccagaactacatcgacttcttcatggagattgatgacatcgtgcgggccagcgagttcctgagctttgctgacatcctgagcggggactggaacaccaggagcctgctgcgggagtacagcaccagcatcgccacccggggcgtgatgcacagcaacaaggcccggggctacgcccactgccagggcggcggcagcagcttccggcccctgcacaagccccagtggttcctgatcaacaagaagtaccgggagaactgcctggccgccaaggccctcttcccagacttctgcctgcctgccctgtgcctgcagacccagctgctgccctacctggccctgctgaccatccccatgaggaaccaggcccagatctccttcatccaggacatcggccgcctgcccctgaagaggcacttcggccgcctgaagatggaggccctgacagaccgggagcacggcatgattgatcctgacagcggagatgaggcccagctgaatggaggccacagcgctgaggagagcctgggggagcccacccaggccaccgtgcctgagacctggagcctgcccctgagccagaacagcgccagcgagctgcctgccagccagccccagcccttcagcgcccagggcgacatggaggagaacatcatcattgaagattatgaaagtgatggcacctag

SEQ ID NO: 21456 - DNA, 2013 bp, Artificial Sequence
  Description of Artificial Sequence: Synthetic coding sequence
atgaaccaggtgacagactgggtggaccccagctttgatgacttcctggagtgcagcggcgtgtccaccatcacagccaccagcctgggcgtgaacaacagcagccacaggaggaagaatggccccagcaccctggagagcagccgcttccctgccaggaagaggggcaacctgagcagcctggagcagatctacggcctggagaacagcaaggagtacctgtctgaaaatgagccctgggtggacaagtacaagccagagacccagcacgagctggccgtgcacaagaagaagattgaggaggtggagacctggctgaaggcccaggtgctggagcggcagcccaagcagggcggcagcatcctgctgatcactggacctcctggctgtgggaagaccaccaccctgaagatcctgagcaaggagcacggcatccaggtgcaggagtggatcaaccctgtgctgcctgacttccagaaggatgacttcaagggcatgttcaacacagagagcagcttccacatgttcccctaccagagccagattgctgtgttcaaggagttcctgctgcgggccaccaagtacaacaagctgcagatgctgggagatgacctgaggacagacaagaagatcatcctggtggaggacctgcccaaccagttctacagagacagccacaccctgcacgaggtgctgaggaaatatgtgcgcatcggccgctgccccctcatcttcatcatcagtgacagcctgagcggggacaacaaccagaggctgctcttccccaaggagatccaggaggagtgcagcatcagcaacatctccttcaaccctgtggcccccaccatcatgatgaagttcctgaacagaattgtgaccatcgaggccaacaagaatggaggcaagatcaccgtgcctgacaagaccagcctggagctgctgtgccagggctgcagcggggacatccgcagcgccatcaacagcctgcagttcagcagcagcaaaggagagaacaacctgcggcccaggaagaagggcatgagcctgaagagtgatgctgtgctgagcaagagcaagaggaggaagaagccagacagagtgtttgagaaccaggaggtgcaggccatcggcggcaaggatgtgtccctcttcctgttccgggccctgggcaagatcctgtactgcaagagggccagcctgacagagctggacagcccccggctgcccagccacctgtctgaatatgagcgggacaccctgctggtggagcctgaggaggtggtggagatgagccacatgcctggggacctcttcaacctgtacctgcaccagaactacatcgacttcttcatggagattgatgacatcgtgcgggccagcgagttcctgagctttgctgacatcctgagcggggactggaacaccaggagcctgctgcgggagtacagcaccagcatcgccacccggggcgtgatgcacagcaacaaggcccggggctacgcccactgccagggcggcggcagcagcttccggcccctgcacaagccccagtggttcctgatcaacaagaagtaccgggagaactgcctggccgccaaggccctcttcccagacttctgcctgcctgccctgtgcctgcagacccagctgctgccctacctggccctgctgaccatccccatgaggaaccaggcccagatctccttcatccaggacatcggccgcctgcccctgaagaggcacttcggccgcctgaagatggaggccctgacagaccgggagcacggcatgattgatcctgacagcggagatgaggcccagctgaatggaggccacagcgctgaggagagcctgggggagcccacccaggccaccgtgcctgagacctggagcctgcccctgagccagaacagcgccagcgagctgcctgccagccagccccagcccttcagcgcccagggcgacatggaggagaacatcatcattgaagattatgaaagtgatggcacctag

SEQ ID NO: 21457 - DNA, 2013 bp, Artificial Sequence; identical to SEQ ID NO: 21456
  Description of Artificial Sequence: Synthetic coding sequence

SEQ ID NO: 21458 - DNA, 2013 bp, Artificial Sequence; identical to SEQ ID NO: 21456
  Description of Artificial Sequence: Synthetic coding sequence

SEQ ID NO: 21459 - DNA, 2013 bp, Artificial Sequence; identical to SEQ ID NO: 21456
  Description of Artificial Sequence: Synthetic coding sequence

SEQ ID NO: 21460 - DNA, 1518 bp, Artificial Sequence
  Description of Artificial Sequence: Synthetic coding sequence
atgttcaacacagagagcagcttccacatgttcccctaccagagccagattgctgtgttcaaggagttcctgctgcgggccaccaagtacaacaagctgcagatgctgggagatgacctgaggacagacaagaagatcatcctggtggaggacctgcccaaccagttctacagagacagccacaccctgcacgaggtgctgaggaaatatgtgagaattggccgctgccccctcatcttcatcatcagtgacagcctgagcggggacaacaaccagaggctgctcttccccaaggagatccaggaggagtgcagcatcagcaacatctccttcaaccctgtggcccccaccatcatgatgaagttcctgaaccgcatcgtgaccatcgaggccaacaagaatggaggcaagatcaccgtgcctgacaagaccagcctggagctgctgtgccagggctgcagcggggacatccgcagcgccatcaacagcctgcagttcagcagcagcaagggggagaacaacctgcggcccaggaagaagggcatgagcctgaagagtgatgctgtgctgagcaagagcaagaggaggaagaagccagacagagtgtttgagaaccaggaggtgcaggccatcggcggcaaggatgtgtccctcttcctgttccgggccctgggcaagatcctgtactgcaagagggccagcctgacagagctggacagcccccggctgcccagccacctgtctgaatatgaaagagacaccctgctggtggagcctgaggaggtggtggagatgagccacatgcctggggacctcttcaacctgtacctgcaccagaactacatcgacttcttcatggagattgatgacatcgtgcgggccagcgagttcctgagctttgctgacatcctgagcggggactggaacaccaggagcctgctgcgggagtacagcaccagcatcgccacccggggcgtgatgcacagcaacaaggcccggggctacgcccactgccagggcggcggcagcagcttccggcccctgcacaagccccagtggttcctgatcaacaagaagtaccgggagaactgcctggccgccaaggccctcttcccagacttctgcctgcctgccctgtgcctgcagacccagctgctgccctacctggccctgctgaccatccccatgaggaaccaggcccagatctccttcatccaggacatcggccgcctgcccctgaagaggcacttcggccgcctgaagatggaggccctgacagaccgggagcacggcatgattgatcctgattctggagatgaggcccagctgaatggaggccacagcgctgaggagagcctgggggagcccacccaggccaccgtgcctgagacctggagcctgcccctgagccagaacagcgccagcgagctgcctgccagccagccccagcccttcagcgcccagggcgacatggaggagaacatcatcatcgaggactatgaaagtgatggcacctag

SEQ ID NO: 21461 - DNA, 2013 bp, Artificial Sequence; identical to SEQ ID NO: 21456
  Description of Artificial Sequence: Synthetic coding sequence

SEQ ID NO: 21462 - DNA, 2046 bp, Artificial Sequence
  Description of Artificial Sequence: Synthetic coding sequence
atgagcaagaccttcctgcggcccaaggtgagcagcaccaaggtgacagactgggtggaccccagctttgatgacttcctggagtgcagcggcgtgtccaccatcacagccaccagcctgggcgtgaacaacagcagccacaggaggaagaatggccccagcaccctggagagcagccgcttccctgccaggaagaggggcaacctgagcagcctggagcagatctacggcctggagaacagcaaggagtacctgtctgaaaatgagccctgggtggacaagtacaagccagagacccagcacgagctggccgtgcacaagaagaagattgaggaggtggagacctggctgaaggcccaggtgctggagcggcagcccaagcagggcggcagcatcctgctgatcaccggccccccaggctgcggcaagaccaccaccctgaagatcctgagcaaggagcacggcatccaggtgcaggagtggatcaaccctgtgctgcctgacttccagaaggatgacttcaagggcatgttcaacacagagagcagcttccacatgttcccctaccagagccagattgctgtgttcaaggagttcctgctgcgggccaccaagtacaacaagctgcagatgctgggagatgacctgaggacagacaagaagatcatcctggtggaggacctgcccaaccagttctacagagacagccacaccctgcacgaggtgctgaggaaatatgtgagaattggccgctgccccctcatcttcatcatcagtgacagcctgagcggggacaacaaccagaggctgctcttccccaaggagatccaggaggagtgcagcatcagcaacatctccttcaaccctgtggcccccaccatcatgatgaagttcctgaaccgcatcgtgaccatcgaggccaacaagaatggaggcaagatcaccgtgcctgacaagaccagcctggagctgctgtgccagggctgcagcggggacatccgcagcgccatcaacagcctgcagttcagcagcagcaagggggagaacaacctgcggcccaggaagaagggcatgagcctgaagagtgatgctgtgctgagcaagagcaagaggaggaagaagccagacagagtgtttgagaaccaggaggtgcaggccatcggcggcaaggatgtgtccctcttcctgttccgggccctgggcaagatcctgtactgcaagagggccagcctgacagagctggacagcccccggctgcccagccacctgtctgaatatgaaagagacaccctgctggtggagcctgaggaggtggtggagatgagccacatgcctggggacctcttcaacctgtacctgcaccagaactacatcgacttcttcatggagattgatgacatcgtgcgggccagcgagttcctgagctttgctgacatcctgagcggggactggaacaccaggagcctgctgcgggagtacagcaccagcatcgccacccggggcgtgatgcacagcaacaaggcccggggctacgcccactgccagggcggcggcagcagcttccggcccctgcacaagccccagtggttcctgatcaacaagaagtaccgggagaactgcctggccgccaaggccctcttcccagacttctgcctgcctgccctgtgcctgcagacccagctgctgccctacctggccctgctgaccatccccatgaggaaccaggcccagatctccttcatccaggacatcggccgcctgcccctgaagaggcacttcggccgcctgaagatggaggccctgacagaccgggagcacggcatgattgatcctgattctggagatgaggcccagctgaatggaggccacagcgctgaggagagcctgggggagcccacccaggccaccgtgcctgagacctggagcctgcccctgagccagaacagcgccagcgagctgcctgccagccagccccagcccttcagcgcccagggcgacatggaggagaacatcatcatcgaggactatgaaagtgatggcacctag

SEQ ID NO: 21463 - DNA, 510 bp, Artificial Sequence
  Description of Artificial Sequence: Synthetic coding sequence
atgaaccaggtgacagactgggtggaccccagctttgatgacttcctggagtgcagcggcgtgtccaccatcacagccaccagcctgggcgtgaacaacagcagccacaggaggaagaatggccccagcaccctggagagcagccgcttccctgccaggaagaggggcaacctgagcagcctggagcagatctacggcctggagaacagcaaggagtacctgtctgaaaatgagccctgggtggacaagtacaagccagagacccagcacgagctggccgtgcacaagaagaagattgaggaggtggagacctggctgaaggcccaggtgctggagcggcagcccaagcagggcggcagcatcctgctgatcactggacctcctggctgtgggaagaccaccaccctgaagatcctgagcaaggagcacggcatccaggtgcaggagtggatcaaccctgtgctgcctgacttccagaaggatgacttcaagggcatgttcaacacctag

SEQ ID NO: 21464 - DNA, 66 bp, Artificial Sequence
  Description of Artificial Sequence: Synthetic coding sequence
atgaaccaggtgacagactgggtggaccccagctttgatgacttcctggagtgcagcggcgtgtag

SEQ ID NO: 21465 - DNA, 2046 bp, Artificial Sequence; identical to SEQ ID NO: 21462
  Description of Artificial Sequence: Synthetic coding sequence

SEQ ID NO: 21466 - DNA, 1518 bp, Artificial Sequence; identical to SEQ ID NO: 21460
  Description of Artificial Sequence: Synthetic coding sequence

SEQ ID NO: 21467 - DNA, 1488 bp, Artificial Sequence
  Description of Artificial Sequence: Synthetic coding sequence
atggacagcctggccgagagccgctggcccccaggcctggccgtgatgaagaccattgatgacctgctgcgctgtggcatctgctttgagtacttcaacatcgccatgatcatcccccagtgcagccacaactactgcagcctgtgcatcaggaagttcctgagctacaagacccagtgccccacctgctgcgtgacagtgacagagccagacctgaagaacaaccgcatcctggatgagctggtgaagagcctgaactttgccaggaaccacctgctgcagtttgccctggagagccctgccaagagccctgccagcagcagcagcaagaacctggccgtgaaggtgtacacccctgtggccagccggcagagcctgaagcagggcagccggctgatggacaacttcctgatccgggagatgagcggcagcaccagcgagctgctgatcaaggagaacaagagcaagttcagcccccagaaggaggccagccctgctgccaagaccaaggagaccaggtctgtggaggagatcgccccagaccccagcgaggccaagaggcctgagccccccagcaccagcaccctgaagcaggtgaccaaggtggactgccctgtgtgtggggtgaacatccctgagagccacatcaacaagcacctggacagctgcctgagccgggaggagaagaaggagagcctgcggagctctgtgcacaagaggaagcccctgcccaagacagtgtacaacctgctgagtgaccgggacctgaagaagaagctgaaggagcacggcctgagcatccagggcaacaagcagcagctgatcaagaggcaccaggagtttgtgcacatgtacaatgcccagtgtgatgccctgcaccccaagtctgctgctgagatcgtgcgggagattgaaaatattgagaagaccaggatgaggctggaggccagcaagctgaatgaatctgtgatggtgttcaccaaggaccagacagagaaggagattgatgagatccacagcaagtacaggaagaagcacaagtctgagttccagctgctggtggaccaggccaggaagggctacaagaagattgctggcatgagccagaagacagtgaccatcaccaaggaggatgagagcacagagaagctgagctctgtgtgcatgggccaggaggacaacatgacctctgtgaccaaccacttcagccagagcaagctggacagccctgaggagctggagccagaccgggaggaggacagcagcagctgcatcgacatccaggaggtgctgagcagcagcgagagtgacagctgcaacagcagcagcagtgacatcatccgggacctgctggaggaggaggaggcctgggaggccagccacaagaatgacctgcaggacacagagatcagcccccggcagaacagaaggaccagggctgctgagagcgctgagattgagcccaggaacaagaggaacagaaattag

SEQ ID NO: 21468 - DNA, 279 bp, Artificial Sequence
  Description of Artificial Sequence: Synthetic coding sequence
atggacagcctggccgagagccgctggcccccaggcctggccgtgatgaagaccattgatgacctgctgcgctgtggcatctgctttgagtacttcaacatcgccatgatcatcccccagtgcagccacaactactgcagcctgtgcatcaggaagttcctgagctacaagacccagtgccccacctgctgcgtgacagtgacagagccagacctgaagaacaaccgcatcctggatgagctggtgaagagcctgaactttgccaggaaccacctgtag

SEQ ID NO: 21469 - DNA, 1092 bp, Artificial Sequence
  Description of Artificial Sequence: Synthetic coding sequence
atggctgtgaccatcaccctgaagaccctgcagcagcagaccttcaagatccgcatggagccagatgagaccgtgaaggtgctgaaggagaagattgaggccgagaagggcagagatgccttccctgtggccggccagaagctgatctatgccggcaagatcctgagtgatgatgtgcccatccgggactacagaattgatgagaagaactttgtggtggtgatggtgaccaagaccaaggccggccagggcaccagcgcccctcctgaggccagccccacagctgcccctgagagcagcaccagcttccccccagcccccaccagcggcatgagccaccccccacctgctgcccgggaggacaagagccccagcgaggagagcgcccccaccaccagccctgagagcgtgtctggctctgtgcccagcagcggcagcagcggccgggaggaggatgctgccagcaccctggtgactggaagtgaatatgagaccatgctgacagagatcatgtccatgggctatgagcgggagcgggtggtggccgccctgcgggccagctacaacaacccccacagagctgtggagtacctgctgaccggcatccctggcagccctgagcctgagcacggctctgtgcaggagagccaggtgtctgagcagcctgccacagaggccgccggggagaaccccctggagttcctgcgggaccagccccagttccagaacatgaggcaggtgatccagcagaacccagccctgctgcctgccctgctgcagcagctgggccaggagaacccccagctgctgcagcagatcagccgccaccaggagcagttcatccagatgctgaatgaacctcctggagagctggccgacatcagtgatgtggagggggaggtgggcgccatcggggaggaggccccccagatgaactacatccaggtgaccccccaggagaaggaggccatcgagcggctgaaggccctgggcttccctgagagcctggtgatccaggcctactttgcctgtgagaagaatgaaaacctggccgccaacttcctgctgagccagaactttgatgatgaatag

SEQ ID NO: 21470 - DNA, 597 bp, Artificial Sequence
  Description of Artificial Sequence: Synthetic coding sequence
atgctgacagagatcatgtccatgggctatgaaagagagcgggtggtggccgccctgcgggccagctacaacaacccccacagagctgtggagtacctgctgaccggcatccctggcagccctgagcctgagcacggctctgtgcaggagagccaggtgtctgagcagcctgccacagaagctgctggggagaaccccctggagttcctgcgggaccagccccagttccagaacatgaggcaggtgatccagcagaacccagccctgctgcctgccctgctgcagcagctgggccaggagaacccccagctgctgcagcagatcagccgccaccaggagcagttcatccagatgctgaatgagcccccaggagagctggccgacatcagtgatgtggagggggaggtgggcgccatcggggaggaggccccccagatgaactacatccaggtgaccccccaggagaaggaggccatcgagcggctgaaggccctgggcttccctgagagcctggtgatccaggcctactttgcctgtgagaagaatgaaaacctggccgccaacttcctgctgagccagaactttgatgatgaatag

SEQ ID NO: 21471 - DNA, 1092 bp, Artificial Sequence; identical to SEQ ID NO: 21469
  Description of Artificial Sequence: Synthetic coding sequence

SEQ ID NO: 21472 - DNA, 927 bp, Artificial Sequence
  Description of Artificial Sequence: Synthetic coding sequence
atggctgtgaccatcaccctgaagaccctgcagcagcagaccttcaagatccgcatggagccagatgagaccgtgaaggtgctgaaggagaagattgaggccgagaagggcagagatgccttccctgtggccggccagaagctgatctatgccggcaagatcctgagtgatgatgtgcccatccgggactacagaattgatgagaagaactttgtggtggtgatggtgaccaagaccaaggccggccagggcaccagcgcccctcctgaggccagccccacagctgcccctgagagcagcaccagcttccccccagcccccaccagcggcatgagccaccccccacctgctgcccgggaggacaagagccccagcgaggagagcgcccccaccaccagccctgagagcgtgtctggctctgtgcccagcagcggcagcagcggccgggaggaggatgctgccagcaccctggtgactggaagtgaatatgagaccatgctgacagagatcatgtccatgggctatgagcgggagcgggtggtggccgccctgcgggccagctacaacaacccccacagagctgtggagtacctgctgaccggcatccctggcagccctgagcctgagcacggctctgtgcaggagagccaggtgtctgagcagcctgccacagaggccgccggggagaaccccctggagttcctgcgggaccagccccagttccagaacatgaggcaggtgatccagcagaacccagccctgctgcctgccctgctgcagcagctgggccaggagaacccccagctgctgcagctgaaggccctgggcttccctgagagcctggtgatccaggcctactttgcctgtgagaagaatgaaaacctggccgccaacttcctgctgagccagaactttgatgatgaatag

SEQ ID NO: 21473 - DNA, 1230 bp, Artificial Sequence
  Description of Artificial Sequence: Synthetic coding sequence
atgcaggtgaccctgaagaccctgcagcagcagaccttcaagattgatattgatcctgaggagaccgtgaaggccctgaaggagaagattgagagcgagaagggcaaggatgccttccctgtggccggccagaagctgatctatgccggcaagatcctgaatgatgacacagccctgaaggagtacaagattgatgagaagaactttgtggtggtgatggtgaccaagcccaaggctgtgtccaccccagccccagccaccacccagcagagcgccccagccagcaccacagctgtgaccagcagcaccaccaccaccgtggcccaggcccccacccctgtgcctgccctggcccccaccagcaccccagccagcatcaccccagccagcgccacagccagcagcgagcccgccccagccagcgctgccaagcaggagaagccagctgagaagccagctgagacccctgtggccaccagccccacagccacagacagcaccagcggggacagcagccgcagcaacctgtttgaagatgccaccagcgccctggtgacaggccagagctatgagaacatggtgacagagatcatgtccatgggctatgaaagagagcaggtgattgctgccctgcgggccagcttcaacaacccagacagagctgtggagtacctgctgatgggcatccctggggaccgggagagccaggccgtggtggaccccccccaggccgccagcactggagccccccagagcagcgctgtggccgctgctgctgccaccaccacagccaccaccaccaccaccagcagcggcggccaccccctggagttcctgaggaaccagccccagttccagcagatgaggcagatcatccagcagaaccccagcctgctgcctgccctgctgcagcagatcggccgggagaacccccagctgctgcagcagatcagccagcaccaggagcacttcatccagatgctgaatgaacctgtgcaggaggccggcggccagggcggcggcggcggcggcggcagcggcggcattgctgaggccggcagcggccacatgaactacatccaggtgaccccccaggagaaggaggccatcgagcggctgaaggccctgggcttccctgagggcctggtgatccaggcctactttgcctgtgagaagaatgaaaacctggccgccaacttcctgctgcagcagaactttgatgaggactag

SEQ ID NO: 21474 - DNA, 519 bp, Artificial Sequence
  Description of Artificial Sequence: Synthetic coding sequence
atggtgaccaagcccaaggctgtgtccaccccagccccagccaccacccagcagagcgccccagccagcaccacagctgtgaccagcagcaccaccaccaccgtggcccaggcccccacccctgtgcctgccctggcccccaccagcaccccagccagcatcaccccagccagcgccacagccagcagcgagcccgccccagccagcgctgccaagcaggagaagccagctgagaagccagctgagacccctgtggccaccagccccacagccacagacagcaccagcggggacagcagccgcagcaacctgtttgaagatgccaccagcgccctggtgacaggccagagctatgagaacatggtgacagagatcatgtccatgggctatgaaagagagcaggtgattgctgccctgcgggccagcttcaacaacccagacagagctgtggagtacctgctgatgatcatcgtgaagacaggcaacaagaagaagaagcagcccctgctgggcaagtag

SEQ ID NO: 21475 - DNA, 1014 bp, Artificial Sequence
  Description of Artificial Sequence: Synthetic coding sequence
atggtgaccaagcccaaggctgtgtccaccccagccccagccaccacccagcagagcgccccagccagcaccacagctgtgaccagcagcaccaccaccaccgtggcccaggcccccacccctgtgcctgccctggcccccaccagcaccccagccagcatcaccccagccagcgccacagccagcagcgagcccgccccagccagcgctgccaagcaggagaagccagctgagaagccagctgagacccctgtggccaccagccccacagccacagacagcaccagcggggacagcagccgcagcaacctgtttgaagatgccaccagcgccctggtgacaggccagagctatgagaacatggtgacagagatcatgtccatgggctatgaaagagagcaggtgattgctgccctgcgggccagcttcaacaacccagacagagctgtggagtacctgctgatgggcatccctggggaccgggagagccaggccgtggtggaccccccccaggccgccagcactggagccccccagagcagcgctgtggccgctgctgctgccaccaccacagccaccaccaccaccaccagcagcggcggccaccccctggagttcctgaggaaccagccccagttccagcagatgaggcagatcatccagcagaaccccagcctgctgcctgccctgctgcagcagatcggccgggagaacccccagctgctgcagcagatcagccagcaccaggagcacttcatccagatgctgaatgaacctgtgcaggaggccggcggccagggcggcggcggcggcggcggcagcggcggcattgctgaggccggcagcggccacatgaactacatccaggtgaccccccaggagaaggaggccatcgagcggctgaaggccctgggcttccctgagggcctggtgatccaggcctactttgcctgtgagaagaatgaaaacctggccgccaacttcctgctgcagcagaactttgatgaggactag

SEQ ID NO: 21476 - DNA, 441 bp, Artificial Sequence
  Description of Artificial Sequence: Synthetic coding sequence
atgcaggtgaccctgaagaccctgcagcagcagaccttcaagattgatattgatcctgaggagaccgtgaaggccctgaaggagaagattgagagcgagaagggcaaggatgccttccctgtggccggccagaagctgatctatgccggcaagatcctgaatgatgacacagccctgaaggagtacaagattgatgagaagaactttgtggtggtgatggtgaccaagcccaaggctgtgtccaccccagccccagccaccacccagcagagcgccccagccagcaccacagctgtgaccagcagcaccaccaccaccgtggcccaggcccccacccctgtgcctgccctggcccccaccagcaccccagccagcatcaccccagccagcgccacagccagcagcgagcccgccccagccagcgctgccaagcaggagtag

SEQ ID NO: 21477 - DNA, 243 bp, Artificial Sequence
  Description of Artificial Sequence: Synthetic coding sequence
atggtgaaggccctgaaggagaagattgaaagtgagaagggcaaggatgccttccctgtggccggccagaagctgatctatgctgggaagatcctgaatgatgacacagccctgaaggagtacaagattgatgagaagaactttgtggtggtgatggtgaccaagcccaaggctgtgtccaccccagccccagccaccacccagcagagcgccccagccagcaccacagctgtgaccagctag

SEQ ID NO: 21478 - DNA, 345 bp, Artificial Sequence
  Description of Artificial Sequence: Synthetic coding sequence
tgaacagccagcagcgagcccgccccagccagcgctgccaagcaggagaagccagctgagaagccagctgagacccctgtggccaccagccccacagccacagacagcaccagcggggacagcagccgcagcaacctgtttgaagatgccaccagcgccctggtgacaggccagagctatgagaacatggtgacagagatcatgtccatgggctatgaaagagagcaggtgattgctgccctgcgggccagcttcaacaacccagacagagctgtggagtacctgctgatgatcatcgtgaagacaggcaacaagaagaagaagcagcccctgctgggcaagtag

SEQ ID NO: 21479 - DNA, 3939 bp, Artificial Sequence
  Description of Artificial Sequence: Synthetic coding sequence
atgagccgcatcgagaagatgagcatcctgggcgtgcgcagctttggaattgaggacaaggacaagcagatcatcaccttcttcagccccctgaccatcctggtgggccccaacggggccggcaagaccaccatcattgaatgtctgaagtacatctgcaccggggacttccccccaggcaccaagggcaacacctttgtgcatgaccccaaggtggcccaggagacagatgtgcgggcccagatccggctgcagttcagagatgtgaatggagagctgattgctgtgcagaggtccatggtgtgcacccagaagagcaagaagacagagttcaagaccctggagggcgtcatcaccaggaccaagcatggagagaaggtgtccctgagcagcaaatgtgccgagattgaccgggagatgatcagcagcctgggcgtgtccaaggctgtgctgaacaacgtcatcttctgccaccaggaggacagcaactggcccctgtctgagggcaaggccctgaagcagaagtttgatgagatcttcagcgccacccgctacatcaaggccctggagaccctgcggcaggtgcggcagacccagggccagaaggtgaaggagtaccagatggagctgaagtacctgaagcagtacaaggagaaggcctgtgagatccgggaccagatcaccagcaaggaggcccagctgaccagcagcaaggagatcgtgaagagctatgaaaatgagctggaccccctgaagaaccggctgaaggagattgagcacaacctgagcaagatcatgaagctggacaatgagatcaaggccctggacagcaggaagaagcagatggagaaggacaacagcgagctggaggagaagatggagaaggtgttccagggcacagatgagcagctgaatgacctgtaccacaaccaccagaggacagtgcgggagaaggagaggaagctggtggactgccaccgggagctggagaagctgaacaaggagagccggctgctgaaccaggagaagtctgagctgctggtggagcagggccgcctgcagctgcaggccgacagacaccaggagcacatccgggcccgggacagcctcatccagagcctggccacccagctggagctggatggctttgagcggggccccttcagcgagcggcagatcaagaacttccacaagctggtgcgggagcggcaggagggggaggccaagacagccaaccagctgatgaatgactttgctgagaaggagaccctgaagcagaagcagattgatgagatccgggacaagaagacaggcctgggccgcatcatcgagctgaagtctgagatcctgagcaagaagcagaatgagctgaagaatgtgaagtatgagctgcagcagctggagggcagcagtgaccgcatcctggagctggaccaggagctgatcaaggccgagcgggagctgagcaaggccgagaagaacagcaatgtggagaccctgaagatggaggtgatcagcctgcagaatgagaaggctgacctggacaggaccctgaggaagctggaccaggagatggagcagctgaaccaccacaccaccaccaggacccagatggagatgctgaccaaggacaaggctgacaaggatgagcagatcaggaagatcaagagccgccacagtgatgagctgaccagcctgctgggctacttccccaacaagaagcagctggaggactggctgcacagcaagagcaaggagatcaaccagacccgggaccggctggccaagctgaacaaggagctggccagcagcgagcagaacaagaaccacatcaacaatgagctgaagaggaaggaggagcagctgagcagctatgaggacaagctgtttgatgtgtgtggcagccaggactttgaaagtgacctggaccggctgaaggaggagattgagaagagcagcaagcagagggccatgctggccggggccacagctgtgtacagccagttcatcacccagctgacagatgagaaccagagctgctgccctgtgtgccagagggtcttccagacagaggccgagctgcaggaggtgatcagtgacctgcagagcaagctgcggctggccccagacaagctgaagagcacagaaagtgagctgaagaagaaggagaagagaagagatgagatgctgggcctggtgcccatgaggcagagcatcatcgacctgaaggagaaggagatccctgagctgaggaacaagctgcagaatgtgaacagagacatccagaggctgaagaatgacatcgaggagcaggagaccctgctgggcaccatcatgcctgaggaggagagcgccaaggtgtgcctgacagatgtgaccatcatggagcgcttccagatggagctgaaggatgtggagaggaagatcgcccagcaggccgccaagctgcagggcatcgacctggacagaacagtgcagcaggtgaaccaggagaagcaggagaagcagcacaagctggacacagtgagcagcaagattgagctgaacaggaagctgatccaggaccagcaggagcagatccagcacctgaagagcaccaccaatgagctgaagtctgagaagctgcagatcagcaccaacctgcagaggcggcagcagctggaggagcagacagtggagctgagcacagaggtgcagagcctgtaccgggagatcaaggatgccaaggagcaggtgagccccctggagaccaccctggagaagttccagcaggagaaggaggagctgatcaacaagaagaacaccagcaacaagatcgcccaggacaagctgaatgacatcaaggagaaggtgaagaacatccacggctacatgaaggacatcgagaactacatccaggacggcaaggatgactacaagaagcagaaggagacagagctgaacaaggtgattgcccagctgtctgaatgtgagaagcacaaggagaagatcaatgaagacatgaggctgatgaggcaggacatcgacacccagaagatccaggagcgctggctgcaggacaacctgaccctgaggaagagaaatgaggagctgaaggaggtggaggaggagaggaagcagcacctgaaggagatgggccagatgcaggtgctgcagatgaagtctgagcaccagaagctggaggagaacatcgacaacatcaagaggaaccacaacctggccctgggccggcagaagggctatgaggaggagatcatccacttcaagaaggagctgcgggagccccagttcagagatgctgaggagaagtaccgggagatgatgattgtgatgaggaccacagagctggtgaacaaggacctggacatctactacaagaccctggaccaggccatcatgaagttccacagcatgaagatggaggagatcaacaagatcatccgggacctgtggaggagcacctaccggggccaggacatcgagtacatcgagatccgcagtgatgctgatgaaaatgtgtctgccagtgacaagagaagaaactacaactacagagtggtgatgctgaagggggacacagccctggacatgaggggccgctgcagcgctggccagaaggtgctggccagcctcatcatccggctggccctggccgagaccttctgcctgaactgtggcatcatcgccctggatgagcccaccaccaacctggaccgggagaacatcgagagcctggcccacgccctggtggagatcatcaagagccgcagccagcagaggaacttccagctgctggtgatcacccatgatgaagattttgtggagctgctgggccgctcagaatatgtggagaagttctaccgcatcaagaagaacatcgaccagtgcagcgagatcgtgaagtgcagcgtgagcagcctgggcttcaacgtgcactag

SEQ ID NO: 21480 - DNA, 3522 bp, Artificial Sequence
  Description of Artificial Sequence: Synthetic coding sequence
atgatcagcagcctgggcgtgtccaaggctgtgctgaacaacgtcatcttctgccaccaggaggacagcaactggcccctgtctgagggcaaggccctgaagcagaagtttgatgagatcttcagcgccacccgctacatcaaggccctggagaccctgcggcaggtgcggcagacccagggccagaaggtgaaggagtaccagatggagctgaagtacctgaagcagtacaaggagaaggcctgtgagatccgggaccagatcaccagcaaggaggcccagctgaccagcagcaaggagatcgtgaagagctatgaaaatgagctggaccccctgaagaaccggctgaaggagattgagcacaacctgagcaagatcatgaagctggacaatgagatcaaggccctggacagcaggaagaagcagatggagaaggacaacagcgagctggaggagaagatggagaaggtgttccagggcacagatgagcagctgaatgacctgtaccacaaccaccagaggacagtgcgggagaaggagaggaagctggtggactgccaccgggagctggagaagctgaacaaggagagccggctgctgaaccaggagaagtctgagctgctggtggagcagggccgcctgcagctgcaggccgacagacaccaggagcacatccgggcccgggacagcctcatccagagcctggccacccagctggagctggatggctttgagcggggccccttcagcgagcggcagatcaagaacttccacaagctggtgcgggagcggcaggagggggaggccaagacagccaaccagctgatgaatgactttgctgagaaggagaccctgaagcagaagcagattgatgagatccgggacaagaagacaggcctgggccgcatcatcgagctgaagtctgagatcctgagcaagaagcagaatgagctgaagaatgtgaagtatgagctgcagcagctggagggcagcagtgaccgcatcctggagctggaccaggagctgatcaaggccgagcgggagctgagcaaggccgagaagaacagcaatgtggagaccctgaagatggaggtgatcagcctgcagaatgagaaggctgacctggacaggaccctgaggaagctggaccaggagatggagcagctgaaccaccacaccaccaccaggacccagatggagatgctgaccaaggacaaggctgacaaggatgagcagatcaggaagatcaagagccgccacagtgatgagctgaccagcctgctgggctacttccccaacaagaagcagctggaggactggctgcacagcaagagcaaggagatcaaccagacccgggaccggctggccaagctgaacaaggagctggccagcagcgagcagaacaagaaccacatcaacaatgagctgaagaggaaggaggagcagctgagcagctatgaggacaagctgtttgatgtgtgtggcagccaggactttgaaagtgacctggaccggctgaaggaggagattgagaagagcagcaagcagagggccatgctggccggggccacagctgtgtacagccagttcatcacccagctgacagatgagaaccagagctgctgccctgtgtgccagagggtcttccagacagaagctgagctgcaggaggtgatcagtgacctgcagagcaagctgcggctggccccagacaagctgaagagcacagagagcgagctgaagaagaaggagaagagaagagatgagatgctgggcctggtgcccatgaggcagagcatcatcgacctgaaggagaaggagatccctgagctgaggaacaagctgcagaatgtgaacagagacatccagaggctgaagaatgacatcgaggagcaggagaccctgctgggcaccatcatgcctgaggaggagagcgccaaggtgtgcctgacagatgtgaccatcatggagcgcttccagatggagctgaaggatgtggagaggaagatcgcccagcaggccgccaagctgcagggcatcgacctggacagaacagtgcagcaggtgaaccaggagaagcaggagaagcagcacaagctggacacagtgagcagcaagattgagctgaacaggaagctgatccaggaccagcaggagcagatccagcacctgaagagcaccaccaatgagctgaagtctgagaagctgcagatcagcaccaacctgcagaggcggcagcagctggaggagcagacagtggagctgagcacagaggtgcagagcctgtaccgggagatcaaggatgccaaggagcaggtgagccccctggagaccaccctggagaagttccagcaggagaaggaggagctgatcaacaagaagaacaccagcaacaagatcgcccaggacaagctgaatgacatcaaggagaaggtgaagaacatccacggctacatgaaggacatcgagaactacatccaggacggcaaggatgactacaagaagcagaaggagacagagctgaacaaggtgattgcccagctgtctgaatgtgagaagcacaaggagaagatcaatgaagacatgaggctgatgaggcaggacatcgacacccagaagatccaggagcgctggctgcaggacaacctgaccctgaggaagagaaatgaggagctgaaggaggtggaggaggagaggaagcagcacctgaaggagatgggccagatgcaggtgctgcagatgaagtctgagcaccagaagctggaggagaacatcgacaacatcaagaggaaccacaacctggccctgggccggcagaagggctatgaggaggagatcatccacttcaagaaggagctgcgggagccccagttcagagatgctgaggagaagtaccgggagatgatgattgtgatgaggaccacagagctggtgaacaaggacctggacatctactacaagaccctggaccaggccatcatgaagttccacagcatgaagatggaggagatcaacaagatcatccgggacctgtggaggagcacctaccggggccaggacatcgagtacatcgagatccgcagtgatgctgatgaaaatgtgtctgccagtgacaagagaagaaactacaactacagagtggtgatgctgaagggggacacagccctggacatgaggggccgctgcagcgctggccagaaggtgctggccagcctcatcatccggctggccctggccgagaccttctgcctgaactgtggcatcatcgccctggatgagcccaccaccaacctggacagagaaaatattgagagcctggcccacgccctggtggagatcatcaagagccgcagccagcagaggaacttccagctgctggtgatcacccatgatgaggactttgtggagctgctgggccgctcagaatatgtggagaagttctaccgcatcaagaagaacatcgaccagtgcagcgagatcgtgaagtgcagcgtgagcagcctgggcttcaacgtgcactag

SEQ ID NO: 21481 - DNA, 1020 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctggccgaggccgccaagctggtgcccatgggcttcaccacagccacagagttccaccagaggagaagtgagatcatccagatcaccaccggcagcaaggagctggacaagctgctgcagggcggcattgaaacaggcagcatcacagagatgtttggagagttcagaacaggcaagacccagatctgccacaccctggccgtgacctgccagctgcccatcgacagaggaggaggagagggcaaggccatgtacatcgacacagagggcaccttccggcctgagcggctgctggccgtggccgagagatatggcctgagcggcagtgatgtgctggacaacgtggcctatgcccgggccttcaacacagaccaccagacccagctgctgtaccaggccagcgccatgatggtggagagccgctatgccctgctgattgtggacagcgccacagccctgtacagaacagactacagcggccgcggggagctgagcgcccggcagatgcacctggcccgcttcctgaggatgctgctgcggctggctgatgaatttggagtggccgtggtgatcaccaaccaggtggtggcccaggtggatggagctgccatgtttgctgctgaccccaagaagcccatcggcggcaacatcatcgcccacgccagcaccacccggctgtacctgaggaagggccgcggggagacccgcatctgcaagatctatgacagcccctgcctgcctgaggccgaggccatgtttgccatcaatgctgatggagtgggagatgccaaggactag

SEQ ID NO: 21482 - DNA, 729 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctgctgctgagccacagatatggcctgagcggcagtgatgtgctggacaacgtggcctatgcccgggccttcaacacagaccaccagacccagctgctgtaccaggccagcgccatgatggtggagagccgctatgccctgctgattgtggacagcgccacagccctgtacagaacagactacagcggccgcggggagctgagcgcccggcagatgcacctggcccgcttcctgaggatgctgctgcggctggctgatgaatttggagtggccgtggtgatcaccaaccaggtggtggcccaggtggatggagctgccatgtttgctgctgaccccaagaagcccatcggcggcaacatcatcgcccacgccagcaccacccggctgtacctgaggaagggccgcggggagacccgcatctgcaagatctatgacagcccctgcctgcctgaggccgaggccatgtttgccatcaatgctgatggagtgggagatgccaaggactag

SEQ ID NO: 21483 - DNA, 1023 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctgacagagagccgctctgtggcccggctggagtgcaacagcgtcatcctggtgtactgcaccctgcggctgagcggcagcagtgacagccctgccagcgccagccgggtggtgggcaccactggaggcatcgagaccggcagcatcacagagatgtttggagagttcagaacaggcaagacccagatctgccacaccctggccgtgacctgccagctgcccatcgaccggggcggcggggagggcaaggccatgtacatcgacacagagggcaccttccggcctgagcggctgctggccgtggccgagagatatggcctgagcggcagtgatgtgctggacaacgtggcctatgcccgggccttcaacacagaccaccagacccagctgctgtaccaggccagcgccatgatggtggagagccgctatgccctgctgattgtggacagcgccacagccctgtacagaacagactacagcggccgcggggagctgagcgcccggcagatgcacctggcccgcttcctgaggatgctgctgcggctggctgatgaatttggagtggccgtggtgatcaccaaccaggtggtggcccaggtggatggagctgccatgtttgctgctgaccccaagaagcccatcggcggcaacatcatcgcccacgccagcaccacccggctgtacctgaggaagggccgcggggagacccgcatctgcaagatctatgacagcccctgcctgcctgaggccgaggccatgtttgccatcaatgctgatggagtgggagatgccaaggactag

SEQ ID NO: 21484 - DNA, 843 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctggccgaggccgccaagctggtgcccatgggcttcaccacagccacagagttccaccagaggagaagtgagatcatccagatcaccaccggcagcaaggagctggacaagctgctgcagggcggcattgaaacaggcagcatcacagagatgtttggagagttcagaacaggcaagacccagatctgccacaccctggccgtgacctgccagctgcccatcgacagaggaggaggagagggcaaggccatgtacatcgacacagagggcaccttccggcctgagcggctgctggccgtggccgagagatatggcctgagcggcagtgatgtgctggacaacgtggcctatgcccgggccttcaacacagaccaccagacccagctgctgtaccaggccagcgccatgatggtggagagccgctatgccctgctgattgtggacagcgccacagccctgtacagaacagactacagcggccgcggggagctgagcgcccggcagatgcacctggcccgcttcctgaggatgctgctgcggctggctgatgaaattgtgtctgaggagaggaagaggggcaaccagaacctgcagaacctgcggctgagcctgagcagctag

SEQ ID NO: 21485 - DNA, 456 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctggccgaggccgccaagctggtgcccatgggcttcaccacagccacagagttccaccagaggagaagtgagatcatccagatcaccaccggcagcaaggagctggacaagctgctgcagggcggcattgaaacaggcagcatcacagagatgtttggagagttcagaacaggcaagacccagatctgccacaccctggccgtgacctgccaggtgtggagcctgtggcagtag

SEQ ID NO: 21486 - DNA, 228 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctgtag

SEQ ID NO: 21487 - DNA, 519 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctggccgaggccgccaagctggtgcccatgggcttcaccacagccacagagttccaccagaggagaagtgagatcatccagatcaccaccggcagcaaggagctggacaagctgctgcagggcggcattgaaacaggcagcatcacagagatgtttggagagttcagaacaggcaagacccagatctgccacaccctggccgtgacctgccagctgcccatcgacagaggaggaggagagggcaaggccatgtacatcgacacagagggcaccttccggcctgagcggctgctgtag

SEQ ID NO: 21488 - DNA, 303 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctggtggagctgcggctggacctgagccagaagtgcctggagaacagcgagctgggccggcccaggagcgtcatcagatag

SEQ ID NO: 21489 - DNA, 1023 bp, Artificial Sequence; identical to SEQ ID NO: 21483
  Description of Artificial Sequence: Synthetic coding sequence

SEQ ID NO: 21490 - DNA, 729 bp, Artificial Sequence
  Description of Artificial Sequence: Synthetic coding sequence
atggccatgcagatgcagctggaggccaatgctgacacctctgtggaggaggagagctttggcccccagcccatcagccggctggagcagtgtggcatcaatgccaatgatgtgaagaagctggaggaggccggcttccacacagtggaggccgtggcctatgcccccaagaaggagctgatcaacatcaagggcatcagcgaggccaaggctgacaagatcctggccgtggccgagagatatggcctgagcggcagtgatgtgctggacaacgtggcctatgcccgggccttcaacacagaccaccagacccagctgctgtaccaggccagcgccatgatggtggagagccgctatgccctgctgattgtggacagcgccacagccctgtacagaacagactacagcggccgcggggagctgagcgcccggcagatgcacctggcccgcttcctgaggatgctgctgcggctggctgatgaatttggagtggccgtggtgatcaccaaccaggtggtggcccaggtggatggagctgccatgtttgctgctgaccccaagaagcccatcggcggcaacatcatcgcccacgccagcaccacccggctgtacctgaggaagggccgcggggagacccgcatctgcaagatctatgacagcccctgcctgcctgaggccgaggccatgtttgccatcaatgctgatggagtgggagatgccaaggactag

SEQ ID NO: 21491 - DNA, 1053 bp, Artificial Sequence
  Description of Artificial Sequence: Synthetic coding sequence
atgggcagcaagaagctgaagagggtgggcctgagccaggagctgtgtgaccggctgagccgccaccagatcctgacctgccaggacttcctgtgcctgagccccctggagctgatgaaggtgacaggcctgagctaccggggcgtgcatgagctgctgtgcatggtgtcccgggcctgtgcccccaagatgcagacagcctacggcatcaaggcccagaggtctgctgacttcagccctgccttcctgagcaccaccctgagcgccctggatgaggccctgcatggaggagtggcctgtggcagcctgacagagatcactggacctcctggctgtgggaagacccagttctgcatcatgatgagcatcctggccaccctgcccaccaacatgggcggcctggagggcgctgtggtgtacatcgacacagaaagtgccttctctgctgagcggctggtggagattgctgagagccgcttcccccgctacttcaacacagaggagaagctgctgctgaccagcagcaaggtgcacctgtaccgggagctgacctgtgatgaggtgctgcagagaattgagagcctggaggaggagatcatcagcaagggcatcaagctggtgatcctggacagcgtggcctctgtggtgaggaaggagtttgatgcccagctgcagggcaacctgaaggagaggaacaagttcctggcccgggaggccagcagcctgaagtacctggccgaggagttcagcatccctgtgatcctgaccaaccagatcaccacccacctgagcggggccctggccagccaggccgacctggtgtccccagcagatgacctgagcctgtctgagggcaccagcggcagcagctgtgtgattgctgccctgggcaacacctggagccacagcgtgaacaccaggctcatcctgcagtacctggacagcgagcggcggcagatcctgattgccaagagccccctggcccccttcaccagctttgtgtacaccatcaaggaggagggcctggtgctgcaggcctatgcccagtgctag

SEQ ID NO: 21492 - DNA, 1101 bp, Artificial Sequence
  Description of Artificial Sequence: Synthetic coding sequence
atgggcagcaagaagctgaagagggtgggcctgagccaggagctgtgtgaccggctgagccgccaccagatcctgacctgccaggacttcctgtgcctgagccccctggagctgatgaaggtgacaggcctgagctaccggggcgtgcatgagctgctgtgcatggtgtcccgggcctgtgcccccaagatgcagacagcctacggcatcaaggcccagaggtctgctgacttcagccctgccttcctgagcaccaccctgagcgccctggatgaggccctgcatggaggagtggcctgtggcagcctgacagagatcactggacctcctggctgtgggaagacccagttctgcatcatgatgagcatcctggccaccctgcccaccaacatgggcggcctggagggcgctgtggtgtacatcgacacagaaagtgccttctctgctgagcggctggtggagattgctgagagccgcttcccccgctacttcaacacagaggagaagctgctgctgaccagcagcaaggtgcacctgtaccgggagctgacctgtgatgaggtgctgcagagaattgagagcctggaggaggagatcatcagcaagggcatcaagctggtgatcctggacagcgtggcctctgtggtgaggaaggagtttgatgcccagctgcagggcaacctgaaggagaggaacaagttcctggcccgggaggccagcagcctgaagtacctggccgaggagttcagcatccctgtgatcctgaccaaccagatcaccacccacctgagcggggccctggccagccaggccgacctggtgtccccagcagatgacctgagcctgtctgagggcaccagcggcagcagctgtgtgattgctgccctgggcaacacctggagccacagcgtgaacaccaggctcatcctgcagtacctggacagcgagcggcggcagatcctgattgccaagagccccctggcccccttcaccagctttgtgtacaccatcaaggaggagggcctggtgctgcaggagttctggcacatctgcatcagcggcttcagcatccagaaccggctgaaggaaaatgaaagctag

SEQ ID NO: 21493 - DNA, 1053 bp, Artificial Sequence
  Description of Artificial Sequence: Synthetic coding sequence
atgggcagcaagaagctgaagagggtgggcctgagccaggagctgtgtgaccggctgagccgccaccagatcctgacctgccaggacttcctgtgcctgagccccctggagctgatgaaggtgacaggcctgagctaccggggcgtgcatgagctgctgtgcatggtgtcccgggcctgtgcccccaagatgcagacagcctacggcatcaaggcccagaggtctgctgacttcagccctgccttcctgagcaccaccctgagcgccctggatgaggccctgcatggaggagtggcctgtggcagcctgacagagatcactggacctcctggctgtgggaagacccagttctgcatcatgatgagcatcctggccaccctgcccaccaacatgggcggcctggagggcgctgtggtgtacatcgacacagaaagtgccttctctgctgagcggctggtggagattgctgagagccgcttcccccgctacttcaacacagaggagaagctgctgctgaccagcagcaaggtgcacctgtaccgggagctgacctgtgatgaggtgctgcagagaattgagagcctggaggaggagatcatcagcaagggcatcaagctggtgatcctggacagcgtggcctctgtggtgaggaaggagtttgatgcccagctgcagggcaacctgaaggagaggaacaagttcctggcccgggaggccagcagcctgaagtacctggccgaggagttcagcatccctgtgatcctgaccaaccagatcaccacccacctgagcggggccctggccagccaggccgacctggtgtccccagcagatgacctgagcctgtctgagggcaccagcggcagcagctgtgtgattgctgccctgggcaacacctggagccacagcgtgaacaccaggctcatcctgcagtacctggacagcgagcggcggcagatcctgattgccaagagccccctggcccccttcaccagctttgtgtacaccatcaaggaggagggcctggtgctgcagggccaggagaccccctag

SEQ ID NO: 21494 - DNA, 1053 bp, Artificial Sequence
  Description of Artificial Sequence: Synthetic coding sequence
atgggcagcaagaagctgaagagggtgggcctgagccaggagctgtgtgaccggctgagccgccaccagatcctgacctgccaggacttcctgtgcctgagccccctggagctgatgaaggtgacaggcctgagctaccggggcgtgcatgagctgctgtgcatggtgtcccgggcctgtgcccccaagatgcagacagcctacggcatcaaggcccagaggtctgctgacttcagccctgccttcctgagcaccaccctgagcgccctggatgaggccctgcatggaggagtggcctgtggcagcctgacagagatcactggacctcctggctgtgggaagacccagttctgcatcatgatgagcatcctggccaccctgcccaccaacatgggcggcctggagggcgctgtggtgtacatcgacacagaaagtgccttctctgctgagcggctggtggagattgctgagagccgcttcccccgctacttcaacacagaggagaagctgctgctgaccagcagcaaggtgcacctgtaccgggagctgacctgtgatgaggtgctgcagagaattgagagcctggaggaggagatcatcagcaagggcatcaagctggtgatcctggacagcgtggcctctgtggtgaggaaggagtttgatgcccagctgcagggcaacctgaaggagaggaacaagttcctggcccgggaggccagcagcctgaagtacctggccgaggagttcagcatccctgtgatcctgaccaaccagatcaccacccacctgagcggggccctggccagccaggccgacctggtgtccccagcagatgacctgagcctgtctgagggcaccagcggcagcagctgtgtgattgctgccctgggcaacacctggagccacagcgtgaacaccaggctcatcctgcagtacctggacagcgagcggcggcagatcctgattgccaagagccccctggcccccttcaccagctttgtgtacaccatcaaggaggagggcctggtgctgcagggccaggagaagccctag

SEQ ID NO: 21495 - DNA, 402 bp, Artificial Sequence
  Description of Artificial Sequence: Synthetic coding sequence
atgggcagcaagaagctgaagagggtgggcctgagccaggagctgtgtgaccggctgagccgccaccagatcctgacctgccaggacttcctgtgcctgagccccctggagctgatgaaggtgacaggcctgagctaccggggcgtgcatgagctgctgtgcatggtgtcccgggcctgtgcccccaagatgcagacagcctacggcatcaaggcccagaggtctgctgacttcagccctgccttcctgagcaccaccctgagcgccctggatgaggccctgcatggaggagtggcctgtggcagcctgacagagatcactggacctcctggctgtgggaagacccagttctgcatcatgatgagcatcctggccaccctgcccaccaacatgggcggctag

SEQ ID NO: 21496 - DNA, 1155 bp, Artificial Sequence
  Description of Artificial Sequence: Synthetic coding sequence
atgggcagcaagaagctgaagagggtgggcctgagccaggagctgtgtgaccggctgagccgccaccagatcctgacctgccaggacttcctgtgcctgagccccctggagctgatgaaggtgacaggcctgagctaccggggcgtgcatgagctgctgtgcatggtgtcccgggcctgtgcccccaagatgcagacagcctacggcatcaaggcccagaggtctgctgacttcagccctgccttcctgagcaccaccctgagcgccctggatgaggccctgcatggaggagtggcctgtggcagcctgacagagatcactggacctcctggctgtgggaagacccagttctgcatcatgatgagcatcctggccaccctgcccaccaacatgggcggcctggagggcgctgtggtgtacatcgacacagaaagtgccttctctgctgagcggctggtggagattgctgagagccgcttcccccgctacttcaacacagaggagaagctgctgctgaccagcagcaaggtgcacctgtaccgggagctgacctgtgatgaggtgctgcagagaattgagagcctggaggaggagatcatcagcaagggcatcaagctggtgatcctggacagcgtggcctctgtggtgaggaaggagtttgatgcccagctgcagggcaacctgaaggagaggaacaagttcctggcccgggaggccagcagcctgaagtacctggccgaggagttcagcatccctgtgatcctgaccaaccagatcaccacccacctgagcggggccctggccagccaggccgacctggtgtccccagcagatgacctgagcctgtctgagggcaccagcggcagcagctgtgtgattgctgccctgggcaacacctggagccacagcgtgaacaccaggctcatcctgcagtacctggacagcgagcggcggcagatcctgattgccaagagccccctggcccccttcaccagctttgtgtacaccatcaaggaggagggcctggtgctgcaggagaccaccttctgcagcgtgacccaggccgagctgaactgggcccctgagatcctgcccccccagcccccagagcagctgggcctgcagatgtgccaccacacccagctgatcttctag

SEQ ID NO: 21497 - DNA, 1101 bp, Artificial Sequence; identical to SEQ ID NO: 21492
  Description of Artificial Sequence: Synthetic coding sequence

SEQ ID NO: 21498 - DNA, 228 bp, Artificial Sequence
  Description of Artificial Sequence: Synthetic coding sequence
atgggcagcaagaagctgaagagggtgggcctgagccaggagctgtgtgaccggctgagccgccaccagatcctgacctgccaggacttcctgtgcctgagccccctggagctgatgaaggtgacaggcctgagctaccggggcgtgcatgagctgctgtgcatggtgtcccgggcctgtgcccccaagatgcagacagcctacggcatcaaggcccagaggagctag

SEQ ID NO: 21499 - DNA, 1131 bp, Artificial Sequence
  Description of Artificial Sequence: Synthetic coding sequence
atgaggggcaagaccttccgctttgagatgcagagggacctggtgtccttccccctgagccctgctgtgcgggtgaagctggtgtctgctggcttccagacagctgaggagctgctggaggtgaagcccagcgagctgagcaaggaggtgggcatcagcaaggccgaggccctggagaccctgcagatcatcagaagagaatgtctgaccaacaagcccaggtatgccggcaccagcgagagccacaagaagtgcacagccctggagctgctggagcaggagcacacccagggcttcatcatcaccttctgcagcgccctggatgacatcctgggcggcggcgtgcccctgatgaagaccacagagatctgtggggcccctggggtgggcaagacccagctgtgcatgcagctggccgtggatgtgcagatccctgagtgcttcggcggcgtggccggggaggccgtgttcatcgacacagagggcagcttcatggtggacagagtggtggacctggccacagcctgcatccagcacctgcagctgattgctgagaagcacaagggggaggagcacaggaaggccctggaggacttcaccctggacaacatcctgagccacatctactacttccgctgccgggactacacagagctgctggcccaggtgtacctgctgcctgacttcctgtctgagcacagcaaggtgcggctggtgattgtggatggcatcgccttccccttcagacatgacctggatgacctgagcctgcggacccggctgctgaatggcctggcccagcagatgatcagcctggccaacaaccaccggctggccgtcatcctgaccaaccagatgaccaccaagattgacaggaaccaggccctgctggtgcctgccctgggggagagctggggccacgccgccaccatccgcctcatcttccactgggacaggaagcagaggctggccaccctgtacaagagccccagccagaaggagtgcaccgtgctcttccagatcaagccccagggcttccgggacacagtggtgaccagcgcctgcagcctgcagacagagggcagcctgagcaccaggaagaggagccgggaccctgaggaggagctgtag

SEQ ID NO: 21500 - DNA, 987 bp, Artificial Sequence
  Description of Artificial Sequence: Synthetic coding sequence
atgggcgtgctgcgggtgggcctgtgccccggcctgacagaggagatgatccagctgctgcggagccaccgcatcaagacagtggtggacctggtgtctgctgacctggaggaggtggcccagaagtgtggcctgagctacaaggccctggtggccctgcggcgggtgctgctggcccagttcagcgccttccctgtgaatggagctgacctgtatgaggagctgaagaccagcacagccatcctgagcacaggcatcggccgcatccggctgtctggaaatgcccgctggctgatgcccaaggtgacagaaattgtgggcggccctggcagcggcaagacccaggtgtgcctgtgcatggccgccaacgtggcccacggcctgcagcagaatgtgctgtatgtggacagcaatggaggcctgacagccagccggctgctgcagctgctgcaggccaagacccaggatgaggaggagcaggccgaggccctgcggcgcatccaggtggtgcacgcctttgacatcttccagatgctggatgtgctgcaggagctgcggggcaccgtggcccagcaggtgacaggcagcagcggcaccgtgaaggtggtggtggtggacagcgtgacagctgtggtgagccccctgctgggcggccagcagcgggagggcctggccctgatgatgcagctggcccgggagctgaagaccctggcccgggacctgggcatggctgtggtggtgaccaaccacatcacccgggaccgggacagcggccgcctgaagccagccctgggccgctcctggagctttgtgcccagcacccgcatcctgctggacaccattgaaggagctggggccagcggcggccgcaggatggcctgcctggccaagagcagccggcagcccaccggcttccaggagatggtggacatcggcacctggggcaccagcgagcagagcgccaccctgcagggcgaccagacctag

SEQ ID NO: 21501 - DNA, 987 bp, Artificial Sequence
  Description of Artificial Sequence: Synthetic coding sequence
atgggcgtgctgcgggtgggcctgtgccccggcctgacagaggagatgatccagctgctgcggagccaccgcatcaagacagtggtggacctggtgtctgctgacctggaggaggtggcccagaagtgtggcctgagctacaaggccctggtggccctgcggcgggtgctgctggcccagttcagcgccttccctgtgaatggagctgacctgtatgaggagctgaagaccagcacagccatcctgagcacaggcatcggcagcctggacaagctgctggatgctggcctgtacacaggagaggtgacagaaattgtgggcggccctggcagcggcaagacccaggtgtgcctgtgcatggccgccaacgtggcccacggcctgcagcagaatgtgctgtatgtggacagcaatggaggcctgacagccagccggctgctgcagctgctgcaggccaagacccaggatgaggaggagcaggccgaggccctgcggcgcatccaggtggtgcacgcctttgacatcttccagatgctggatgtgctgcaggagctgcggggcaccgtggcccagcaggtgacaggcagcagcggcaccgtgaaggtggtggtggtggacagcgtgacagctgtggtgagccccctgctgggcggccagcagcgggagggcctggccctgatgatgcagctggcccgggagctgaagaccctggcccgggacctgggcatggctgtggtggtgaccaaccacatcacccgggaccgggacagcggccgcctgaagccagccctgggccgctcctggagctttgtgcccagcacccgcatcctgctggacaccattgaaggagctggggccagcggcggccgcaggatggcctgcctggccaagagcagccggcagcccaccggcttccaggagatggtggacatcggcacctggggcaccagcgagcagagcgccaccctgcagggcgaccagacctag

SEQ ID NO: 21502 - DNA, 651 bp, Artificial Sequence
  Description of Artificial Sequence: Synthetic coding sequence
atgggcgtgctgcgggtgggcctgtgccccggcctgacagaggagatgatccagctgctgcggagccaccgcatcaagacagtggtggacctggtgtctgctgacctggaggaggtggcccagaagtgtggcctgagctacaaggccgaggccctgcggcgcatccaggtggtgcacgcctttgacatcttccagatgctggatgtgctgcaggagctgcggggcaccgtggcccagcaggtgacaggcagcagcggcaccgtgaaggtggtggtggtggacagcgtgacagctgtggtgagccccctgctgggcggccagcagcgggagggcctggccctgatgatgcagctggcccgggagctgaagaccctggcccgggacctgggcatggctgtggtggtgaccaaccacatcacccgggaccgggacagcggccgcctgaagccagccctgggccgctcctggagctttgtgcccagcacccgcatcctgctggacaccattgaaggagctggggccagcggcggccgcaggatggcctgcctggccaagagcagccggcagcccaccggcttccaggagatggtggacatcggcacctggggcaccagcgagcagagcgccaccctgcagggcgaccagacctag

SEQ ID NO: 21503 - DNA, 357 bp, Artificial Sequence
  Description of Artificial Sequence: Synthetic coding sequence
atgggcgtgctgcgggtgggcctgtgccccggcctgacagaggagatgatccagctgctgcggagccaccgcatcaagacagtggtggacctggtgtctgctgacctggaggaggtggcccagaagtgtggcctgagctacaaggccctggtggccctgcggcgggtgctgctggcccagttcagcgccttccctgtgaatggagctgacctgtatgaggagctgaagaccagcacagccatcctgagcacaggcatcggcagacatggaggccgcacccaggtgggcacctgggaggactgcagctgcctgcggagcccccagggcgaccggggcgtgggcagcggcatgctgtag

SEQ ID NO: 21504 - DNA, 852 bp, Artificial Sequence
  Description of Artificial Sequence: Synthetic coding sequence
atgggcgtgctgcgggtgggcctgtgccccggcctgacagaggagatgatccagctgctgcggagccaccgcatcaagacagtggtggacctggtgtctgctgacctggaggaggtggcccagaagtgtggcctgagctacaaggccctggtggccctgcggcgggtgctgctggcccagttcagcgccttccctgtgaatggagctgacctgtatgaggagctgaagaccagcacagccatcctgagcacaggcatcggcagcctggacaagctgctggatgctggcctgtacacaggagaggtgacagaaattgtgggcggccctggcagcggcaagacccaggccgaggccctgcggcgcatccaggtggtgcacgcctttgacatcttccagatgctggatgtgctgcaggagctgcggggcaccgtggcccagcaggtgacaggcagcagcggcaccgtgaaggtggtggtggtggacagcgtgacagctgtggtgagccccctgctgggcggccagcagcgggagggcctggccctgatgatgcagctggcccgggagctgaagaccctggcccgggacctgggcatggctgtggtggtgaccaaccacatcacccgggaccgggacagcggccgcctgaagccagccctgggccgctcctggagctttgtgcccagcacccgcatcctgctggacaccatcgagggcgctggggccagcggcggccgcaggatggcctgcctggccaagagcagccggcagcccaccggcttccaggagatggtggacatcggcacctggggcaccagcgagcagagcgccaccctgcagggcgaccagacctag

SEQ ID NO: 21505 - DNA, 1047 bp, Artificial Sequence
  Description of Artificial Sequence: Synthetic coding sequence
atgggcgtgctgcgggtgggcctgtgccccggcctgacagaggagatgatccagctgctgcggagccaccgcatcaagacagtggtggacctggtgtctgctgacctggaggaggtggcccagaagtgtggcctgagctacaagacctggagggcccacagcagcggcaacctgggcggcctgcagctgccccaggtgcctgctggccgctcctggagcggcgtgagaaatgccctgaagaaggccggcctgggccacggcggcacagatggcctgagcctgaatgcctttgatgagcggggcacagctgtgtccaccagccggctggacaagctgctggatgctggcctgtacacaggagaggtgacagaaattgtgggcggccctggcagcggcaagacccaggtgtgcctgtgcatggccgccaacgtggcccacggcctgcagcagaatgtgctgtatgtggacagcaatggaggcctgacagccagccggctgctgcagctgctgcaggccaagacccaggatgaggaggagcaggccgaggccctgcggcgcatccaggtggtgcacgcctttgacatcttccagatgctggatgtgctgcaggagctgcggggcaccgtggcccagcaggtgacaggcagcagcggcaccgtgaaggtggtggtggtggacagcgtgacagctgtggtgagccccctgctgggcggccagcagcgggagggcctggccctgatgatgcagctggcccgggagctgaagaccctggcccgggacctgggcatggctgtggtggtgaccaaccacatcacccgggaccgggacagcggccgcctgaagccagccctgggccgctcctggagctttgtgcccagcacccgcatcctgctggacaccattgaaggagctggggccagcggcggccgcaggatggcctgcctggccaagagcagccggcagcccaccggcttccaggagatggtggacatcggcacctggggcaccagcgagcagagcgccaccctgcagggcgaccagacctag

SEQ ID NO: 21506 - DNA, 648 bp, Artificial Sequence
  Description of Artificial Sequence: Synthetic coding sequence
atggtgatggccgccctgcccttcagcgaggacctgaagatgccagacacctgtgtgctgccccactgccctgggaaggagaacaaggatgtggtggacctggtgtctgctgacctggaggaggtggcccagaagtgtggcctgagctacaaggccctggtggccctgcggcgggtgctgctggcccagttcagcgccttccctgtgaatggagctgacctgtatgaggagctgaagaccagcacagccatcctgagcactggaattggcagcctggacaagctgctggatgctggcctgtacaccggggaggtgacagagatcgtgggcggccctggcagcggcaagacccaggtgtgcctgtgcatggccgccaacgtggcccacggcctgcagcagaatgtgctgtatgtggacagcaatggaggcctgacagccagccggctgctgcagctgctgcaggccaagacccaggatgaggaggagcaggccgaggccctgcggcgcatccaggtggtgcacgcctttgacatcttccagatgctggatgtgctgcaggagctgcggggcaccgtggcccagcaggacggcatccctgagcacctgaaccacatcccccactgcctgcacgtgcacctgccctgctag

SEQ ID NO: 21507 - DNA, 711 bp, Artificial Sequence
  Description of Artificial Sequence: Synthetic coding sequence
atgggcgtgctgcgggtgggcctgtgccccggcctgacagaggagatgatccagctgctgcggagccaccgcatcaagacagtggtggacctggtgtctgctgacctggaggaggtggcccagaagtgtggcctgagctacaaggccctggtggccctgcggcgggtgctgctggcccagttcagcgccttccctgtgaatggagctgacctgtatgaggagctgaagaccagcacagccatcctgagcacaggcatcggcagcctggacaagctgctggatgctggcctgtacacaggagaggtgacagaaattgtgggcggccctggcagcggcaagacccaggtgtgcctgtgcatggccgccaacgtggcccacggcctgcagcagaatgtgctgtatgtggacagcaatggaggcctgacagccagccggctgctgcagctgctgcaggccaagacccaggatgaggaggagcaggccgaggccctgcggcgcatccaggtggtgcacgcctttgacatcttccagatgctggatgtgctgcaggagctgcggggcaccgtggcccagcaggtgacaggcagcagcggcaccgtgaaggtggtggtggtggacagcgtgacagctgtggtgagccccctgctgggcggccagcagcgggagggcctggccctgatgatgcagctggcccgggagctgaagacctag

SEQ ID NO: 21508 - DNA, 1047 bp, Artificial Sequence; identical to SEQ ID NO: 21505
  Description of Artificial Sequence: Synthetic coding sequence

SEQ ID NO: 21509 - DNA, 1257 bp, Artificial Sequence
  Description of Artificial Sequence: Synthetic coding sequence
atgagcggcacagaggaggccatcctgggcggccgggacagccaccctgctgctgggggcggctctgtgctgtgcttcggccagtgccagtacacagctgaggagtaccaggccatccagaaggccctgcggcagaggctgggccctgagtacatcagcagcaggatggccggcggcggccagaaggtgtgctacatcgagggccacagggtcatcaacctggccaatgagatgtttggctacaacggctgggcccacagcatcacccagcagaatgtggactttgtggacctgaacaacgggaagttctacgtgggcgtgtgtgcctttgtgcgggtgcagctgaaggatggcagctaccatgaagatgtgggctacggcgtgtctgagggcctgaagagcaaggccctgagcctggagaaggccaggaaggaggccgtgacagatggcctgaagagggccctgcggagctttggaaatgccctgggcaactgcatcctggacaaggactacctgcggagcctgaacaagctgccccggcagctgcccctggaggtggacctgaccaaggccaagaggcaggacctggagcccagcgtggaggaggcccgctacaacagctgccggcccaacatggccctgggccacccccagctgcagcaggtgaccagccccagccggcccagccatgctgtgatcccagctgaccaggactgcagcagccgcagcctgagcagcagcgctgtggagagcgaggccacccaccagaggaagctgcggcagaagcagctgcagcagcagttccgggagaggatggagaagcagcaggtgcgggtgtccaccccatctgctgagaagtctgaggccgcccccccagcccctcctgtgacccacagcacccctgtgacagtgtctgagcccctgctggagaaggacttcctggccggcgtgacccaggagctgatcaagaccctggaggacaacagcgagaagtgggccgtgaccccagatgctggagatggagtggtgaagcccagcagcagagctgaccctgcccagaccagtgacaccctggccctgaacaaccagatggtgacccagaacagaacaccccacagcgtgtgccaccagaagccccaggccaagagcggctcctgggacctgcagacctacagcgctgaccagaggaccaccggcaactgggagagccacaggaagagccaggacatgaagaagaggaaatatgaccccagctag

SEQ ID NO: 21510 - DNA, 1257 bp, Artificial Sequence; identical to SEQ ID NO: 21509
  Description of Artificial Sequence: Synthetic coding sequence

SEQ ID NO: 21511 - DNA, 1026 bp, Artificial Sequence
  Description of Artificial Sequence: Synthetic coding sequence
atgtttggctacaacggctgggcccacagcatcacccagcagaatgtggactttgtggacctgaacaacgggaagttctacgtgggcgtgtgtgcctttgtgcgggtgcagctgaaggatggcagctaccatgaagatgtgggctatggagtgtctgagggcctgaagagcaaggccctgagcctggagaaggccaggaaggaggccgtgacagatggcctgaagagggccctgcggagctttggaaatgccctgggcaactgcatcctggacaaggactacctgcggagcctgaacaagctgccccggcagctgcccctggaggtggacctgaccaaggccaagaggcaggacctggagcccagcgtggaggaggcccgctacaacagctgccggcccaacatggccctgggccacccccagctgcagcaggtgaccagccccagccggcccagccacgccgtcatcccagctgaccaggactgcagcagccgcagcctgagcagcagcgctgtggagagcgaggccacccaccagaggaagctgcggcagaagcagctgcagcagcagttccgggagaggatggagaagcagcaggtgcgggtgtccacccccagcgctgagaagtctgaggccgcccccccagcccctcctgtgacccacagcacccctgtgacagtgtctgagcccctgctggagaaggacttcctggccggcgtgacccaggagctgatcaagaccctggaggacaacagcgagaagtgggccgtgaccccagatgctggagatggagtggtgaagcccagcagcagagctgaccctgcccagaccagtgacaccctggccctgaacaaccagatggtgacccagaacagaacaccccacagcgtgtgccaccagaagccccaggccaagagcggctcctgggacctgcagacctacagcgctgaccagaggaccactggaaactgggagagccacaggaagagccaggacatgaagaagaggaaatatgaccccagctag

SEQ ID NO: 21512 - DNA, 681 bp, Artificial Sequence
  Description of Artificial Sequence: Synthetic coding sequence
atgagcggcacagaggaggccatcctgggcggccgggacagccaccctgctgctgggggcggctctgtgctgtgcttcggccagtgccagtacacagctgaggagtaccaggccatccagaaggccctgcggcagaggctgggccctgagtacatcagcagcaggatggccggcggcggccagaaggtgtgctacatcgagggccacagggtcatcaacctggccaatgagatgtttggctacaacggctgggcccacagcatcacccagcagaatgtggactttgtggacctgaacaacgggaagttctacgtgggcgtgtgtgcctttgtgcgggtgcagctgaaggatggcagctaccatgaagatgtgggctacggcgtgtctgagggcctgaagagcaaggccctgagcctggagaaggccaggaaggaggccgtgacagatggcctgaagagggccctgcggctgcccctgctgggcgtgtctggccgcatcctgtacagcctcttctctgtgcacagcgtgatgtgtgccggcggcctgcccacccccacagccagcgcccagacagcccccagcagcccctgcagcagcgctgtgctgcgctatgcccaggagttctgggagtgcacctggaagctgtacagcggccagaggctgcctgagatcaccaagtag

SEQ ID NO: 21513 - DNA, 2244 bp, Artificial Sequence
  Description of Artificial Sequence: Synthetic coding sequence
atgaggaggagcctggcccccagccagctggccaagaggaagccagagggccgcagctgtgatgatgaggactggcagcccggcctggtgacccccaggaagaggaagagcagcagcgagacccagatccaggagtgcttcctgagccccttcaggaagcccctgagccagctgaccaaccagcccccctgcctggacagcagccagcacgaggccttcatccgcagcatcctgagcaagcccttcaaggtgcccatccccaactaccagggccccctgggcagccgggccctgggcctgaagagagctggggtgcggcgggccctgcatgaccccctggagaaggatgccctggtgctgtatgagcccccacccctgagcgcccatgaccagctgaagctggacaaggagaagctgcctgtgcacgtggtggtggaccccatcctgagcaaggtgctgcggccccaccagcgggagggcgtgaagttcctgtgggagtgtgtgaccagccgccgcatccctggcagccacggctgcatcatggctgatgagatgggcctgggcaagaccctgcagtgcatcaccctgatgtggaccctgctgcggcagagccctgagtgcaagccagaaattgacaaggctgtggtggtgagccccagcagcctggtgaagaactggtacaatgaggtgggcaagtggctgggcggccgcatccagcccctggccattgatggcggcagcaaggatgaaattgaccagaagctggagggcttcatgaaccagagaggagcccgggtgagcagccccatcctgatcatctcctatgagaccttccggctgcacgtgggcgtgctgcagaagggctctgtgggcctggtgatctgtgatgagggccaccggctgaagaacagcgagaaccagacctaccaggccctggacagcctgaacaccagcagaagagtgctgatcagcggcacccccatccagaatgacctgctggagtacttcagcctggtgcactttgtgaacagcggcatcctgggcacagcccacgagttcaagaagcactttgagctgcccatcctgaagggcagagatgctgctgccagcgaggccgaccggcagctgggggaggagcggctgcgggagctgaccagcatcgtgaaccgctgcctgatccggaggaccagtgacatcctgagcaagtacctgcctgtgaagattgagcaggtggtgtgctgccgcctgacccccctgcagacagagctgtacaagcgcttcctgcggcaggccaagccagctgaggagctgctggagggcaagatgtctgtgagcagcctgagcagcatcaccagcctgaagaagctgtgcaaccacccagccctgatctatgacaagtgtgtggaggaggaggatggctttgtgggcgccctggacctcttccccccaggctacagcagcaaggccctggagccccagctgagcggcaagatgctggtgctggactacatcctggccgtgaccaggagccgcagcagtgacaaggtggtgctggtgagcaactacacccagaccctggacctgtttgagaagctgtgccgggcccggcgctacctgtatgtgcggctggatggcaccatgagcatcaagaagagggccaaggtggtggagcgcttcaacagccccagcagcccagactttgtgttcatgctgagcagcaaggccggcggctgcggcctgaacctgattggagccaaccggctggtgatgtttgatcctgactggaacccagccaatgatgagcaggccatggcccgggtgtggagagatggccagaagaagacctgctacatctaccgcctgctgtctgctggcaccatcgaggagaagatcttccagaggcagagccacaagaaggccctgagcagctgtgtggtggatgaggagcaggatgtggagcggcacttcagcctgggggagctgaaggagctgttcatcctggatgaggccagcctgagtgacacccatgaccggctgcactgccgccgctgtgtgaacagccggcagatccggcccccaccagatggcagtgactgcaccagtgacctggccggctggaaccactgcacagacaagtggggcctgagagatgaggtgctgcaggccgcctgggatgctgccagcacagccatcacctttgtgttccaccagaggagccatgaggagcagaggggcctgaggtag

SEQ ID NO: 21514 - DNA, 2244 bp, Artificial Sequence; identical to SEQ ID NO: 21513
  Description of Artificial Sequence: Synthetic coding sequence

SEQ ID NO: 21515 - DNA, 1704 bp, Artificial Sequence
  Description of Artificial Sequence: Synthetic coding sequence
atggctgatgagatgggcctgggcaagaccctgcagtgcatcaccctgatgtggaccctgctgcggcagagccctgagtgcaagccagaaattgacaaggctgtggtggtgagccccagcagcctggtgaagaactggtacaatgaggtgggcaagtggctgggcggccgcatccagcccctggccattgatggcggcagcaaggatgaaattgaccagaagctggagggcttcatgaaccagagaggagcccgggtgagcagccccatcctgatcatctcctatgagaccttccggctgcacgtgggcgtgctgcagaagggctctgtgggcctggtgatctgtgatgagggccaccggctgaagaacagcgagaaccagacctaccaggccctggacagcctgaacaccagcagaagagtgctgatcagcggcacccccatccagaatgacctgctggagtacttcagcctggtgcactttgtgaacagcggcatcctgggcacagcccacgagttcaagaagcactttgagctgcccatcctgaagggcagagatgctgctgccagcgaggccgaccggcagctgggggaggagcggctgcgggagctgaccagcatcgtgaaccgctgcctgatccggaggaccagtgacatcctgagcaagtacctgcctgtgaagattgagcaggtggtgtgctgccgcctgacccccctgcagacagagctgtacaagcgcttcctgcggcaggccaagccagctgaggagctgctggagggcaagatgtctgtgagcagcctgagcagcatcaccagcctgaagaagctgtgcaaccacccagccctgatctatgacaagtgtgtggaggaggaggatggctttgtgggcgccctggacctcttccccccaggctacagcagcaaggccctggagccccagctgagcggcaagatgctggtgctggactacatcctggccgtgaccaggagccgcagcagtgacaaggtggtgctggtgagcaactacacccagaccctggacctgtttgagaagctgtgccgggcccggcgctacctgtatgtgcggctggatggcaccatgagcatcaagaagagggccaaggtggtggagcgcttcaacagccccagcagcccagactttgtgttcatgctgagcagcaaggccggcggctgcggcctgaacctgattggagccaaccggctggtgatgtttgatcctgactggaacccagccaatgatgagcaggccatggcccgggtgtggagagatggccagaagaagacctgctacatctaccgcctgctgtctgctggcaccatcgaggagaagatcttccagaggcagagccacaagaaggccctgagcagctgtgtggtggatgaggagcaggatgtggagcggcacttcagcctgggggagctgaaggagctgttcatcctggatgaggccagcctgagtgacacccatgaccggctgcactgccgccgctgtgtgaacagccggcagatccggcccccaccagatggcagtgactgcaccagtgacctggccggctggaaccactgcacagacaagtggggcctgagagatgaggtgctgcaggccgcctgggatgctgccagcacagccatcacctttgtgttccaccagaggagccatgaggagcagaggggcctgaggtag

SEQ ID NO: 21516 - DNA, 1176 bp, Artificial Sequence
  Description of Artificial Sequence: Synthetic coding sequence
atgaagtgcctggtgactggaggaaatgtgaaggtgctgggcaaggctgtgcacagcctgagcagaattggagatgagctgtacctggagcccctggaggatggcctgagcctgaggacagtgaacagcagccgcagcgcctatgcctgcttcctgtttgcccccctcttcttccagcagtaccaggccgccaccccaggccaggacctgctgcgctgcaagatcctgatgaagagcttcctgagcgtcttccgcagcctggccatgctggagaagacagtggagaagtgctgcatcagcctgaatggccgcagcagccggctggtggtgcagctgcactgcaagtttggagtgaggaagacccacaacctgtccttccaggactgtgagagcctgcaggccgtgtttgatcctgccagctgcccccacatgctgcgggccccagcccgggtgctgggggaggccgtgctgcccttctccccagccctggccgaggtgaccctgggcatcggccggggccggcgggtcatcctgcggagctaccacgaggaggaggccgacagcacagccaaggccatggtgacagagatgtgcctgggggaggaggacttccagcagctgcaggcccaggagggcgtggccatcaccttctgcctgaaggagttccggggcctgctgagctttgctgagagcgccaacctgaacctgagcatccactttgatgcccctggccggcctgccatcttcaccatcaaggacagcctgctggatggccactttgtgctggccaccctgagtgacacagacagccacagccaggacctgggcagccctgagcggcaccagcctgtgccccagctgcaggcccacagcaccccccacccagatgactttgccaatgatgacatcgacagctacatgattgccatggagaccaccatcggaaatgaaggcagccgggtgctgcccagcatcagcctgagccctggcccccagccccccaagagccctggcccccacagcgaggaggaggatgaagctgagcccagcacagtgcccggcaccccaccacccaagaagttccgcagcctcttcttcggcagcatcctggcccctgtgcgcagcccccagggccccagccctgtgctggctgaagattctgagggggagggctag

SEQ ID NO: 21517 - DNA, 1752 bp, Artificial Sequence
  Description of Artificial Sequence: Synthetic coding sequence
atgcccaagcccatcaacgtgcgggtgaccaccatggatgctgagctggagtttgccatccagcccaacaccaccgggaagcagctgtttgaccaggtggtgaagacagtgggcctgcgggaggtgtggttcttcggcctgcagtatgtggacagcaagggctacagcacctggctgaagctgaacaagaaggtgacccagcaggatgtgaagaaggagaaccccctgcagttcaagttccgggccaagttcttcccagaagatgtgtctgaggagctgatccaggagatcacccagaggctcttcttcctgcaggtgaaggaggccatcctgaatgatgagatctactgccccccagagacagctgtgctgctggccagctatgctgtgcaggccaagtacggggactacaacaaggagatccacaagccaggctacctggccaatgaccggctgctgccccagagggtgctggagcagcacaagctgaccaaggagcagtgggaggagcgcatccagaactggcatgaggagcaccggggcatgctgagagaagattccatgatggagtacctgaagatcgcccaggacctggagatgtatggagtgaactactttgagatcaagaacaagaagggcacagagctgtggctgggcgtggatgccctgggcctgaacatctatgaacatgatgacaagctgacccccaagattggcttcccctggagcgagatccggaacatctccttcaatgacaagaagtttgtgatcaagcccatcgacaagaaggccccagactttgtgttctacgccccccggctgcgcatcaacaagaggatcctggccctgtgcatgggcaaccacgagctgtacatgagaagaaggaagccagacaccatcgaggtgcagcagatgaaggcccaggcccgggaggagaagcaccagaagcagctggagcgggcccagctggagaatgagaagaagaagcgggagattgctgagaaggagaaggagcgcatcgagcgggagaaggaggagctgatggagcggctgaagcagatcgaggagcagaccatcaaggcccagaaggagctggaggagcagaccaggaaggccctggagctggaccaggagaggaagagggccaaggaggaggccgagcggctggagaaggagaggagagctgctgaggaggccaagagcgccatcgccaagcaggccgctgaccagatgaagaaccaggagcagctggccgctgagctggccgagttcaccgccaagatcgccctgctggaggaggccaagaagaagaaggaggaggaggccacagagtggcagcacaaggcctttgctgcccaggaggacctggagaagaccaaggaggagctgaagacagtgatgtctgcccctcctcctcctcctcctcctcctgtgatccccccaacagaaaatgaacatgatgaacatgatgaaaataatgctgaggccagcgctgagctgagcaatgaaggagtgatgaaccacaggtctgaggaggagcgggtgacagagacccagaagaatgaaagagtgaagaagcagctgcaggccctgagcagcgagctggcccaggccagagatgagaccaagaagacccagaatgatgtgctgcacgcagaaaatgtgaaggccggccgggacaagtacaagaccctgcggcagatccggcagggcaacaccaagcagagaattgatgaatttgaggccatgtag

SEQ ID NO: 21518 - DNA, 1815 bp, Artificial Sequence
  Description of Artificial Sequence: Synthetic coding sequence
atgcccaagcccatcaacgtgcgggtgaccaccatggatgctgagctggagtttgccatccagcccaacaccaccgggaagcagctgtttgaccaggtggtgaagacagtgggcctgcgggaggtgtggttcttcggcctgcagtatgtggacagcaagggctacagcacctggctgaagctgaacaagaaggtgacccagcaggatgtgaagaaggagaaccccctgcagttcaagttccgggccaagttcttcccagaagatgtgtctgaggagctgatccaggagatcacccagaggctcttcttcctgcaggtgaaggaggccatcctgaatgatgagatctactgccccccagagacagctgtgctgctggccagctatgctgtgcaggccaagtacggggactacaacaaggagatccacaagccaggctacctggccaatgaccggctgctgccccagagggtgctggagcagcacaagctgaccaaggagcagtgggaggagcgcatccagaactggcatgaggagcaccggggcatgctgagagaagattccatgatggagtacctgaagatcgcccaggacctggagatgtatggagtgaactactttgagatcaagaacaagaagggcacagagctgtggctgggcgtggatgccctgggcctgaacatctatgaacatgatgacaagctgacccccaagattggcttcccctggagcgagatccggaacatctccttcaatgacaagaagtttgtgatcaagcccatcgacaagaaggccccagactttgtgttctacgccccccggctgcgcatcaacaagaggatcctggccctgtgcatgggcaaccacgagctgtacatgagaagaaggaagccagacaccatcgaggtgcagcagatgaaggcccaggcccgggaggagaagcaccagaagcagctggagcgggcccagctggagaatgagaagaagaagcgggagattgctgagaaggagaaggagcgcatcgagcgggagaaggaggagctgatggagcggctgaagcagatcgaggagcagaccatcaaggcccagaaggagctggaggagcagaccaggaaggccctggagctggaccaggagaggaagagggccaaggaggaggccgagcggctggagaaggagaggagagctgctgaggaggccaagagcgccatcgccaagcaggccgctgaccagatgaagaaccaggagcagctggccgctgagctggccgagttcaccgccaagatcgccctgctggaggaggccaagaagaagaaggaggaggaggccacagagtggcagcacaaggcctttgctgcccaggaggacctggagaagaccaaggaggagctgaagacagtgatgtctgcccctcctcctcctcctcctcctcctgtgatccccccaacagaaaatgaacatgatgaacatgatgaaaataatgctgaggccagcgctgagctgagcaatgaaggagtgatgaaccacaggtctgaggaggagcgggtgacagagacccagaagaatgaaagagtgaagaagcagctgcaggccctgagcagcgagctggcccaggccagagatgagaccaagaagacccagaatgatgtgctgcacgcagaaaatgtgaaggccggccgggacaagtacaagaccctgcggcagatccggcagggcaacaccaagcagagaattgatgaatttgaggccatgtggggccccaagctgtatgccctcttccagatgaggagctgccagagcagcatcaagcagatgtag

SEQ ID NO: 21519 - DNA, 1020 bp, Artificial Sequence
  Description of Artificial Sequence: Synthetic coding sequence
ccccaccccaagatcaacgtgcgggtgaccaccatggatgctgagctggagtttgccatccagcccaacaccaccgggaagcagctgtttgaccaggtggtgaagacagtgggcctgcgggaggtgtggttcttcggcctgcagtatgtggacagcaagggctacagcacctggctgaagctgaacaagaaggtgacccagcaggatgtgaagaaggagaaccccctgcagttcaagttccgggccaagttcttcccagaagatgtgtctgaggagctgatccaggagatcacccagaggctcttcttcctgcaggtgaaggaggccatcctgaatgatgagatctactgccccccagagacagctgtgctgctggccagctatgctgtgcaggccaagtacggggactacaacaaggagatccacaagccaggctacctggccaatgaccggctgctgccccagagggtgctggagcagcacaagctgaccaaggagcagtgggaggagcgcatccagaactggcatgaggagcaccggggcatgctgagagaagattccatgatggagtacctgaagatcgcccaggacctggagatgtatggagtgaactactttgagatcaagaacaagaagggcacagagctgtggctgggcgtggatgccctgggcctgaacatctatgaacatgatgacaagctgacccccaagattggcttcccctggagcgagatccggaacatctccttcaatgacaagaagtttgtgatcaagcccatcgacaagaaggccccagactttgtgttctacgccccccggctgcgcatcaacaagaggatcctggccctgtgcatgggcaaccacgagctgtacatgagaagaaggaagccagacaccatcgaggtgcagcagatgaaggcccaggcccgggaggagaagcaccagaagcagctggagaggagccggctgagcaagatcaagaagaagaagaggaagaagaagaagaagaagaagaagtag

SEQ ID NO: 21520 - DNA, 1815 bp, Artificial Sequence; identical to SEQ ID NO: 21518
  Description of Artificial Sequence: Synthetic coding sequence

SEQ ID NO: 21521 - DNA, 774 bp, Artificial Sequence
  Description of Artificial Sequence: Synthetic coding sequence
atggagcggctgaagcagatcgaggagcagaccatcaaggcccagaaggagctggaggagcagaccaggaaggccctggagctggaccaggagaggaagagggccaaggaggaggccgagcggctggagaaggagcggcgggctgctgaggaggccaagagcgccatcgccaagcaggccgctgaccagatgaagaaccaggagcagctggccgctgagctggccgagttcaccgccaagatcgccctgctggaggaggccaagaagaagaaggaggaggaggccacagagtggcagcacaaggcctttgctgcccaggaggacctggagaagaccaaggaggagctgaagacagtgatgtctgcccctcctcctcctcctcctcctcctgtgattcctcccacagaaaatgaacatgatgaacatgatgagaacaatgctgaggccagcgctgagctgagcaatgaaggagtgatgaaccacaggtctgaggaggagcgggtgacagagacccagaagaatgaaagagtgaagaagcagctgcaggccctgagcagcgagctggcccaggccagagatgagaccaagaagacccagaatgatgtgctgcatgctgaaaatgtgaaggccggccgggacaagtacaagaccctgcggcagatccggcagggcaacaccaagcagagaattgatgaatttgaggccatgtggggccccaagctgtatgccctcttccagatgaggagctgccagagcagcatcaagcagatgtag

SEQ ID NO: 21522 - DNA, 762 bp, Artificial Sequence
  Description of Artificial Sequence: Synthetic coding sequence
gggggccgcatcgcccgggcccacgagtttgaggccgctgtgtccttctgcaccagcgcctgggccacagagcgggaccctgtgtccaggaagcagcgggagctggaggagcagaccaggaaggccctggagctggaccaggagaggaagagggccaaggaggaggccgagcggctggagaaggagaggagagctgctgaggaggccaagagcgccatcgccaagcaggccgctgaccagatgaagaaccaggagcagctggccgctgagctggccgagttcaccgccaagatcgccctgctggaggaggccaagaagaagaaggaggaggaggccacagagtggcagcacaaggcctttgctgcccaggaggacctggagaagaccaaggaggagctgaagacagtgatgtctgcccctcctcctcctcctcctcctcctgtgatccccccaacagaaaatgaacatgatgaacatgatgaaaataatgctgaggccagcgctgagctgagcaatgaaggagtgatgaaccacaggtctgaggaggagcgggtgacagagacccagaagaatgaaagagtgaagaagcagctgcaggccctgagcagcgagctggcccaggccagagatgagaccaagaagacccagaatgatgtgctgcacgcagaaaatgtgaaggccggccgggacaagtacaagaccctgcggcagatccggcagggcaacaccaagcagagaattgatgaatttgaggccatgtag

SEQ ID NO: 21523 - DNA, 603 bp, Artificial Sequence
  Description of Artificial Sequence: Synthetic coding sequence
atgcccaagcccatcaacgtgcgggtgaccaccatggatgctgagctggagtttgccatccagcccaacaccaccgggaagcagctgtttgaccaggtgacccagcaggatgtgaagaaggagaaccccctgcagttcaagttccgggccaagttcttcccagaagatgtgtctgaggagctgatccaggagatcacccagaggctcttcttcctgcaggtgaaggaggccatcctgaatgatgagatctactgccccccagagacagctgtgctgctggccagctatgctgtgcaggccaagtacggggactacaacaaggagatccacaagccaggctacctggccaatgaccggctgctgccccagagggtgctggagcagcacaagctgaccaaggagcaggatgagaccaagaagacccagaatgatgtgctgcacgcagaaaatgtgaaggccggccgggacaagtacaagaccctgcggcagatccggcagggcaacaccaagcagagaattgatgaatttgaggccatgtggggccccaagctgtatgccctcttccagatgaggagctgccagagcagcatcaagcagatgtag

SEQ ID NO: 21524 - DNA, 1815 bp, Artificial Sequence; identical to SEQ ID NO: 21518
  Description of Artificial Sequence: Synthetic coding sequence

SEQ ID NO: 21525 - DNA, 1344 bp, Artificial Sequence
  Description of Artificial Sequence: Synthetic coding sequence
atgctgtcctggaacctgcccttcagccccatccagctggccaacaacttcctgacctctgtgctggagcagcacaagctgaccaaggagcagtgggaggagcgcatccagaactggcatgaggagcaccggggcatgctgagagaagattccatgatggagtacctgaagatcgcccaggacctggagatgtatggagtgaactactttgagatcaagaacaagaagggcacagagctgtggctgggcgtggatgccctgggcctgaacatctatgaacatgatgacaagctgacccccaagattggcttcccctggagcgagatccggaacatctccttcaatgacaagaagtttgtgatcaagcccatcgacaagaaggccccagactttgtgttctacgccccccggctgcgcatcaacaagaggatcctggccctgtgcatgggcaaccacgagctgtacatgagaagaaggaagccagacaccatcgaggtgcagcagatgaaggcccaggcccgggaggagaagcaccagaagcagctggagcgggcccagctggagaatgagaagaagaagcgggagattgctgagaaggagaaggagcgcatcgagcgggagaaggaggagctgatggagcggctgaagcagatcgaggagcagaccatcaaggcccagaaggagctggaggagcagaccaggaaggccctggagctggaccaggagaggaagagggccaaggaggaggccgagcggctggagaaggagaggagagctgctgaggaggccaagagcgccatcgccaagcaggccgctgaccagatgaagaaccaggagcagctggccgctgagctggccgagttcaccgccaagatcgccctgctggaggaggccaagaagaagaaggaggaggaggccacagagtggcagcacaaggcctttgctgcccaggaggacctggagaagaccaaggaggagctgaagacagtgatgtctgcccctcctcctcctcctcctcctcctgtgatccccccaacagaaaatgaacatgatgaacatgatgaaaataatgctgaggccagcgctgagctgagcaatgaaggagtgatgaaccacaggtctgaggaggagcgggtgacagagacccagaagaatgaaagagtgaagaagcagctgcaggccctgagcagcgagctggcccaggccagagatgagaccaagaagacccagaatgatgtgctgcacgcagaaaatgtgaaggccggccgggacaagtacaagaccctgcggcagatccggcagggcaacaccaagcagagaattgatgaatttgaggccatgtag

SEQ ID NO: 21526 - DNA, 3234 bp, Artificial Sequence
  Description of Artificial Sequence: Synthetic coding sequence
atggacacagacagccagaggagccacctgagcagcttcaccatgaagctgatggacaagttccacagccccaagatcaagaggacccccagcaagaagggcaagccagctgaggtgtctgtgaagatccctgagaagcctgtgaacaaggaggccacagaccgcttcctgcctgagggctaccccctgcccctggacctggagcagcaggccgtggagttcatgagcaccagcgctgtggccagccgcagccagaggcagaagaacctgtcctggctggaggagaaggagaaggaggtggtgtctgccctgcgctacttcaagaccatcgtggacaagatggccatcgacaagaaggtgctggagatgctgcccggcagcgccagcaaggtgctggaggccatcctgcccctggtgcagaatgacccccgcatccagcacagcagcgccctgagcagctgctacagccgggtgtaccagagcctggccaacctgatccgctggagcgaccaggtgatgctggagggcgtgaacagcgaggacaaggagatggtgaccaccgtgaagggcgtcatcaaggctgtgctggatggagtgaaggagctggtgcggctgaccatcgagaagcagggccggcccagccccaccagccctgtgaagcccagcagccctgccagcaagccagatggccctgctgagctgcccctgacagaccgggaggtggagatcctgaacaagaccaccggcatgagccagagcacagagctgctgcctgatgccacagatgaggaggtggccccacccaagccacccctgcccggcatccgggtggtggacaacagccccccaccagccctgccccccaagaagaggcagagcgcccccagccccaccagggtggccgtggtggcccccatgagccgggccaccagcggcagcagcctgcctgtgggcatcaaccggcaggactttgatgtggactgctacgcccagaggcggctgagcggcggcagccacagctatggaggagagagcccccggctgagcccctgcagcagcatcggcaagctgagcaagagtgatgagcagctgagcagcctggaccgggacagcggccagtgcagcaggaacaccagctgtgagaccctggaccactatgaccctgactatgagttcctgcagcaggacctgagcaatgctgaccagatcccccagcagacagcctggaacctgagccccctgcctgagagcctgggggagagcggcagccccttcctgggcccccccttccagctgcccctgggcggccacccccagccagatggccccctggcccctggccagcagacagacaccccaccagccctgcctgagaagaagagaagatctgctgccagccagacagcagatggcagcggctgccgggtgtcctatgaaagacaccccagccagtatgacaacatctctggagaggacctgcagagcacagcccccatccccagcgtgccctatgccccctttgctgccatcctgcccttccagcacggcggcagcagcgcccctgtggagtttgtgggggacttcaccgcccctgagagcactggagaccctgagaagcccccacccctgcctgagaagaagaacaagcacatgctggcctacatgcagctgctggaggactacagcgagccccagcccagcatgttctaccagaccccccagaatgagcacatctaccagcagaagaacaagctgctgatggaggtgtatggcttcagtgacagcttctctggagtggacagcgtgcaggagctggcccctcctccagccctgccccccaagcagaggcagctggagcccccagctgggaaggatggccacccccgggaccccagcgctgtgtctggagtgcctgggaaggacagcagagatggcagcgagcgggcccccaagagcccagatgccctggagagcgcccagagcgaggaggaggtggatgagctgagcctgattgaccacaatgagatcatgagccggctgaccctgaagcaggagggagatgatggcccagatgtgcggggcggcagcggggacatcctgctggtgcacgccacagaaacagacaggaaggacctggtgctgtactgtgaggccttcctgaccacctaccgcaccttcatcagccctgaggagctgatcaagaagctgcagtaccgctatgagaagttcagcccctttgctgacaccttcaagaagagggtgtccaagaacaccttctttgtgctggtgcgggtggtggatgagctgtgcctggtggagctgacagaggagatcctgaagctgctgatggagctggtgttccggctggtgtgcaatggagagctgagcctggcccgggtgctgaggaagaacatcctggacaaggtggaccagaagaagctgctgcgctgtgccaccagcagccagcccctggccgcccggggcgtggccgcccggcccggcaccctgcatgacttccacagccatgaaattgctgagcagctgaccctgctggatgctgagctgttctacaagattgagatccctgaggtgctgctgtgggccaaggagcagaatgaggagaagagccccaacctgacccagttcacagagcacttcaacaacatgagctactgggtgcgcagcatcatcatgctgcaggagaaggcccaggaccgggagcggctgctgctgaagttcatcaagatcatgaagcacctgaggaagctgaacaacttcaacagctacctggccatcctgagcgccctggacagcgcccccatccggcggctggagtggcagaagcagaccagcgagggcctggccgagtactgcaccctgattgacagcagcagcagcttccgggcctaccgggccgccctgtctgaggtggagcccccctgcatcccctacctgggcctcatcctgcaggacctgacctttgtgcacctgggcaacccagactacattgatggcaaggtgaacttcagcaagcgctggcagcagttcaacatcctggacagcatgcgctgcttccagcaggcccactatgacatgagaagaaatgatgacatcatcaacttcttcaatgacttcagtgaccacctggccgaggaggccctgtgggagctgagcctgaagatcaagcccaggaacatcaccaggaggaagacagaccgggaggagaagacctag

SEQ ID NO: 21527 - DNA, 3168 bp, Artificial Sequence
  Description of Artificial Sequence: Synthetic coding sequence
atgagcaccagcgctgtggccagccgcagccagaggcagaagaacctgtcctggctggaggagaaggagaaggaggtggtgtctgccctgcgctacttcaagaccatcgtggacaagatggccatcgacaagaaggtgctggagatgctgcccggcagcgccagcaaggtgctggaggccatcctgcccctggtgcagaatgacccccgcatccagcacagcagcgccctgagcagctgctacagccgggtgtaccagagcctggccaacctgatccgctggagcgaccaggtgatgctggagggcgtgaacagcgaggacaaggagatggtgaccaccgtgaagggcgtcatcaaggctgtgctggatggagtgaaggagctggtgcggctgaccatcgagaagcagggccggcccagccccaccagccctgtgaagcccagcagccctgccagcaagccagatggccctgctgagctgcccctgacagaccgggaggtggagatcctgaacaagaccaccggcatgagccagagcacagagctgctgcctgatgccacagatgaggaggtggccccacccaagccacccctgcccggcatccgggtggtggacaacagccccccaccagccctgccccccaagaagaggcagagcgcccccagccccaccagggtggccgtggtggcccccatgagccgggccaccagcggcagcagcctgcctgtgggcatcaaccggcaggactttgatgtggactgctacgcccagaggcggctgagcggcggcagccacagctatggaggagagagcccccggctgagcccctgcagcagcatcggcaagctgagcaagagtgatgagcagctgagcagcctggaccgggacagcggccagtgcagcaggaacaccagctgtgagaccctggaccactatgaccctgactatgagttcctgcagcaggacctgagcaatgctgaccagatcccccagcagacagcctggaacctgagccccctgcctgagagcctgggggagagcggcagccccttcctgggcccccccttccagctgcccctgggcggccacccccagccagatggccccctggcccctggccagcagacagacaccccaccagccctgcctgagaagaagagaagatctgctgccagccagacagcagatggcagcggctgccgggtgtcctatgaaagacaccccagccagtatgacaacatctctggagaggacctgcagagcacagcccccatccccagcgtgccctatgccccctttgctgccatcctgcccttccagcacggcggcagcagcgcccctgtggagtttgtgggggacttcaccgcccctgagagcactggagaccctgagaagcccccacccctgcctgagaagaagaacaagcacatgctggcctacatgcagctgctggaggactacagcgagccccagcccagcatgttctaccagaccccccagaatgagcacatctaccagcagaagaacaagctgctgatggaggtgtatggcttcagtgacagcttctctggagtggacagcgtgcaggagctggcccctcctccagccctgccccccaagcagaggcagctggccagctgtgccgccagcagcttcagctctgtgagccactgtgtgcagcagaccaaggtggccttcaccccagaagatggcagcgctgcccagggcctgtctgtgtctgtgagcaacagcttcctgagcagacatggcagcctgcctgtgcccagcgagcccccagctgggaaggatggccacccccgggaccccagcgctgtgtctggagtgcctgggaaggacagcagagatggcagcgagcgggcccccaagagcccagatgccctggagagcgcccagagcgaggaggaggtggatgagctgagcctgattgaccacaatgagatcatgagccggctgaccctgaagcaggagggagatgatggcccagatgtgcggggcggcagcggggacatcctgctggtgcacgccacagaaacagacaggaaggacctggtgctgtactgtgaggccttcctgaccacctaccgcaccttcatcagccctgaggagctgatcaagaagctgcagtaccgctatgagaagttcagcccctttgctgacaccttcaagaagagggtgtccaagaacaccttctttgtgctggtgcgggtggtggatgagctgtgcctggtggagctgacagaggagatcctgaagctgctgatggagctggtgttccggctggtgtgcaatggagagctgagcctggcccgggtgctgaggaagaacatcctggacaaggtggaccagaagaagctgctgcgctgtgccaccagcagccagcccctggccgcccggggcgtggccgcccggcccggcaccctgcatgacttccacagccatgaaattgctgagcagctgaccctgctggatgctgagctgttctacaagattgagatccctgaggtgctgctgtgggccaaggagcagaatgaggagaagagccccaacctgacccagttcacagagcacttcaacaacatgagctactgggtgcgcagcatcatcatgctgcaggagaaggcccaggaccgggagcggctgctgctgaagttcatcaagatcatgaagcacctgaggaagctgaacaacttcaacagctacctggccatcctgagcgccctggacagcgcccccatccggcggctggagtggcagaagcagaccagcgagggcctggccgagtactgcaccctgattgacagcagcagcagcttccgggcctaccgggccgccctgtctgaggtggagcccccctgcatcccctacctgggcctcatcctgcaggacctgacctttgtgcacctgggcaacccagactacattgatggcaaggtgaacttcagcaagcgctggcagcagttcaacatcctggacagcatgcgctgcttccagcaggcccactatgacatgagaagaaatgatgacatcatcaacttcttcaatgacttcagtgaccacctggccgaggaggccctgtgggagctgagcctgaagatcaagcccaggaacatcaccaggaggaagacagaccgggaggagaagacctag

SEQ ID NO: 21528 - DNA, 3285 bp, Artificial Sequence
  Description of Artificial Sequence: Synthetic coding sequence
atgtctgggggcctgggcctgcggcgcagccctgagatgtctgggaagattgagaaggctgacagccagaggagccacctgagcagcttcaccatgaagctgatggacaagttccacagccccaagatcaagaggacccccagcaagaagggcaagccagctgaggtgtctgtgaagatccctgagaagcctgtgaacaaggaggccacagaccgcttcctgcctgagggctaccccctgcccctggacctggagcagcaggccgtggagttcatgagcaccagcgctgtggccagccgcagccagaggcagaagaacctgtcctggctggaggagaaggagaaggaggtggtgtctgccctgcgctacttcaagaccatcgtggacaagatggccatcgacaagaaggtgctggagatgctgcccggcagcgccagcaaggtgctggaggccatcctgcccctggtgcagaatgacccccgcatccagcacagcagcgccctgagcagctgctacagccgggtgtaccagagcctggccaacctgatccgctggagcgaccaggtgatgctggagggcgtgaacagcgaggacaaggagatggtgaccaccgtgaagggcgtcatcaaggctgtgctggatggagtgaaggagctggtgcggctgaccatcgagaagcagggccggcccagccccaccagccctgtgaagcccagcagccctgccagcaagccagatggccctgctgagctgcccctgacagaccgggaggtggagatcctgaacaagaccaccggcatgagccagagcacagagctgctgcctgatgccacagatgaggaggtggccccacccaagccacccctgcccggcatccgggtggtggacaacagccccccaccagccctgccccccaagaagaggcagagcgcccccagccccaccagggtggccgtggtggcccccatgagccgggccaccagcggcagcagcctgcctgtgggcatcaaccggcaggactttgatgtggactgctacgcccagaggcggctgagcggcggcagccacagctatggaggagagagcccccggctgagcccctgcagcagcatcggcaagctgagcaagagtgatgagcagctgagcagcctggaccgggacagcggccagtgcagcaggaacaccagctgtgagaccctggaccactatgaccctgactatgagttcctgcagcaggacctgagcaatgctgaccagatcccccagcagacagcctggaacctgagccccctgcctgagagcctgggggagagcggcagccccttcctgggcccccccttccagctgcccctgggcggccacccccagccagatggccccctggcccctggccagcagacagacaccccaccagccctgcctgagaagaagagaagatctgctgccagccagacagcagatggcagcggctgccgggtgtcctatgagcggcaccccagccagtatgacaacatcagcggggaggacctgcagagcacagcccccatccccagcgtgccctatgccccctttgctgccatcctgcccttccagcacggcggcagcagcgcccctgtggagtttgtgggggacttcaccgcccctgagagcactggagaccctgagaagcccccacccctgcctgagaagaagaacaagcacatgctggcctacatgcagctgctggaggactacagcgagccccagcccagcatgttctaccagaccccccagaatgagcacatctaccagcagaagaacaagctgctgatggaggtgtatggcttcagtgacagcttcagcggcgtggacagcgtgcaggagctggcccctcctccagccctgccccccaagcagaggcagctggagcccccagctgggaaggatggccacccccgggaccccagcgctgtgtctggagtgcctgggaaggacagcagagatggcagcgagcgggcccccaagagcccagatgccctggagagcgcccagagcgaggaggaggtggatgagctgagcctgattgaccacaatgagatcatgagccggctgaccctgaagcaggagggagatgatggcccagatgtgcggggcggcagcggggacatcctgctggtgcacgccacagaaacagacaggaaggacctggtgctgtactgtgaggccttcctgaccacctaccgcaccttcatcagccctgaggagctgatcaagaagctgcagtaccgctatgagaagttcagcccctttgctgacaccttcaagaagagggtgtccaagaacaccttctttgtgctggtgcgggtggtggatgagctgtgcctggtggagctgacagaggagatcctgaagctgctgatggagctggtgttccggctggtgtgcaatggagagctgagcctggcccgggtgctgaggaagaacatcctggacaaggtggaccagaagaagctgctgcgctgtgccaccagcagccagcccctggccgcccggggcgtggccgcccggcccggcaccctgcatgacttccacagccatgaaattgctgagcagctgaccctgctggatgctgagctgttctacaagattgagatccctgaggtgctgctgtgggccaaggagcagaatgaggagaagagccccaacctgacccagttcacagagcacttcaacaacatgagctactgggtgcgcagcatcatcatgctgcaggagaaggcccaggaccgggagcggctgctgctgaagttcatcaagatcatgaagcacctgaggaagctgaacaacttcaacagctacctggccatcctgagcgccctggacagcgcccccatccggcggctggagtggcagaagcagaccagcgagggcctggccgagtactgcaccctgattgacagcagcagcagcttccgggcctacagagctgccctgtctgaggtggagcccccctgcatcccctacctgggcctcatcctgcaggacctgacctttgtgcacctgggcaacccagactacattgatggcaaggtgaacttcagcaagcgctggcagcagttcaacatcctggacagcatgcgctgcttccagcaggcccactatgacatgagaagaaatgatgacatcatcaacttcttcaatgacttcagtgaccacctggccgaggaggccctgtgggagctgagcctgaagatcaagcccaggaacatcaccaggaggaagacagaccgggaggagaagacctag

SEQ ID NO: 21529 - DNA, 3234 bp, Artificial Sequence; identical to SEQ ID NO: 21526
  Description of Artificial Sequence: Synthetic coding sequence

SEQ ID NO: 21530 - DNA, 3288 bp, Artificial Sequence
  Description of Artificial Sequence: Synthetic coding sequence
atgggaaatgccatcgagaagcagaagcccctgaagaggagccacctgtacccctggaagcaggacagccagaggagccacctgagcagcttcaccatgaagctgatggacaagttccacagccccaagatcaagaggacccccagcaagaagggcaagccagctgaggtgtctgtgaagatccctgagaagcctgtgaacaaggaggccacagaccgcttcctgcctgagggctaccccctgcccctggacctggagcagcaggccgtggagttcatgagcaccagcgctgtggccagccgcagccagaggcagaagaacctgtcctggctggaggagaaggagaaggaggtggtgtctgccctgcgctacttcaagaccatcgtggacaagatggccatcgacaagaaggtgctggagatgctgcccggcagcgccagcaaggtgctggaggccatcctgcccctggtgcagaatgacccccgcatccagcacagcagcgccctgagcagctgctacagccgggtgtaccagagcctggccaacctgatccgctggagcgaccaggtgatgctggagggcgtgaacagcgaggacaaggagatggtgaccaccgtgaagggcgtcatcaaggctgtgctggatggagtgaaggagctggtgcggctgaccatcgagaagcagggccggcccagccccaccagccctgtgaagcccagcagccctgccagcaagccagatggccctgctgagctgcccctgacagaccgggaggtggagatcctgaacaagaccaccggcatgagccagagcacagagctgctgcctgatgccacagatgaggaggtggccccacccaagccacccctgcccggcatccgggtggtggacaacagccccccaccagccctgccccccaagaagaggcagagcgcccccagccccaccagggtggccgtggtggcccccatgagccgggccaccagcggcagcagcctgcctgtgggcatcaaccggcaggactttgatgtggactgctacgcccagaggcggctgagcggcggcagccacagctatggaggagagagcccccggctgagcccctgcagcagcatcggcaagctgagcaagagtgatgagcagctgagcagcctggaccgggacagcggccagtgcagcaggaacaccagctgtgagaccctggaccactatgaccctgactatgagttcctgcagcaggacctgagcaatgctgaccagatcccccagcagacagcctggaacctgagccccctgcctgagagcctgggggagagcggcagccccttcctgggcccccccttccagctgcccctgggcggccacccccagccagatggccccctggcccctggccagcagacagacaccccaccagccctgcctgagaagaagagaagatctgctgccagccagacagcagatggcagcggctgccgggtgtcctatgaaagacaccccagccagtatgacaacatctctggagaggacctgcagagcacagcccccatccccagcgtgccctatgccccctttgctgccatcctgcccttccagcacggcggcagcagcgcccctgtggagtttgtgggggacttcaccgcccctgagagcactggagaccctgagaagcccccacccctgcctgagaagaagaacaagcacatgctggcctacatgcagctgctggaggactacagcgagccccagcccagcatgttctaccagaccccccagaatgagcacatctaccagcagaagaacaagctgctgatggaggtgtatggcttcagtgacagcttctctggagtggacagcgtgcaggagctggcccctcctccagccctgccccccaagcagaggcagctggagcccccagctgggaaggatggccacccccgggaccccagcgctgtgtctggagtgcctgggaaggacagcagagatggcagcgagcgggcccccaagagcccagatgccctggagagcgcccagagcgaggaggaggtggatgagctgagcctgattgaccacaatgagatcatgagccggctgaccctgaagcaggagggagatgatggcccagatgtgcggggcggcagcggggacatcctgctggtgcacgccacagaaacagacaggaaggacctggtgctgtactgtgaggccttcctgaccacctaccgcaccttcatcagccctgaggagctgatcaagaagctgcagtaccgctatgagaagttcagcccctttgctgacaccttcaagaagagggtgtccaagaacaccttctttgtgctggtgcgggtggtggatgagctgtgcctggtggagctgacagaggagatcctgaagctgctgatggagctggtgttccggctggtgtgcaatggagagctgagcctggcccgggtgctgaggaagaacatcctggacaaggtggaccagaagaagctgctgcgctgtgccaccagcagccagcccctggccgcccggggcgtggccgcccggcccggcaccctgcatgacttccacagccatgaaattgctgagcagctgaccctgctggatgctgagctgttctacaagattgagatccctgaggtgctgctgtgggccaaggagcagaatgaggagaagagccccaacctgacccagttcacagagcacttcaacaacatgagctactgggtgcgcagcatcatcatgctgcaggagaaggcccaggaccgggagcggctgctgctgaagttcatcaagatcatgaagcacctgaggaagctgaacaacttcaacagctacctggccatcctgagcgccctggacagcgcccccatccggcggctggagtggcagaagcagaccagcgagggcctggccgagtactgcaccctgattgacagcagcagcagcttccgggcctaccgggccgccctgtctgaggtggagcccccctgcatcccctacctgggcctcatcctgcaggacctgacctttgtgcacctgggcaacccagactacattgatggcaaggtgaacttcagcaagcgctggcagcagttcaacatcctggacagcatgcgctgcttccagcaggcccactatgacatgagaagaaatgatgacatcatcaacttcttcaatgacttcagtgaccacctggccgaggaggccctgtgggagctgagcctgaagatcaagcccaggaacatcaccaggaggaagacagaccgggaggagaagacctag

SEQ ID NO: 21531 - DNA, 1395 bp, Artificial Sequence
  Description of Artificial Sequence: Synthetic coding sequence
atgagccgggccaccagcggcagcagcctgcctgtgggcatcaaccggcaggactttgatgtggactgctacgcccagaggcggctgagcggcggcagccacagctatggaggagagagcccccggctgagcccctgcagcagcatcggcaagctgagcaagagtgatgagcagctgagcagcctggaccgggacagcggccagtgcagcaggaacaccagctgtgagaccctggaccactatgaccctgactatgagttcctgcagcaggacctgagcaatgctgaccagatcccccagcagacagcctggaacctgagccccctgcctgagagcctgggggagagcggcagccccttcctgggcccccccttccagctgcccctgggcggccacccccagccagatggccccctggcccctggccagcagacagacaccccaccagccctgcctgagaagaagagaagatctgctgccagccagacagcagatggcagcggctgccgggtgtcctatgagcggcaccccagccagtatgacaacatcagcggggaggacctgcagagcacagcccccatccccagcgtgccctatgccccctttgctgccatcctgcccttccagcacggcggcagcagcgcccctgtggagtttgtgggggacttcaccgcccctgagagcactggagaccctgagaagcccccacccctgcctgagaagaagaacaagcacatgctggcctacatgcagctgctggaggactacagcgagccccagcccagcatgttctaccagaccccccagaatgagcacatctaccagcagaagaacaagctgctgatggaggtgtatggcttcagtgacagcttcagcggcgtggacagcgtgcaggagctggcccctcctccagccctgccccccaagcagaggcagctgcaggccagctgtgccgccagcagcttcagctctgtgagccactgtgtgcagcagaccaaggtggccttcaccccagaagatggcagcgctgcccagggcctgtctgtgtctgtgagcaacagcttcctgagcagacatggcagcctgcctgtgcccagctacaagtctgtgttccgcagctacagccaggactttgtgccccaccaccaggcctctgtgccccccttcctgccccccaccagcagcagcagcccccacttccccccagcccaccagagccagagcagtgacctggccgtgcccaccatggccggccccccacccagcacagtggatggccccctgagcgccagccaggagagcagcttccacggcaacacagtgtgcctgcccagcgagaccagcttcacagacagcgagcccccagctgggaaggatggccacccccgggactag

SEQ ID NO: 21532 - DNA, 3285 bp, Artificial Sequence; identical to SEQ ID NO: 21528
  Description of Artificial Sequence: Synthetic coding sequence

SEQ ID NO: 21533 - DNA, 1011 bp, Artificial Sequence
  Description of Artificial Sequence: Synthetic coding sequence
atggaggtgtatggcttcagtgacagcttctctggagtggacagcgtgcaggagctggcccctcctccagccctgccccccaagcagaggcagctgtctgaaaatgccagcgaggaggccggggagggggagtatgtgaacctgtacagcagcggccagagcagcgaggagctggcccccagcagaggagagcccccagctgggaaggatggccacccccgggaccccagcgctgtgtctggagtgcctgggaaggacagcagagatggcagcgagcgggcccccaagagcccagatgccctggagagcgcccagagcgaggaggaggtggatgagctgagcctgattgaccacaatgagatcatgagccggctgaccctgaagcaggagggagatgatggcccagatgtgcggggcggcagcggggacatcctgctggtgcacgccacagaaacagacaggaaggacctggtgctgtactgtgaggccttcctgaccacctaccgcaccttcatcagccctgaggagctgatcaagaagctgcagtaccgctatgagaagttcagcccctttgctgacaccttcaagaagagggtgtccaagaacaccttctttgtgctggtgcgggtggtggatgagctgtgcctggtggagctgacagaggagatcctgaagctgctgatggagctggtgttccggctggtgtgcaatggagagctgagcctggcccgggtgctgaggaagaacatcctggacaaggtggaccagaagaagctgctgcgctgtgccaccagcagccagcccctggccgcccggggcgtggccgcccggcccggcaccctgcatgacttccacagccatgaaattgctgagcagctgaccctgctggatgctgagctgttctacaagattgagatccctgaggtgctgctgtgggccaaggagcagaatgaggagaagagccccaacctgacccagttcacagagcacttcaacaacatgagctactag

SEQ ID NO: 21534 - DNA, 3174 bp, Artificial Sequence
  Description of Artificial Sequence: Synthetic coding sequence
atgggaaatgccatcgagaagcagaagcccctgaagaggagccacctgtacccctggaagcaggacagccagaggagccacctgagcagcttcaccatgaagctgatggacaagttccacagccccaagatcaagaggacccccagcaagaagggcaagccagctgaggtgtctgtgaagatccctgagaagcctgtgaacaagaacctgtcctggctggaggagaaggagaaggaggtggtgtctgccctgcgctacttcaagaccatcgtggacaagatggccatcgacaagaaggtgctggagatgctgcccggcagcgccagcaaggtgctggaggccatcctgcccctggtgcagaatgacccccgcatccagcacagcagcgccctgagcagctgctacagccgggtgtaccagagcctggccaacctgatccgctggagcgaccaggtgatgctggagggcgtgaacagcgaggacaaggagatggtgaccaccgtgaagggcgtcatcaaggctgtgctggatggagtgaaggagctggtgcggctgaccatcgagaagcagggccggcccagccccaccagccctgtgaagcccagcagccctgccagcaagccagatggccctgctgagctgcccctgacagaccgggaggtggagatcctgaacaagaccaccggcatgagccagagcacagagctgctgcctgatgccacagatgaggaggtggccccacccaagccacccctgcccggcatccgggtggtggacaacagccccccaccagccctgccccccaagaagaggcagagcgcccccagccccaccagggtggccgtggtggcccccatgagccgggccaccagcggcagcagcctgcctgtgggcatcaaccggcaggactttgatgtggactgctacgcccagaggcggctgagcggcggcagccacagctatggaggagagagcccccggctgagcccctgcagcagcatcggcaagctgagcaagagtgatgagcagctgagcagcctggaccgggacagcggccagtgcagcaggaacaccagctgtgagaccctggaccactatgaccctgactatgagttcctgcagcaggacctgagcaatgctgaccagatcccccagcagacagcctggaacctgagccccctgcctgagagcctgggggagagcggcagccccttcctgggcccccccttccagctgcccctgggcggccacccccagccagatggccccctggcccctggccagcagacagacaccccaccagccctgcctgagaagaagagaagatctgctgccagccagacagcagatggcagcggctgccgggtgtcctatgaaagacaccccagccagtatgacaacatctctggagaggacctgcagagcacagcccccatccccagcgtgccctatgccccctttgctgccatcctgcccttccagcacggcggcagcagcgcccctgtggagtttgtgggggacttcaccgcccctgagagcactggagaccctgagaagcccccacccctgcctgagaagaagaacaagcacatgctggcctacatgcagctgctggaggactacagcgagccccagcccagcatgttctaccagaccccccagaatgagcacatctaccagcagaagaacaagctgctgatggaggtgtatggcttcagtgacagcttctctggagtggacagcgtgcaggagctggcccctcctccagccctgccccccaagcagaggcagctggagcccccagctgggaaggatggccacccccgggaccccagcgctgtgtctggagtgcctgggaaggacagcagagatggcagcgagcgggcccccaagagcccagatgccctggagagcgcccagagcgaggaggaggtggatgagctgagcctgattgaccacaatgagatcatgagccggctgaccctgaagcaggagggagatgatggcccagatgtgcggggcggcagcggggacatcctgctggtgcacgccacagaaacagacaggaaggacctggtgctgtactgtgaggccttcctgaccacctaccgcaccttcatcagccctgaggagctgatcaagaagctgcagtaccgctatgagaagttcagcccctttgctgacaccttcaagaagagggtgtccaagaacaccttctttgtgctggtgcgggtggtggatgagctgtgcctggtggagctgacagaggagatcctgaagctgctgatggagctggtgttccggctggtgtgcaatggagagctgagcctggcccgggtgctgaggaagaacatcctggacaaggtggaccagaagaagctgctgcgctgtgccaccagcagccagcccctggccgcccggggcgtggccgcccggcccggcaccctgcatgacttccacagccatgaaattgctgagcagctgaccctgctggatgctgagctgttctacaagattgagatccctgaggtgctgctgtgggccaaggagcagaatgaggagaagagccccaacctgacccagttcacagagcacttcaacaacatgagctactgggtgcgcagcatcatcatgctgcaggagaaggcccaggaccgggagcggctgctgctgaagttcatcaagatcatgaagcacctgaggaagctgaacaacttcaacagctacctggccatcctgagcgccctggacagcgcccccatccggcggctggagtggcagaagcagaccagcgagggcctggccgagtactgcaccctgattgacagcagcagcagcttccgggcctaccgggccgccctgtctgaggtggagcccccctgcatcccctacctgggcctcatcctgcaggacctgacctttgtgcacctgggcaacccagactacattgatggcaaggtgaacttcagcaagcgctggcagcagttcaacatcctggacagcatgcgctgcttccagcaggcccactatgacatgagaagaaatgatgacatcatcaacttcttcaatgacttcagtgaccacctggccgaggaggccctgtgggagctgagcctgaagatcaagcccaggaacatcaccaggaggaagacagaccgggaggagaagacctag

SEQ ID NO: 21535 - DNA, 960 bp, Artificial Sequence
  Description of Artificial Sequence: Synthetic coding sequence
tgactggcccctcctccagccctgccccccaagcagaggcagctgtctgaaaatgccagcgaggaggccggggagggggagtatgtgaacctgtacagcagcggccagagcagcgaggagctggcccccagcagaggagagcccccagctgggaaggatggccacccccgggaccccagcgctgtgtctggagtgcctgggaaggacagcagagatggcagcgagcgggcccccaagagcccagatgccctggagagcgcccagagcgaggaggaggtggatgagctgagcctgattgaccacaatgagatcatgagccggctgaccctgaagcaggagggagatgatggcccagatgtgcggggcggcagcggggacatcctgctggtgcacgccacagaaacagacaggaaggacctggtgctgtactgtgaggccttcctgaccacctaccgcaccttcatcagccctgaggagctgatcaagaagctgcagtaccgctatgagaagttcagcccctttgctgacaccttcaagaagagggtgtccaagaacaccttctttgtgctggtgcgggtggtggatgagctgtgcctggtggagctgacagaggagatcctgaagctgctgatggagctggtgttccggctggtgtgcaatggagagctgagcctggcccgggtgctgaggaagaacatcctggacaaggtggaccagaagaagctgctgcgctgtgccaccagcagccagcccctggccgcccggggcgtggccgcccggcccggcaccctgcatgacttccacagccatgaaattgctgagcagctgaccctgctggatgctgagctgttctacaagattgagatccctgaggtgctgctgtgggccaaggagcagaatgaggagaagagccccaacctgacccagttcacagagcacttcaacaacatgagctactag

SEQ ID NO: 21536 - DNA, 687 bp, Artificial Sequence
  Description of Artificial Sequence: Synthetic coding sequence
tgactgcctgagaagaagaacaagcacatgctggcctacatgcagctgctggaggactacagcgagccccagcccagcatgttctaccagaccccccagaatgagcacatctaccagcagaagaacaagctgctgatggaggtgtatggcttcagtgacagcttcagcggcgtggacagcgtgcaggagctggcccctcctccagccctgccccccaagcagaggcagctgcaggccagctgtgccgccagcagcttcagctctgtgagccactgtgtgcagcagaccaaggtggccttcaccccagaagatggcagcgctgcccagggcctgtctgtgtctgtgagcaacagcttcctgagcagacatggcagcctgcctgtgcccagctacaagtctgtgttccgcagctacagccaggactttgtgccccaccaccaggcctctgtgccccccttcctgccccccaccagcagcagcagcccccacttccccccagcccaccagagccagagcagtgacctggccgtgcccaccatggccggccccccacccagcacagtggatggccccctgagcgccagccaggagagcagcttccacggcaacacagtgtgcctgcccagcgagaccagcttcacagacagcgagcccccagctgggaaggatggccacccccgggactag

SEQ ID NO: 21537 - DNA, 582 bp, Artificial Sequence
  Description of Artificial Sequence: Synthetic coding sequence
atgggaaatgccatcgagaagcagaagcccctgaagaggagccacctgtacccctggaagcaggacagccagaggagccacctgagcagcttcaccatgaagctgatggacaagttccacagccccaagatcaagaggacccccagcaagaagggcaagccagctgaggtgtctgtgaagatccctgagaagcctgtgaacaaggaggccacagaccgcttcctgcctgagggctaccccctgcccctggacctggagcagcaggccgtggagttcatgagcaccagcgctgtggccagccgcagccagaggcagaagaacctgtcctggctggaggagaaggagaaggaggtggtgtctgccctgcgctacttcaagaccatcgtggacaagatggccatcgacaagaaggtgctggagatgctgcccggcagcgccagcaaggtgctggaggccatcctgcccctggtgcagaatgacccccgcatccagcacagcagcgccctgagcagctgctacagccgggtgtaccagagcctggccaacctgatccgctggagcgaccaggtgatgctggagtag

SEQ ID NO: 21538 - DNA, 3072 bp, Artificial Sequence
  Description of Artificial Sequence: Synthetic coding sequence
ttcaagaccatcgtggacaagatggccatcgacaagaaggtgctggagatgctgcccggcagcgccagcaaggtgctggaggccatcctgcccctggtgcagaatgacccccgcatccagcacagcagcgccctgagcagctgctacagccgggtgtaccagagcctggccaacctgatccgctggagcgaccaggtgatgctggagggcgtgaacagcgaggacaaggagatggtgaccaccgtgaagggcgtcatcaaggctgtgctggatggagtgaaggagctggtgcggctgaccatcgagaagcagggccggcccagccccaccagccctgtgaagcccagcagccctgccagcaagccagatggccctgctgagctgcccctgacagaccgggaggtggagatcctgaacaagaccaccggcatgagccagagcacagagctgctgcctgatgccacagatgaggaggtggccccacccaagccacccctgcccggcatccgggtggtggacaacagccccccaccagccctgccccccaagaagaggcagagcgcccccagccccaccagggtggccgtggtggcccccatgagccgggccaccagcggcagcagcctgcctgtgggcatcaaccggcaggactttgatgtggactgctacgcccagaggcggctgagcggcggcagccacagctatggaggagagagcccccggctgagcccctgcagcagcatcggcaagctgagcaagagtgatgagcagctgagcagcctggaccgggacagcggccagtgcagcaggaacaccagctgtgagaccctggaccactatgaccctgactatgagttcctgcagcaggacctgagcaatgctgaccagatcccccagcagacagcctggaacctgagccccctgcctgagagcctgggggagagcggcagccccttcctgggcccccccttccagctgcccctgggcggccacccccagccagatggccccctggcccctggccagcagacagacaccccaccagccctgcctgagaagaagagaagatctgctgccagccagacagcagatggcagcggctgccgggtgtcctatgaaagacaccccagccagtatgacaacatctctggagaggacctgcagagcacagcccccatccccagcgtgccctatgccccctttgctgccatcctgcccttccagcacggcggcagcagcgcccctgtggagtttgtgggggacttcaccgcccctgagagcactggagaccctgagaagcccccacccctgcctgagaagaagaacaagcacatgctggcctacatgcagctgctggaggactacagcgagccccagcccagcatgttctaccagaccccccagaatgagcacatctaccagcagaagaacaagctgctgatggaggtgtatggcttcagtgacagcttctctggagtggacagcgtgcaggagctggcccctcctccagccctgccccccaagcagaggcagctggccagctgtgccgccagcagcttcagctctgtgagccactgtgtgcagcagaccaaggtggccttcaccccagaagatggcagcgctgcccagggcctgtctgtgtctgtgagcaacagcttcctgagcagacatggcagcctgcctgtgcccagcgagcccccagctgggaaggatggccacccccgggaccccagcgctgtgtctggagtgcctgggaaggacagcagagatggcagcgagcgggcccccaagagcccagatgccctggagagcgcccagagcgaggaggaggtggatgagctgagcctgattgaccacaatgagatcatgagccggctgaccctgaagcaggagggagatgatggcccagatgtgcggggcggcagcggggacatcctgctggtgcacgccacagaaacagacaggaaggacctggtgctgtactgtgaggccttcctgaccacctaccgcaccttcatcagccctgaggagctgatcaagaagctgcagtaccgctatgagaagttcagcccctttgctgacaccttcaagaagagggtgtccaagaacaccttctttgtgctggtgcgggtggtggatgagctgtgcctggtggagctgacagaggagatcctgaagctgctgatggagctggtgttccggctggtgtgcaatggagagctgagcctggcccgggtgctgaggaagaacatcctggacaaggtggaccagaagaagctgctgcgctgtgccaccagcagccagcccctggccgcccggggcgtggccgcccggcccggcaccctgcatgacttccacagccatgaaattgctgagcagctgaccctgctggatgctgagctgttctacaagattgagatccctgaggtgctgctgtgggccaaggagcagaatgaggagaagagccccaacctgacccagttcacagagcacttcaacaacatgagctactgggtgcgcagcatcatcatgctgcaggagaaggcccaggaccgggagcggctgctgctgaagttcatcaagatcatgaagcacctgaggaagctgaacaacttcaacagctacctggccatcctgagcgccctggacagcgcccccatccggcggctggagtggcagaagcagaccagcgagggcctggccgagtactgcaccctgattgacagcagcagcagcttccgggcctaccgggccgccctgtctgaggtggagcccccctgcatcccctacctgggcctcatcctgcaggacctgacctttgtgcacctgggcaacccagactacattgatggcaaggtgaacttcagcaagcgctggcagcagttcaacatcctggacagcatgcgctgcttccagcaggcccactatgacatgagaagaaatgatgacatcatcaacttcttcaatgacttcagtgaccacctggccgaggaggccctgtgggagctgagcctgaagatcaagcccaggaacatcaccaggaggaagacagaccgggaggagaagacctag

SEQ ID NO: 21539 - DNA, 480 bp, Artificial Sequence
  Description of Artificial Sequence: Synthetic coding sequence
atggaggtgtatggcttcagtgacagcttctctggagtggacagcgtgcaggagctggcccctcctccagccctgccccccaagcagaggcagctgtacaagtctgtgttccgcagctacagccaggactttgtgccccaccaccaggcctctgtgccccccttcctgccccccaccagcagcagcagcccccacttccccccagcccaccagagccagagcagtgacctggccgtgcccaccatggccggccccccacccagcacagtggatggccccctgagcgccagccaggagagcagcttccacggcaacacagtgtgcctgcccagcgagaccagcttcacagacagcgagcccccagctgggaaggatggccacccccgggaccccagcgctgtgtctggagtgcctgggaaggacagcagagatggcagcgagcgggcccccaagagcccagatgccctggagagcgcctag

SEQ ID NO: 21540 - DNA, 696 bp, Artificial Sequence
  Description of Artificial Sequence: Synthetic coding sequence
atggaggtgtatggcttcagtgacagcttctctggagtggacagcgtgcaggagctggcccctcctccagccctgccccccaagcagaggcagctgcaggccagctgtgccgccagcagcttcagctctgtgagccactgtgtgcagcagaccaaggtggccttcaccccagaagatggcagcgctgcccagggcctgtctgtgtctgtgagcaacagcttcctgagccgccacggcagcctgcctgtgcccagctacaagagcgtcttccgcagctacagccaggactttgtgccccaccaccaggcctctgtgccccccttcctgccccccaccagcagcagcagcccccacttccccccagcccaccagagccagagcagtgacctggccgtgcccaccatggccggccccccacccagcacagtggatggccccctgagcgccagccaggagagcagcttccacggcaacacagtgtgcctgcccagcgagaccagcttcacagacagcagtgaaaatgccagcgaggaggccggggagggggagtatgtgaacctgtacagcagcggccagagcagcgaggagctggcccccagcagaggagagcccccagctgggaaggatggccacccccgggaccccagcgctgtgtctggagtgcctgggaaggacagcagagatggcagcgagtag

SEQ ID NO: 21541 - DNA, 477 bp, Artificial Sequence
  Description of Artificial Sequence: Synthetic coding sequence
atgtctgggggcctgggcctgcggcgcagccctgagatgtctgggaagattgagaaggctgacagccagaggagccacctgagcagcttcaccatgaagctgatggacaagttccacagccccaagatcaagaggacccccagcaagaagggcaagccagctgaggtgtctgtgaagatccctgagaagcctgtgaacaagaacctgtcctggctggaggagaaggagaaggaggtggtgtctgccctgcgctacttcaagaccatcgtggacaagatggccatcgacaagaaggtgctggagatgctgcccggcagcgccagcaaggtgctggaggccatcctgcccctggtgcagaatgacccccgcatccagcacagcagcgccctgagcagctgctacagccgggtgtaccagagcctggccaacctgatccgctggagcgaccaggtgatgctggagggcgtgaacagctag

SEQ ID NO: 21542 - DNA, 261 bp, Artificial Sequence
  Description of Artificial Sequence: Synthetic coding sequence
atggaggtgtatggcttcagtgacagcttctctggagtggacagcgtgcaggagctggcccctcctccagccctgccccccaagcagaggcagctggagcccccagctgggaaggatggccacccccgggaccccagcgctgtgtctggagtgcctgggaaggacagcagagatggcagcgagagcggcatcacctctgtgtaccgctggaacatccagaggcagcagaggctgtcctatggccacacagccagccagtag

SEQ ID NO: 21543 - DNA, 7419 bp, Artificial Sequence
  Description of Artificial Sequence: Synthetic coding sequence
atgacagcccggggccagagccccctggcccccctgctggagaccctggaggaccccagcgccagccatggaggccagacagatgcctacctgaccctgaccagcaggatgaccggggaggagggcaaggaggtgatcacagaaattgagaagaagctgccccggctgtacaaggtgctgaagacccacatcagcagccagaacagcgagctgagcagcgctgccctgcaggccctgggcttctgcctgtacaaccccaagatcaccagcgagctgtctgaggccaatgccctggagctgctgagcaagctgaatgacaccatcaagaacagcgacaagaatgtgaggacccgggccctgtgggtgatcagcaagcagaccttccccagcgaggtggtgggcaagatggtgagcagcatcatcgacagcctggagatcctcttcaacaagggggagacccacagcgctgtggtggactttgaggccctgaatgtcatcgtgcggctcatcgagcaggcccccatccagatgggagaggaggccgtgcgctgggccaagctggtgatccccctggtggtgcacagcgcccagaaggtgcacctgcggggggccacagccctggagatgggcatgcccctgctgctgcagaagcagcaggagatcgccagcatcacagagcagctgatgaccaccaagctgatcagcgagctgcagaagctgttcatgagcaagaatgagacctacgtgctgaagctgtggcccctgtttgtgaagctgctgggccgcaccctgcacaggagcggcagcttcatcaacagcctgctgcagctggaggagctgggcttccgcagcggggcccccatgatcaagaagatcgccttcatcgcctggaagagcctgattgacaactttgccctgaacccagacatcctgtgcagcgccaagaggctgaagctgctgatgcagcccctgagcagcatccacgtgaggacagagaccctggccctgaccaagctggaggtgtggtggtacctgctgatgaggctgggcccccacctgcctgccaactttgagcaggtgtgtgtgcccctcatccagagcaccatcagcattgacagcaatgccagcccccagggcaacagctgccacgtggccaccagccctggcctgaaccccatgacccctgtgcacaagggggccagcagcccctacggggcccctggcacccccaggatgaacctgagcagcaacctgggcggcatggccaccatccccagcatccagctgctgggcctggagatgctgctgcacttcctgctgggccctgaggccctgagctttgccaagcagaacaagctggtgctgagcctggagcccctggagcaccccctcatcagcagccccagcttcttcagcaagcacgccaacaccctcatcacagctgtgcatgacagctttgtggccgtgggcaaggatgccccagatgtggtggtgtctgccatctggaaggagctgatcagcctggtgaagtctgtgacagaaagtggcaacaagaaggagaagccaggcagcgaggtgctgaccctgctgctgaagagcctggagagcatcgtgaagtctgaggtgtttcctgtgtccaagaccctggtgctgatggagatcaccatcaagggcctgccccagaaggtgctgggcagccctgcctaccaggtggccaacatggacatcctgaatggcaccccagccctcttcctgatccagctgatcttcaacaacttcctggagtgtggggtgtctgatgagcgcttcttcctgagcctggagagcctggtgggctgtgtgctgagcggccccaccagccccctggccttcagtgacagcgtgctgaatgtcatcaaccagaatgccaagcagctggagaacaaggagcacctgtggaagatgtggagcgtcatcgtgacccccctgacagagctgatcaaccagaccaatgaggtgaaccagggagatgccctggagcacaacttcagcgccatctacggggccctgaccctgcctgtgaaccacatcttcagcgagcagcgcttccctgtggccaccatgaagaccctgctgcggacctggagcgagctgtaccgggcctttgcccgctgtgccgccctggtggccacagctgaggagaacctgtgctgtgaggagctgagcagcaagatcatgagcagcctggaggatgagggcttcagcaacctgctgtttgtggaccgcatcatctacatcatcaccgtgatggtggactgcatcgacttcagcccctacaacatcaagtaccagcccaaggtgaagagcccccagaggcccagcgactggagcaagaagaagaatgagcccctgggcaagctgaccagcctcttcaagctgattgtgaaggtgatctacagcttccacaccctgtccttcaaggaggcccacagcgacaccctcttcaccatcggcaacagcatcaccggcatcatcagctctgtgctgggccacatcagcctgcccagcatgatcaggaagatctttgccaccctgacccggcccctggccctcttctatgagaacagcaagctggatgaggtgcccaaggtgtacagctgcctgaacaacaagctggagaagctgctgggggagatcatcgcctgcctgcagttctcctacacaggcacctatgacagcgagctgctggagcagctgagccccctgctgtgcatcatcttcctgcacaagaacaagcagatcaggaagcagagcgcccagttctggaatgccacctttgccaaggtgatgatgctggtgtacccagaggagctgaagcctgtgctgacccaggccaagcagaagttcctgctgctgctgcccggcctggagaccgtggagatgatggaggagagcagcggcccctacagtgatggaacagagaacagccagctgaatgtgaagatcagcggcatggagaggaagagcaatggcaagagggacagcttcctggcccagaccaagaacaagaaggagaacatgaagccagctgccaagctgaagctggagagcagcagcctgaaggtgaagggggagatcctgctggaggaggagaagagcacagactttgtgttcatccccccagagggcaaggatgccaaggagcgcatcctgacagaccaccagaaggaggtgctgaagaccaagagatgtgacatcccagccatgtacaacaacctggatgtgtcccaggacaccctcttcacccagtacagccaggaggagcccatggagatccccaccctgaccaggaagcccaaggaggacagcaagatgatgatcacagaggagcagatggacagcgacatcgtcatcccccaggatgtgacagaggactgtggcatggccgagcacctggagaagagcagcctgagcaacaatgaatgtggcagcctggacaagaccagccctgagatgagcaacagcaacaatgatgagaggaagaaggccctgatcagcagcaggaagaccagcacagaatgtgccagcagcacagagaacagctttgtggtgagcagcagctctgtgagcaacaccaccgtggccggcaccccaccctaccccaccagccggcggcagaccttcatcaccctggagaagtttgatggctctgaaaatcggcccttcagccccagccccctgaacaacatcagcagcacagtgacagtgaagaacaaccaggagaccatgatcaagacagacttcctgcccaaggccaagcagcgggagggcaccttcagcaagagtgacagcgagaagatcgtgaatggcaccaagaggagcagcagaagagctgggaaggccgagcagacaggcaacaagaggagcaagcccctgatgaggtctgagcctgagaagaacacagaggagagcgtggagggcatcgtggtgctggagaacaaccccccaggcctgctgaaccagacagaatgtgtgtctgacaaccaggtgcacctgtctgagagcaccatggagcatgacaacaccaagctgaaggccgccaccgtggagaatgctgtgctgctggagaccaacacagtggaggagaagaatgtggagatcaacctggagagcaaggagaacaccccacctgtggtgatctctgctgaccagatggtgaatgaagacagccaggtgcagatcacccccaaccagaagaccctgcggcgcagcagcagaagaagaagtgaggtggtggagagcaccacagagagccaggacaaggagaacagccaccagaagaaggagaggaggaaggaggaggagaagcccctgcagaagagccccctgcacatcaaggatgatgtgctgcccaagcagaagctgattgctgagcagaccctgcaggagaacctgattgagaagggcagcaacctgcacgagaagaccctgggggagaccagcgccaatgctgagacagagcagaacaagaagaaggctgaccctgagaacatcaagtcagaaggagatggcacccaggacatcgtggacaagagcagcgagaagctggtgcggggccgcacccgctaccagacccggcgggccagccagggcctgctgagcagcattgagaacagcgagagtgacagcagcgaggccaaggaggagggcagcaggaagaagaggtctgggaagtggaagaacaagagcaatgaatctgtggacatccaggaccaggaggagaaggtggtgaagcaggagtgcatcaaggccgagaaccagagccatgactacaaggccaccagcgaggaggatgtgtccatcaagagccccatctgtgagaagcaggatgagagcaacacagtcatctgccaggacagcacagtgaccagtgacctgctgcaggtgcctgatgacctgcccaacgtgtgtgaggagaagaatgagaccagcaaatatgcagagtacagcttcaccagcctgcctgtgcctgagagcaacctgcggaccagaaatgccatcaagaggctgcacaagagggacagctttgacaactgcagcctgggggagagcagcaagattggcatcagtgacatcagcagcctgtctgagaagaccttccagaccctggagtgccagcacaagaggagccggcgggtgagaagaagcaagggctgtgactgctgcggggagaagagccagccccaggagaagagcctgattggcctgaagaacacagaaaataatgatgtggagatcagcgagaccaagaaggcagatgtgcaggcccctgtgagccccagcgagaccagccaggccaacccctacagcgagggccagttcctggatgagcaccacagcgtgaacttccacctgggcctgaaggaggacaatgacaccatcaatgacagcctcatcgtgtctgagaccaagagcaaggagaacaccatgcaggagagcctgcccagcggcatcgtgaacttccgggaggagatctgtgacatggacagcagcgaggccatgagcctggagagccaggagagccccaatgaaaacttcaagacagtgggcccctgcctgggggacagcaagaatgtgtcccaggagagcctggagaccaaggaggagaagccagaggagacccccaagatggagctgagcctggagaatgtgacagtggagggcaatgcctgcaaggtgacagagagcaacctggagaaggccaagaccatggagctgaatgtgggcaatgaggccagcttccacggccaggagaggaccaagacaggcatcagcgaggaggccgccatcgaggagaacaagagaaatgatgacagcgaggccgacacagccaagctgaatgccaaggaggtggccacagaggagttcaacagcgacatcagcctgagtgacaacaccacccctgtgaagctgaatgcccagacagagatcagcgagcagacagctgctggggagctggatggcggcaatgatgtgtctgacctgcacagcagcgaggagaccaacaccaagatgaagaacaatgaggagatgatgattggagaggccatggccgagactggacatgatggagaaacagaaaatgaaggcatcaccaccaagaccagcaagccagatgaggccgagaccaacatgctgacagctgagatggacaactttgtgtgtgacacagtggagatgagcacagaggagggcatcattgatgccaacaagacagagaccaacacagagtacagcaagtctgaggagaagctggacaacaaccagatggtgatggagagtgacatcctgcaggaggaccaccacaccagccagaaggtggaggagcccagccagtgcctggccagcggcacagccatcagcgagctgatcatcgaggacaacaatgccagcccccagaagctgcgggagctggaccccagcctggtgtctgccaatgacagccccagcggcatgcagacccgctgtgtgtggagccccctggccagccccagcaccagcatcctgaagaggggcctgaagaggagccaggaggatgagatcagcagccctgtgaacaaggtgcggcgggtgtcctttgctgaccccatctaccaggccggcctggctgatgacatcgaccggcgctgcagcatcgtgcgcagccacagcagcaacagcagccccatcggcaagtctgtgaagaccagccccaccacccagagcaagcacaacaccaccagcgccaagggcttcctgagccctggcagccgcagccccaagttcaagagcagcaagaagtgcctgatcagcgagatggccaaggagagcatcccctgccccacagagagcgtgtacccacccctggtgaactgtgtggcccctgtggacatcatcctgccccagatcaccagcaacatgtgggcccggggcctgggccagctgatccgggccaagaacatcaagaccatcggggacctgagcaccctgacagccagcgagatcaagaccctgcccatccgcagccccaaggtgtccaatgtgaagaaggccctgcgcatctaccacgagcagcaggtgaagacccggggcctggaggagatccctgtgtttgacatcagcgagaagacagtgaatggaattgagaacaagagcctgagcccagatgaggagcggctggtgtctgacatcatcgaccctgtggccctggagatccccctgagcaagaacctgctggcccagatcagcgccctggccctgcagctggacagcgaggacctgcacaactacagcggcagccagctgtttgagatgcatgagaagctgagctgcatggccaacagcgtcatcaagaacctgcagagccgctggaggagccccagccatgaaaattccatctag

SEQ ID NO: 21544 - DNA, 264 bp, Artificial Sequence
  Description of Artificial Sequence: Synthetic coding sequence
atgacagcccggggccagagccccctggcccccctgctggagaccctggaggaccccagcgccagccatggaggccagacagatgcctacctgaccctgaccagcaggatgaccggggaggagggcaaggaggtgatcacagaaattgagaagaagctgccccggctgtacaaggtgctgaagacccacatcagcagccagaacagcgagctgagcagcgctgccctgcaggccctgggcttctgcctgtacaaccccaagtag

SEQ ID NO: 21545 - DNA, 7341 bp, Artificial Sequence
  Description of Artificial Sequence: Synthetic coding sequence
atgacagcccggggccagagccccctggcccccctgctggagaccctggaggaccccagcgccagccatggaggccagacagatgcctacctgaccctgaccagcaggatgaccggggaggagggcaaggaggtgatcacagaaattgagaagaagctgccccggctgtacaaggtgctgaagacccacatcagcagccagaacagcgagctgagcagcgctgccctgcaggccctgggcttctgcctgtacaaccccaagatcaccagcgagctgtctgaggccaatgccctggagctgctgagcaagctgaatgacaccatcaagaacagcgacaagaatgtgaggacccgggccctgtgggtgatcagcaagcagaccttccccagcgaggtggtgggcaagatggtgagcagcatcatcgacagcctggagatcctcttcaacaagggggagacccacagcgctgtggtggactttgaggccctgaatgtcatcgtgcggctcatcgagcaggcccccatccagatgggagaggaggccgtgcgctgggccaagctggtgatccccctggtggtgcacagcgcccagaaggtgcacctgcggggggccacagccctggagatgggcatgcccctgctgctgcagaagcagcaggagatcgccagcatcacagagcagctgatgaccaccaagctgatcagcgagctgcagaagctgttcatgagcaagaatgagacctacgtgctgaagctgtggcccctgtttgtgaagctgctgggccgcaccctgcacaggagcggcagcttcatcaacagcctgctgcagctggaggagctgggcttccgcagcggggcccccatgatcaagaagatcgccttcatcgcctggaagagcctgattgacaactttgccctgaacccagacatcctgtgcagcgccaagaggctgaagctgctgatgcagcccctgagcagcatccacgtgaggacagagaccctggccctgaccaagctggaggtgtggtggtacctgctgatgaggctgggcccccacctgcctgccaactttgagcaggtgtgtgtgcccctcatccagagcaccatcagcattgacagcaatgccagcccccagggcaacagctgccacgtggccaccagccctggcctgaaccccatgacccctgtgcacaagggggccagcagcccctacggggcccctggcacccccaggatgaacctgagcagcaacctgggcggcatggccaccatccccagcatccagctgctgggcctggagatgctgctgcacttcctgctgggccctgaggccctgagctttgccaagcagaacaagctggtgctgagcctggagcccctggagcaccccctcatcagcagccccagcttcttcagcaagcacgccaacaccctcatcacagctgtgcatgacagctttgtggccgtgggcaaggatgccccagatgtggtggtgtctgccatctggaaggagctgatcagcctggtgaagtctgtgacagaaagtggcaacaagaaggagaagccaggcagcgaggtgctgaccctgctgctgaagagcctggagagcatcgtgaagtctgaggtgtttcctgtgtccaagaccctggtgctgatggagatcaccatcaagggcctgccccagaaggtgctgggcagccctgcctaccaggtggccaacatggacatcctgaatggcaccccagccctcttcctgatccagctgatcttcaacaacttcctggagtgtggggtgtctgatgagcgcttcttcctgagcctggagagcctggtgggctgtgtgctgagcggccccaccagccccctggccttcagtgacagcgtgctgaatgtcatcaaccagaatgccaagcagctggagaacaaggagcacctgtggaagatgtggagcgtcatcgtgacccccctgacagagctgatcaaccagaccaatgaggtgaaccagggagatgccctggagcacaacttcagcgccatctacggggccctgaccctgcctgtgaaccacatcttcagcgagcagcgcttccctgtggccaccatgaagaccctgctgcggacctggagcgagctgtaccgggcctttgcccgctgtgccgccctggtggccacagctgaggagaacctgtgctgtgaggagctgagcagcaagatcatgagcagcctggaggatgagggcttcagcaacctgctgtttgtggaccgcatcatctacatcatcaccgtgatggtggactgcatcgacttcagcccctacaacatcaagtaccagcccaaggtgaagagcccccagaggcccagcgactggagcaagaagaagaatgagcccctgggcaagctgaccagcctcttcaagctgattgtgaaggtgatctacagcttccacaccctgtccttcaaggaggcccacagcgacaccctcttcaccatcggcaacagcatcaccggcatcatcagctctgtgctgggccacatcagcctgcccagcatgatcaggaagatctttgccaccctgacccggcccctggccctcttctatgagaacagcaagctggatgaggtgcccaaggtgtacagctgcctgaacaacaagctggagaagctgctgggggagatcatcgcctgcctgcagttctcctacacaggcacctatgacagcgagctgctggagcagctgagccccctgctgtgcatcatcttcctgcacaagaacaagcagatcaggaagcagagcgcccagttctggaatgccacctttgccaaggtgatgatgctggtgtacccagaggagctgaagcctgtgctgacccaggccaagcagaagttcctgctgctgctgcccggcctggagaccgtggagatgatggaggagagcagcggcccctacagtgatggaacagagaacagccagctgaatgtgaagatcagcggcatggagaggaagagcaatggcaagagggacagcttcctggcccagaccaagaacaagaaggagaacatgaagccagctgccaagctgaagctggagagcagcagcctgaaggtgaagggggagatcctgctggaggaggagaagagcacagactttgtgttcatccccccagagggcaaggatgccaaggagcgcatcctgacagaccaccagaaggaggtgctgaagaccaagagatgtgacatcccagccatgtacaacaacctggatgtgtcccaggacaccctcttcacccagtacagccaggaggagcccatggagatccccaccctgaccaggaagcccaaggaggacagcaagatgatgatcacagaggagcagatggacagcgacatcgtcatcccccaggatgtgacagaggactgtggcatggccgagcacctggagaagagcagcctgagcaacaatgaatgtggcagcctggacaagaccagccctgagatgagcaacagcaacaatgatgagaggaagaaggccctgatcagcagcaggaagaccagcacagaatgtgccagcagcacagagaacagctttgtggtgagcagcagctctgtgagcaacaccaccgtggccggcaccccaccctaccccaccagccggcggcagaccttcatcaccctggagaagtttgatggctctgaaaatcggcccttcagccccagccccctgaacaacatcagcagcacagtgacagtgaagaacaaccaggagaccatgatcaagacagacttcctgcccaaggccaagcagcgggagggcaccttcagcaagagtgacagcgagaagatcgtgaatggcaccaagaggagcagcagaagagctgggaaggccgagcagacaggcaacaagaggagcaagcccctgatgaggtctgagcctgagaagaacacagaggagagcgtggagggcatcgtggtgctggagaacaaccccccaggcctgctgaaccagacagaatgtgtgtctgacaaccaggtgcacctgtctgagagcaccatggagcatgacaacaccaagctgaaggccgccaccgtggagaatgctgtgctgctggagaccaacacagtggaggagaagaatgtggagatcaacctggagagcaaggagaacaccccacctgtggtgatctctgctgaccagatggtgaatgaagacagccaggtgcagatcacccccaaccagaagaccctgcggcgcagcagcagaagaagaagtgaggtggtggagagcaccacagagagccaggacaaggagaacagccaccagaagaaggagaggaggaaggaggaggagaagcccctgcagaagagccccctgcacatcaaggatgatgtgctgcccaagcagaagctgattgctgagcagaccctgcaggagaacctgattgagaagggcagcaacctgcacgagaagaccctgggggagaccagcgccaatgctgagacagagcagaacaagaagaaggctgaccctgagaacatcaagtcagaaggagatggcacccaggacatcgtggacaagagcagcgagaagctggtgcggggccgcacccgctaccagacccggcgggccagccagggcctgctgagcagcattgagaacagcgagagtgacagcagcgaggccaaggaggagggcagcaggaagaagaggtctgggaagtggaagaacaagagcaatgaatctgtggacatccaggaccaggaggagaaggtggtgaagcaggagtgcatcaaggccgagaaccagagccatgactacaaggccaccagcgaggaggatgtgtccatcaagagccccatctgtgagaagcaggatgagagcaacacagtcatctgccaggacagcacagtgaccagtgacctgctgcaggtgcctgatgacctgcccaacgtgtgtgaggagaagaatgagaccagcaaatatgcagagtacagcttcaccagcctgcctgtgcctgagagcaacctgcggaccagaaatgccatcaagaggctgcacaagagggacagctttgacaactgcagcctgggggagagcagcaagattggcatcagtgacatcagcagcctgtctgagaagaccttccagaccctggagtgccagcacaagaggagccggcgggtgagaagaagcaagggctgtgactgctgcggggagaagagccagccccaggagaagagcctgattggcctgaagaacacagaaaataatgatgtggagatcagcgagaccaagaaggcagatgtgcaggcccctgtgagccccagcgagaccagccaggccaacccctacagcgagggccagttcctggatgagcaccacagcgtgaacttccacctgggcctgaaggaggacaatgacaccatcaatgacagcctcatcgtgtctgagaccaagagcaaggagaacaccatgcaggagagcctgcccagcggcatcgtgaacttccgggaggagatctgtgacatggacagcagcgaggccatgagcctggagagccaggagagccccaatgaaaacttcaagacagtgggcccctgcctgggggacagcaagaatgtgtcccaggagagcctggagaccaaggaggagaagccagaggagacccccaagatggagctgagcctggagaatgtgacagtggagggcaatgcctgcaaggtgacagagagcaacctggagaaggccaagaccatggagctgaatgtgggcaatgaggccagcttccacggccaggagaggaccaagacaggcatcagcgaggaggccgccatcgaggagaacaagagaaatgatgacagcgaggccgacacagccaagctgaatgccaaggaggtggccacagaggagttcaacagcgacatcagcctgagtgacaacaccacccctgtgaagctgaatgcccagacagagatcagcgagcagacagctgctggggagctggatggcggcaatgatgtgtctgacctgcacagcagcgaggagaccaacaccaagatgaagaacaatgaggagatgatgattggagaggccatggccgagactggacatgatggagaaacagaaaatgaaggcatcaccaccaagaccagcaagccagatgaggccgagaccaacatgctgacagctgagatggacaactttgtgtgtgacacagtggagatgagcacagaggagggcatcattgatgccaacaagacagagaccaacacagagtacagcaagtctgaggagaagctggacaacaaccagatggtgatggagagtgacatcctgcaggaggaccaccacaccagccagaaggtggaggagcccagccagtgcctggccagcggcacagccatcagcgagctgatcatcgaggacaacaatgccagcccccagaagctgcgggagctggaccccagcctggtgtctgccaatgacagccccagcggcatgcagacccgctgtgtgtggagccccctggccagccccagcaccagcatcctgaagaggggcctgaagaggagccaggaggatgagatcagcagccctgtgaacaaggtgcggcgggtgtcctttgctgaccccatctaccaggccggcctggctgatgacatcgaccggcgctgcagcatcgtgcgcagccacagcagcaacagcagccccatcggcaagtctgtgaagaccagccccaccacccagagcaagatcagcgagatggccaaggagagcatcccctgccccacagagagcgtgtacccacccctggtgaactgtgtggcccctgtggacatcatcctgccccagatcaccagcaacatgtgggcccggggcctgggccagctgatccgggccaagaacatcaagaccatcggggacctgagcaccctgacagccagcgagatcaagaccctgcccatccgcagccccaaggtgtccaatgtgaagaaggccctgcgcatctaccacgagcagcaggtgaagacccggggcctggaggagatccctgtgtttgacatcagcgagaagacagtgaatggaattgagaacaagagcctgagcccagatgaggagcggctggtgtctgacatcatcgaccctgtggccctggagatccccctgagcaagaacctgctggcccagatcagcgccctggccctgcagctggacagcgaggacctgcacaactacagcggcagccagctgtttgagatgcatgagaagctgagctgcatggccaacagcgtcatcaagaacctgcagagccgctggaggagccccagccatgaaaattccatctag

SEQ ID NO: 21546 - DNA, 7341 bp, Artificial Sequence; identical to SEQ ID NO: 21545
  Description of Artificial Sequence: Synthetic coding sequence

SEQ ID NO: 21547 - DNA, 1026 bp, Artificial Sequence
  Description of Artificial Sequence: Synthetic coding sequence
atgacagcccggggccagagccccctggcccccctgctggagaccctggaggaccccagcgccagccatggaggccagacagatgcctacctgaccctgaccagcaggatgaccggggaggagggcaaggaggtgatcacagaaattgagaagaagctgccccggctgtacaaggtgctgaagacccacatcagcagccagaacagcgagctgagcagcgctgccctgcaggccctgggcttctgcctgtacaaccccaagatcaccagcgagctgtctgaggccaatgccctggagctgctgagcaagctgaatgacaccatcaagaacagcgacaagaatgtgaggacccgggccctgtgggtgatcagcaagcagaccttccccagcgaggtggtgggcaagatggtgagcagcatcatcgacagcctggagatcctcttcaacaagggggagacccacagcgctgtggtggactttgaggccctgaatgtcatcgtgcggctcatcgagcaggcccccatccagatgggagaggaggccgtgcgctgggccaagctggtgatccccctggtggtgcacagcgcccagaaggtgcacctgcggggggccacagccctggagatgggcatgcccctgctgctgcagaagcagcaggagatcgccagcatcacagagcagctgatgaccaccaccctgcacaggagcggcagcttcatcaacagcctgctgcagctggaggagctgggcttccgcagcggggcccccatgatcaagaagatcgccttcatcgcctggaagagcctgattgacaactttgccctgaacccagacatcctgtgcagcgccaagaggctgaagctgctgatgcagcccctgagcagcatccacgtgaggacagagaccctggccctgaccaagctggaggtgtggtggtacctgctgatgaggctgggcccccacctgcctgccaactttgagcaggtgctgccccccaggacagagccccgggagctgcctgagtag

SEQ ID NO: 21548 - DNA, 7419 bp, Artificial Sequence; identical to SEQ ID NO: 21543
  Description of Artificial Sequence: Synthetic coding sequence

SEQ ID NO: 21549 - DNA, 7341 bp, Artificial Sequence; identical to SEQ ID NO: 21545
  Description of Artificial Sequence: Synthetic coding sequence

SEQ ID NO: 21550 - DNA, 555 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggactgccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagcagatcctgcgggtgaaggacacagaagatgtgcccatgatcctggtgggcaacaagtgtgacctggaggatgagcgggtggtgggcaaggagcagggccagaacctggcccggcagtggtgcaactgtgccttcctggagagcagcgccaagagcaagatcaacgtgaatgagatcttctatgacctggtgcggcagatcaacaggaagacccctgtggagaagaagaagcccaagaagaagagctgcctgctgctgtag

SEQ ID NO: 21551 - DNA, 555 bp, Artificial Sequence; identical to SEQ ID NO: 21550
  Description of Artificial Sequence: Synthetic coding sequence

SEQ ID NO: 21552 - DNA, 390 bp, Artificial Sequence
  Description of Artificial Sequence: Synthetic coding sequence
atgagggagtacaagctggtggtgctgggcagcggaggagtgggcaagagcgccctgactgtgcagtttgtgcagggcatctttgtggagaagtatgaccccaccattgaagattcctacaggaagcaggtggaggtggactgccagcagtgcatgctggagatcctggacacagctggaacagagcagttcaccgccatgagggacctgtacatgaagaatggccagggctttgccctggtgtacagcatcacagcccagagcaccttcaatgacctgcaggacctgcgggagcagatcctgcgggtgaaggacacagaagatgtgcccatgatcctggtgggcaacaagtgtgacctggaggatgagcgggtggtgggcaaggagtag

SEQ ID NO: 21553 - DNA, 555 bp, Artificial Sequence; identical to SEQ ID NO: 21550
  Description of Artificial Sequence: Synthetic coding sequence

SEQ ID NO: 21554 - DNA, 555 bp, Artificial Sequence; identical to SEQ ID NO: 21550
  Description of Artificial Sequence: Synthetic coding sequence

SEQ ID NO: 21555 - DNA, 1380 bp, Artificial Sequence
  Description of Artificial Sequence: Synthetic coding sequence
atgagggcccagattgaagtcatcccctgcaagatctgtggggacaagagcagcggcatccactacggcgtcatcacctgtgagggctgcaagggcttcttcagaagaagccagcagaacaatgccagctacagctgcccccggcagaggaactgcctgattgacaggaccaacagaaaccgctgccagcactgccgcctgcagaagtgcctggccctgggcatgagcagagatgctgtgaagtttggccgcatgagcaagaagcagagggacagcctgtatgcagaggtgcagaagcaccagcagaggctgcaggagcagaggcagcagcagagcggggaggccgaggccctggcccgggtgtacagcagcagcatcagcaatggcctgagcaacctgaacaatgagaccagcggcacctacgccaatggacatgtgattgacctgcccaagtctgagggctactacaacgtggacagcggccagcccagcccagaccagagcggcctggacatgacaggcatcaagcagatcaagcaggagcccatctatgacctgacctctgtgcccaacctcttcacctacagcagcttcaacaacggccagctggcccctggcatcaccatgacagaaattgacagaattgcccagaacatcatcaagagccacctggagacctgccagtacaccatggaggagctgcaccagctggcctggcagacccacacctatgaggagatcaaggcctaccagagcaagagccgggaggccctgtggcagcagtgtgccatccagatcacccacgccatccagtatgtggtggagtttgccaagaggatcaccggcttcatggagctgtgccagaatgaccagatcctgctgctgaagagcggctgcctggaggtggtgctggtgaggatgtgccgggccttcaaccccctgaacaacacagtgctgtttgagggcaagtatggaggcatgcagatgttcaaggccctgggcagtgatgacctggtgaatgaggcctttgattttgccaagaacctgtgcagcctgcagctgacagaggaggagatcgccctcttcagcagcgctgtgctgatcagcccagaccgggcctggctgattgagcccaggaaggtgcagaagctgcaggagaagatctactttgccctgcagcacgtgatccagaagaaccacctggatgatgagaccctggccaagctgattgccaagatccccaccatcacagctgtgtgcaacctgcatggagagaagctgcaggtgttcaagcagagccaccctgagatcgtgaacaccctcttcccccccctgtacaaggagctgttcaacccagactgtgccaccggctgcaagtag

SEQ ID NO: 21556 - DNA, 1413 bp, Artificial Sequence
  Description of Artificial Sequence: Synthetic coding sequence
atgtgtgagaaccagctgaagaccaaggcagatgccacagcccagatcgaggtgatcccctgcaagatctgtggggacaagagcagcggcatccactatggagtcatcacctgtgagggctgcaagggcttcttccgccgcagccagcagaacaatgccagctacagctgcccccggcagaggaactgcctgattgacaggaccaacagaaaccgctgccagcactgccgcctgcagaagtgcctggccctgggcatgagcagagatgctgtgaagtttggaaggatgagcaagaagcagagggacagcctgtatgcagaggtgcagaagcaccagcagaggctgcaggagcagaggcagcagcagagcggggaggccgaggccctggcccgggtgtacagcagcagcatcagcaatggcctgagcaacctgaacaatgagaccagcggcacctacgccaacggccacgtgattgacctgcccaagtctgagggctactacaacgtggacagcggccagcccagcccagaccagagcggcctggacatgacaggcatcaagcagatcaagcaggagcccatctatgacctgacctctgtgcccaacctcttcacctacagcagcttcaacaacggccagctggcccctggcatcaccatgacagaaattgaccgcatcgcccagaacatcatcaagagccacctggagacctgccagtacaccatggaggagctgcaccagctggcctggcagacccacacctatgaggagatcaaggcctaccagagcaagagccgggaggccctgtggcagcagtgtgccatccagatcacccacgccatccagtatgtggtggagtttgccaagaggatcaccggcttcatggagctgtgccagaatgaccagatcctgctgctgaagagcggctgcctggaggtggtgctggtgaggatgtgccgggccttcaaccccctgaacaacacagtgctgtttgagggcaagtatggaggcatgcagatgttcaaggccctgggcagtgatgacctggtgaatgaggcctttgattttgccaagaacctgtgcagcctgcagctgacagaggaggagatcgccctcttcagcagcgctgtgctgatcagcccagaccgggcctggctgattgagcccaggaaggtgcagaagctgcaggagaagatctactttgccctgcagcacgtgatccagaagaaccacctggatgatgagaccctggccaagctgattgccaagatccccaccatcacagctgtgtgcaacctgcacggggagaagctgcaggtgttcaagcagagccaccctgagatcgtgaacaccctcttcccccccctgtacaaggagctgttcaacccagactgtgccaccggctgcaagtag

SEQ ID NO: 21557 - DNA, 813 bp, Artificial Sequence
  Description of Artificial Sequence: Synthetic coding sequence
atgggagaggccgaggcccccagctttgagatgacctggagcagcaccaccagcagcggctactgcagccaggaggacagcgacagcgagctggagcagtacttcaccgcccggaccagcctggcccggcggccccggcgggaccaggatgagcctgtggagtgggagaccccagacctgagccaggccgagattgagcagaagatcaaggagtacaatgcccagatcaacagcaacctcttcatgagcctgaacaaggatggcagctacacaggcttcatcaaggtgcagctgaagctggtgcggcctgtgtctgtgcccagcagcaagaagccacccagcctgcaggatgcccggcggggccctggccggggcacctctgtgagaagaaggaccagcttctacctgcccaaggatgctgtgaagcacctgcacgtgctgagcaggacccgggcccgggaggtgattgaggccctgctgaggaagttcctggtggtggatgaccccaggaagtttgccctgtttgagcgggcagagagacatggccaggtgtacctgaggaagctgctggatgatgagcagcccctgcggctgcggctgctggccggccccagcgacaaggccctgagctttgtgctgaaggaaaatgacagcggggaggtgaactgggatgccttctccatgcctgagctgcacaacttcctgcgcatcctgcagcgggaggaggaggagcacctgcggcagatcctgcagaagtacagctactgccggcagaagatccaggaggccctgcacgcctgccccctgggctag

SEQ ID NO: 21558 - DNA, 1035 bp, Artificial Sequence
  Description of Artificial Sequence: Synthetic coding sequence
atgtctggagagcctgagctgattgagctgcgggagctggccccagctggccgggccgggaaaggaagaacccggctggagcgggccaatgccctgcgcatcgcccggggcacagcctgcaaccccacccggcagctggtgcccggccggggccaccgcttccagcctgctggccctgccacccacacctggtgtgacctgtgtggggacttcatctggggcgtggtgaggaagggcctgcagtgtgcccggctgtctgctgactgcaagttcacctgccactaccgctgccgggccctggtgtgcctggactgctgcggcccccgggacctgggctgggagcctgctgtggagcgggacaccaacgtggatgagcctgtggagtgggagaccccagacctgagccaggccgagattgagcagaagatcaaggagtacaatgcccagatcaacagcaacctcttcatgagcctgaacaaggatggcagctacacaggcttcatcaaggtgcagctgaagctggtgcggcctgtgtctgtgcccagcagcaagaagccacccagcctgcaggatgcccggcggggccctggccggggcacctctgtgagaagaaggaccagcttctacctgcccaaggatgctgtgaagcacctgcacgtgctgagcaggacccgggcccgggaggtgattgaggccctgctgaggaagttcctggtggtggatgaccccaggaagtttgccctgtttgagcgggcagagagacatggccaggtgtacctgaggaagctgctggatgatgagcagcccctgcggctgcggctgctggccggccccagcgacaaggccctgagctttgtgctgaaggaaaatgacagcggggaggtgaactgggatgccttctccatgcctgagctgcacaacttcctgcgcatcctgcagcgggaggaggaggagcacctgcggcagatcctgcagaagtacagctactgccggcagaagatccaggaggccctgcacgcctgccccctgggctag

SEQ ID NO: 21559 - DNA, 1023 bp, Artificial Sequence
  Description of Artificial Sequence: Synthetic coding sequence
atgtctggagagcctgagctgattgagctgcgggagctggccccagctggccgggccgggaaaggaagaacccggctggagcgggccaatgccctgcgcatcgcccggggcacagcctgcaaccccacccggcagctggtgcccggccggggccaccgcttccagcctgctggccctgccacccacacctggtgtgacctgtgtggggacttcatctggggcgtggtgaggaagggcctgcagtgtgcccactgcaagttcacctgccactaccgctgccgggccctggtgtgcctggactgctgcggcccccgggacctgggctgggagcctgctgtggagcgggacaccaacgtggatgagcctgtggagtgggagaccccagacctgagccaggccgagattgagcagaagatcaaggagtacaatgcccagatcaacagcaacctcttcatgagcctgaacaaggatggcagctacacaggcttcatcaaggtgcagctgaagctggtgcggcctgtgtctgtgcccagcagcaagaagccacccagcctgcaggatgcccggcggggccctggccggggcacctctgtgagaagaaggaccagcttctacctgcccaaggatgctgtgaagcacctgcacgtgctgagcaggacccgggcccgggaggtgattgaggccctgctgaggaagttcctggtggtggatgaccccaggaagtttgccctgtttgagcgggcagagagacatggccaggtgtacctgaggaagctgctggatgatgagcagcccctgcggctgcggctgctggccggccccagcgacaaggccctgagctttgtgctgaaggaaaatgacagcggggaggtgaactgggatgccttctccatgcctgagctgcacaacttcctgcgcatcctgcagcgggaggaggaggagcacctgcggcagatcctgcagaagtacagctactgccggcagaagatccaggaggccctgcacgcctgccccctgggctag

SEQ ID NO: 21560 - DNA, 570 bp, Artificial Sequence
  Description of Artificial Sequence: Synthetic coding sequence
atgagcctgaacaaggatggcagctacacaggcttcatcaaggtgcagctgaagctggtgcggcctgtgtctgtgcccagcagcaagaagccacccagcctgcaggatgcccggcggggccctggccggggcacctctgtgagaagaaggaccagcttctacctgcccaaggatgctgtgaagcacctgcacgtgctgagcaggacccgggcccgggaggtgattgaggccctgctgaggaagttcctggtggtggatgaccccaggaagtttgccctgtttgaaagagctgagcggcacggccaggtgtacctgaggaagctgctggatgatgagcagcccctgcggctgcggctgctggccggccccagcgacaaggccctgagctttgtgctgaaggaaaatgattctggagaggtgaactgggatgccttctccatgcctgagctgcacaacttcctgcgcatcctgcagcgggaggaggaggagcacctgcggcagatcctgcagaagtacagctactgccggcagaagatccaggaggccctgcacgcctgccccctgggctag

SEQ ID NO: 21561 - DNA, 981 bp, Artificial Sequence
  Description of Artificial Sequence: Synthetic coding sequence
atggactacagccaccagaccagcctggtgccctgtggccaggacaagtacatcagcaagaatgagctgctgctgcacctgaagacctacaacctgtactatgagggccagaacctgcagctgcggcaccgggaggaggaggatgagttcatcgtggagggcctgctgaacatctcctggggcctgcggcggcccatccggctgcagatgcaggatgacaatgaaagaatccggcccccacccagcagcagctcctggcacagcggctgcaacctgggcgcccagggcaccaccctgaagcccctgactgtgcccaaggtgcagatcagcgaggtggatgcccctcctgagggggaccagatgcccagcagcacagacagccggggcctgaagcccctgcaggaggacaccccccagctgatgaggaccaggagtgatgtgggcgtgagaagaagaggaaatgtgaggacccccagcgaccagaggcgcatcagaagacaccgcttcagcatcaatggccacttctacaaccacaagacctctgtgttcaccccagcctacggctctgtgaccaacgtgcgcatcaacagcaccatgaccaccccccaggtgctgaagctgctgctgaacaagttcaagattgaaaattctgctgaggagtttgccctgtatgtggtgcacaccagcggggagaagcagaagctgaaggccacagactaccccctgattgcccgcatcctgcagggcccctgtgagcagatcagcaaggtgttcctgatggagaaggaccaggtggaggaggtgacctatgatgtggcccagtacatcaagtttgagatgcctgtgctgaagagcttcatccagaagctgcaggaggaggaggaccgggaggtgaagaagctgatgaggaagtacacagtgctgcggctgatgatccggcagaggctggaggagattgctgagaccccagccaccatctag

SEQ ID NO: 21562 - DNA, 981 bp, Artificial Sequence; identical to SEQ ID NO: 21561
  Description of Artificial Sequence: Synthetic coding sequence

SEQ ID NO: 21563 - DNA, 993 bp, Artificial Sequence
  Description of Artificial Sequence: Synthetic coding sequence
atgaaggaggactgcctgcccagcagccacgtgcccatcagtgacagcaagagcatccagaagagagatgtgcagggcctgtctgaggagggcaccctcatcatcgagggcctgctgaacatcgcctggggcctgcggcggcccatccggctgcagatgcaggatgaccgggagcaggtgcacctgcccagcacctcctggatgccccggcggcccagctgccccctgggctgctggagcctgctgctgggcctgagcagcctgagcctgcctgctgccatcagcgccctgcagctgagcgtcttcaggaaggagcccagcccccagaatggaaacatcacagcccagggccccagcatccagcctgtgcacaaggccgagagcagcacagacagcagcggccccctggaggaggccgaggaggccccccagctgatgaggaccaagagtgatgccagctgcatgagccagaggcggcccaagtgccgggcccctggagaggcccagaggatccgccgccaccgcttcagcatcaatggccacttctacaaccacaagaccagcgtcttcaccccagcctacggctctgtgaccaacgtgcgggtgaacagcaccatgaccaccctgcaggtgctgaccctgctgctgaacaagttccgggtggaggatggccccagcgagtttgccctgtacatcgtgcatgagagcggggagaggaccaagctgaaggactgtgagtaccccctcatcagccgcatcctgcacggcccctgtgagaagatcgcccgcatcttcctgatggaggccgacctgggcgtggaggtgccccatgaggtggcccagtacatcaagtttgagatgcctgtgctggacagctttgtggagaagctgaaggaggaggaggagcgggagatcatcaagctgaccatgaagttccaggccctgcggctgaccatgctgcagaggctggagcagctggtggaggccaagtag

SEQ ID NO: 21564 - DNA, 966 bp, Artificial Sequence
  Description of Artificial Sequence: Synthetic coding sequence
atgaaggaggactgcctgcccagcagccacgtgcccatcagtgacagcaagagcatccagaagtctgagctgctgggcctgctgaagacctacaactgctaccacgagggcaagagcttccagctgcggcaccgggaggaggagggcaccctcatcatcgagggcctgctgaacatcgcctggggcctgcggcggcccatccggctgcagatgcaggatgaccgggagcaggtgcacctgcccagcacctcctggatgccccggcggcccagctgccccctgaaggagcccagcccccagaatggaaacatcacagcccagggccccagcatccagcctgtgcacaaggccgagagcagcacagacagcagcggccccctggaggaggccgaggaggccccccagctgatgaggaccaagagtgatgccagctgcatgagccagaggcggcccaagtgccgggcccctggagaggcccagaggatcagaagacaccgcttcagcatcaatggccacttctacaaccacaagacctctgtgttcaccccagcctacggctctgtgaccaacgtgcgggtgaacagcaccatgaccaccctgcaggtgctgaccctgctgctgaacaagttccgggtggaggatggccccagcgagtttgccctgtacatcgtgcatgaaagtggagagaggaccaagctgaaggactgtgagtaccccctcatcagccgcatcctgcacggcccctgtgagaagatcgcccgcatcttcctgatggaggccgacctgggcgtggaggtgccccatgaggtggcccagtacatcaagtttgagatgcctgtgctggacagctttgtggagaagctgaaggaggaggaggagcgggagatcatcaagctgaccatgaagttccaggccctgcggctgaccatgctgcagaggctggagcagctggtggaggccaagtag

SEQ ID NO: 21565 - DNA, 1239 bp, Artificial Sequence
  Description of Artificial Sequence: Synthetic coding sequence
ggcagcaatgctgggggcggccagggcggctgccagggcctgacctgtgacagcgagagcgtgggcaccctggacatcctggaccagacccaggcctgccctgtgtccctggccagcagcagcgcccggcccccctgccccccacctggcccctgtgccgagcccagcggctgcatcgccatggctgtgtggagccccctggtgatgcctggccggcgggagggctgctgccacacccctgtgaccaatgaggagacagaggcccgggaggccaagggccagaagctgcggccctgccacaccctgggcgtgcacgtgtgcctgagcctcttccgctctgagctgctgggcctgctgaagacctacaactgctaccacgagggcaagagcttccagctgcggcaccgggaggaggagggcaccctcatcatcgagggcctgctgaacatcgcctggggcctgcggcggcccatccggctgcagatgcaggatgaccgggagcaggtgcacctgcccagcacctcctggatgccccggcggcccagctgccccctgaaggagcccagcccccagaatggaaacatcacagcccagggccccagcatccagcctgtgcacaaggccgagagcagcacagacagcagcggccccctggaggaggccgaggaggccccccagctgatgaggaccaagagtgatgccagctgcatgagccagaggcggcccaagtgccgggcccctggagaggcccagaggatccgccgccaccgcttcagcatcaatggccacttctacaaccacaagaccagcgtcttcaccccagcctacggctctgtgaccaacgtgcgggtgaacagcaccatgaccaccctgcaggtgctgaccctgctgctgaacaagttccgggtggaggatggccccagcgagtttgccctgtacatcgtgcatgagagcggggagaggaccaagctgaaggactgtgagtaccccctcatcagccgcatcctgcacggcccctgtgagaagatcgcccgcatcttcctgatggaggccgacctgggcgtggaggtgccccatgaggtggcccagtacatcaagtttgagatgcctgtgctggacagctttgtggagaagctgaaggaggaggaggagcgggagatcatcaagctgaccatgaagttccaggccctgcggctgaccatgctgcagaggctggagcagctggtggaggccaagtag

SEQ ID NO: 21566 - DNA, 393 bp, Artificial Sequence
  Description of Artificial Sequence: Synthetic coding sequence
atgaaggaggactgcctgcccagcagccacgtgcccatcagtgacagcaagagcatccagaagtctgagctgctgggcctgctgaagacctacaactgctaccacgagggcaagagcttccagctgcggcaccgggaggaggagggcaccctcatcatcgagggcctgctgaacatcgcctggggcctgcggcggcccatccggctgcagatgcaggatgaccgggagcaggtgcacctgcccagcacctcctggatgccccggcggcccagctgccccctgcacctggccggcaagaagggccgcctgcagcccggcggcctgcccacccccatgcaggccgagcacgtgagccccagcctggtgctgagcctgaagttcacccgcatctag

SEQ ID NO: 21567 - DNA, 381 bp, Artificial Sequence
  Description of Artificial Sequence: Synthetic coding sequence
atgaaggaggactgcctgcccagcagccacgtgcccatcagtgacagcaagagcatccagaagtctgagctgctgggcctgctgaagacctacaactgctaccacgagggcaagagcttccagctgcggcaccgggaggaggagggcaccctcatcatcgagggcctgctgaacatcgcctggggcctgcggcggcccatccggctgcagatgcaggatgaccgggagcaggtgcacctgcccagcacctcctggatgccccggcggcccagctgccccctggcccctgggggcggccggggcggccccccagcagatgctgaccaggagcggcggcagctgcacgagcctgaggaggcccaggtgccccggcccaggtag

SEQ ID NO: 21568 - DNA, 456 bp, Artificial Sequence
  Description of Artificial Sequence: Synthetic coding sequence
atgaaggaggactgcctgcccagcagccacgtgcccatcagtgacagcaagagcatccagaagtctgagctgctgggcctgctgaagacctacaactgctaccacgagggcaagagcttccagctgcggcaccgggaggaggagggcaccctcatcatcgagggcctgctgaacatcgcctggggcctgcggcggcccatccggctgcagatgcaggatgaccgggagcaggtgcacctgcccagcacctcctggatgccccggcggcccagctgccccctgggctgctggagcctgctgctgggcctgagcagcctgagcctgcctgctgccatcagcgccctgcagctgagcgtcttcaggaaggagcccagcccccagaatggaaacatcacagcccagggccccagcatccagcctgtgcacaaggccgagagcagcacagacagcagctag

SEQ ID NO: 21569 - DNA, 372 bp, Artificial Sequence
  Description of Artificial Sequence: Synthetic coding sequence
agcagccacgtgcccatcagtgacagcaagagcatccagaagtctgagctgctgggcctgctgaagacctacaactgctaccacgagggcaagagcttccagctgcggcaccgggaggaggagggcaccctcatcatcgagggcctgctgaacatcgcctggggcctgcggcggcccatccggctgcagatgcaggatgaccgggagcaggtgcacctgcccagcacctcctggatgccccggcggcccagctgccccctgcacctggccggcaagaagggccgcctgcagcccggcggcctgcccacccccatgcaggccgagcacgtgagccccagcctggtgctgagcctgaagttcacccgcatctag

SEQ ID NO: 21570 - DNA, 798 bp, Artificial Sequence
  Description of Artificial Sequence: Synthetic coding sequence
atgacagtggacagctccatgagcagcggctactgcagcctggatgaggagctggaggactgcttcttcaccgccaagaccaccttcttcagaaatgcccagagcaagcacctgagcaagaatgtgtgcaagcctgtggaggagacccagaggcctcccaccctgcaggagatcaagcagaagattgacagctacaacacccgggagaagaactgcctgggcatgaagctgtctgaagatggcacctacacaggcttcatcaaggtgcacctgaagctgcggcggcctgtgacagtgcctgctggcatccggccccagagcatctatgatgccatcaaggaggtgaacctggccgccaccacagacaagaggaccagcttctacctgcccctggatgccatcaagcagctgcacatcagcagcaccaccaccgtgtctgaggtgatccagggcctgctgaagaagttcatggtggtggacaacccccagaagtttgccctcttcaagaggatccacaaggatggccaggtgctcttccagaagctgagcattgctgaccggcccctgtacctgcggctgctggccggccctgacacagaggtgctgagctttgtgctgaaggaaaatgaaacaggagaggtggagtgggatgccttcagcatccctgagctgcagaacttcctgaccatcctggagaaggaggagcaggacaagatccagcaggtgcagaagaagtatgacaagttccggcagaagctggaggaggccctgcgggagagccagggcaagccaggatag

SEQ ID NO: 21571 - DNA, 1179 bp, Artificial Sequence
  Description of Artificial Sequence: Synthetic coding sequence
atggccatggccagccctgccatcggccagaggccctaccccctgctgctggaccctgagcccccacgctacctgcagagcctgagcggccctgagctgcccccacctcctccagacaggagcagccggctgtgtgtgcctgcccccctgagcacagcccctggggcccgggagggccgcagcgccaggagagctgcccggggcaacctggagcccccaccccgggccagcaggcctgcccggcccctgcggcccggcctgcagcagaggctgcggcggcggcctggggccccccggcccagagatgtgcgcagcatctttgagcagccccaggacccccgggtgcctgctgagcggggggagggccactgctttgctgagctggtgctgcccggcggccctggctggtgtgacctgtgtggccgggaggtgctgcggcaggccctgcgctgcaccaactgcaagttcacctgccacccagaatgtcgcagcctcatccagctggactgcagccagcaggagggcctgagccgggaccggcccagccctgagagcaccctgactgtgaccttcagccagaatgtgtgcaagcctgtggaggagacccagaggcctcccaccctgcaggagatcaagcagaagattgacagctacaacacccgggagaagaactgcctgggcatgaagctgtctgaagatggcacctacacaggcttcatcaaggtgcacctgaagctgcggcggcctgtgacagtgcctgctggcatccggccccagagcatctatgatgccatcaaggaggtgaacctggccgccaccacagacaagaggaccagcttctacctgcccctggatgccatcaagcagctgcacatcagcagcaccaccaccgtgtctgaggtgatccagggcctgctgaagaagttcatggtggtggacaacccccagaagtttgccctcttcaagaggatccacaaggatggccaggtgctcttccagaagctgagcattgctgaccggcccctgtacctgcggctgctggccggccctgacacagaggtgctgagctttgtgctgaaggaaaatgagaccggggaggtggagtgggatgccttcagcatccctgagctgcagaacttcctgagctcctggtgcatccagatctacctgtactactag

SEQ ID NO: 21572 - DNA, 1257 bp, Artificial Sequence
  Description of Artificial Sequence: Synthetic coding sequence
atggccatggccagccctgccatcggccagaggccctaccccctgctgctggaccctgagcccccacgctacctgcagagcctgagcggccctgagctgcccccacctcctccagacaggagcagccggctgtgtgtgcctgcccccctgagcacagcccctggggcccgggagggccgcagcgccaggagagctgcccggggcaacctggagcccccaccccgggccagcaggcctgcccggcccctgcggcccggcctgcagcagaggctgcggcggcggcctggggccccccggcccagagatgtgcgcagcatctttgagcagccccaggacccccgggtgcctgctgagcggggggagggccactgctttgctgagctggtgctgcccggcggccctggctggtgtgacctgtgtggccgggaggtgctgcggcaggccctgcgctgcaccaactgcaagttcacctgccacccagaatgtcgcagcctcatccagctggactgcagccagcaggagggcctgagccgggaccggcccagccctgagagcaccctgactgtgaccttcagccagaatgtgtgcaagcctgtggaggagacccagaggcctcccaccctgcaggagatcaagcagaagattgacagctacaacacccgggagaagaactgcctgggcatgaagctgtctgaagatggcacctacacaggcttcatcaaggtgcacctgaagctgcggcggcctgtgacagtgcctgctggcatccggccccagagcatctatgatgccatcaaggaggtgaacctggccgccaccacagacaagaggaccagcttctacctgcccctggatgccatcaagcagctgcacatcagcagcaccaccaccgtgtctgaggtgatccagggcctgctgaagaagttcatggtggtggacaacccccagaagtttgccctcttcaagaggatccacaaggatggccaggtgctcttccagaagctgagcattgctgaccggcccctgtacctgcggctgctggccggccctgacacagaggtgctgagctttgtgctgaaggaaaatgagaccggggaggtggagtgggatgccttcagcatccctgagctgcagaacttcctgaccatcctggagaaggaggagcaggacaagatccagcaggtgcagaagaagtatgacaagttccggcagaagctggaggaggccctgcgggagagccagggcaagccaggatag

SEQ ID NO: 21573 - DNA, 1011 bp, Artificial Sequence
  Description of Artificial Sequence: Synthetic coding sequence
atggccatggccagccctgccatcggccagaggccctaccccctgctgctggaccctgagcccccacgctacctgcagagcctgagcggccctgagctgcccccacctcctccagacaggagcagccggctgtgtgtgcctgcccccctgagcacagcccctggggcccgggagggccgcagcgccaggagagctgcccggggcaacctggagcccccaccccgggccagcaggcctgcccggcccctgcggcccggcctgcagcagaggctgcggcggcggcctggggccccccggcccagagatgtgcgcagcatctttgagcagccccaggacccccgggtgcctgctgagcggggggagggccactgctttgctgagctggtgctgcccggcggccctggctggtgtgacctgtgtggccgggaggtgctgcggcaggccctgcgctgcaccaactgcaagttcacctgccacccagaatgtcgcagcctcatccagctggactgcagccagcaggagggcctgagccgggaccggcccagccctgagagcaccctgactgtgaccttcagccagaatgtgtgcaagcctgtggaggagacccagaggcctcccaccctgcaggagatcaagcagaagattgacagctacaacacccgggagaagaactgcctgggcatgaagctgtctgaagatggcacctacacaggcttcatcaaggtgcacctgaagctgcggcggcctgtgacagtgcctgctggcatccggccccagagcatctatgatgccatcaaggaggtgaacctggccgccaccacagacaagaggaccagcttctacctgcccctggatgccatcaagcagctgcacatcagcagcaccaccaccgtgtctgaggtgatccagggcctgctgaagaagttcatggtggtggacaacccccagaagtttgccctcttcaagaggatccacaaggatggccaggtgggctgcctgctgcacccctag

SEQ ID NO: 21574 - DNA, 1182 bp, Artificial Sequence
  Description of Artificial Sequence: Synthetic coding sequence
atggccatggccagccctgccatcggccagaggccctaccccctgctgctggaccctgagcccccacgctacctgcagagcctgagcggccctgagctgcccccacctcctccagacaggagcagccggctgtgtgtgcctgcccccctgagcacagcccctggggcccgggagggccgcagcgccaggagagctgcccggggcaacctggagcccccaccccgggccagcaggcctgcccggcccctgcggcccggcctgcagcagaggctgcggcggcggcctggggccccccggcccagagatgtgcgcagcatctttgagcagccccaggacccccgggtgcctgctgagcggggggagggccactgctttgctgagctggtgctgcccggcggccctggctggtgtgacctgtgtggccgggaggtgctgcggcaggccctgcgctgcaccaactgcaagttcacctgccacccagaatgtcgcagcctcatccagctggactgcagccagcaggagggcctgagccgggaccggcccagccctgagagcaccctgactgtgaccttcagccagaatgtgtgcaagcctgtggaggagacccagaggcctcccaccctgcaggagatcaagcagaagattgacagctacaacacccgggagaagaactgcctgggcatgaagctgtctgaagatggcacctacacaggcttcatcaaggtgcacctgaagctgcggcggcctgtgacagtgcctgctggcatccggccccagagcatctatgatgccatcaaggaggtgaacctggccgccaccacagacaagaggaccagcttctacctgcccctggatgccatcaagcagctgcacatcagcagcaccaccaccgtgtctgaggtgatccagggcctgctgaagaagttcatggtggtggacaacccccagaagtttgccctcttcaagaggatccacaaggatggccaggtgctcttccagaagctgagcattgctgaccggcccctgtacctgcggctgctggccggccctgacacagaggtgctgagctttgtgctgaaggaaaatgagaccggggaggtggagtgggatgccttcagcatccctgagctgcagaacttcttcctgagctcctggtgcatccagatctacctgtactactag

SEQ ID NO: 21575 - DNA, 555 bp, Artificial Sequence
  Description of Artificial Sequence: Synthetic coding sequence
atgccccagagcaagagcaggaagatcgccatcctgggctacagatctgtgggcaagagcagcctgaccatccagtttgtggagggccagtttgtggacagctatgaccccaccatcgagaacaccttcaccaagctgatcaccgtgaatggccaggagtaccacctgcagctggtggacacagctggccaggatgagtacagcatcttcccccagacctacagcattgacatcaatggctacatcctggtgtacagcgtgaccagcatcaagagctttgaagtcatcaaggtgatccacggcaagctgctggacatggtgggcaaggtgcagatccccatcatgctggtgggcaacaagaaggacctgcacatggagagggtcatctcctatgaggagggcaaggccctggccgagagctggaatgctgccttcctggagagcagcgccaaggagaaccagacagctgtggatgtgttccgccgcatcatcctggaggccgagaagatggatggagctgccagccagggcaagagcagctgcagcgtgatgtag

SEQ ID NO: 21576 - DNA, 582 bp, Artificial Sequence
  Description of Artificial Sequence: Synthetic coding sequence
atggccgccatcaggaagaagctggtgattgtgggagatggagcctgtgggaagacctgcctgctgattgtgttcagcaaggaccagtttcctgaggtgtatgtgcccaccgtgtttgagaactacgtggccgacatcgaggtggatggcaagcaggtggagctggccctgtgggacacagctggccaggaggactatgaccggctgcggcccctgagctacccagacacagatgtgatcctgatgtgcttcagcattgacagcccagacagcctggagaacatccctgagaagtggaccccagaggtgaagcacttctgccccaacgtgcccatcatcctggtgggcaacaagaaggacctgagaaatgatgagcacacccggcgggagctggccaagatgaagcaggagcctgtgaagccagaggagggccgggacatggccaacagaattggagccttcggctacatggagtgcagcgccaagaccaaggatggagtgcgggaggtgtttgagatggccaccagggctgccctgcaggcccggcggggcaagaagaagagcggctgcctggtgctgtag

SEQ ID NO: 21577 - DNA, 591 bp, Artificial Sequence
  Description of Artificial Sequence: Synthetic coding sequence
atggccgccatcaggaagaagctggtggtggtgggagatggagcctgtgggaagacctgcctgctgattgtgttcagcaaggatgagttccctgaggtgtatgtgcccaccgtgtttgagaactacgtggccgacatcgaggtggatggcaagcaggtggagctggccctgtgggacacagctggccaggaggactatgaccggctgcggcccctgagctacccagacacagatgtgatcctgatgtgcttctctgtggacagcccagacagcctggagaacatccctgagaagtgggtgcctgaggtgaagcacttctgccccaacgtgcccatcatcctggtggccaacaagaaggacctgcggagtgatgagcacgtgaggacagagctggccaggatgaagcaggagcctgtgaggacagatgatggccgggccatggctgtgcgcatccaggcctatgactacctggagtgcagcgccaagaccaaggagggcgtgcgggaggtgtttgaaacagccaccagggctgccctgcagaagagatatggcagccagaatggctgcatcaactgctgcaaggtgctgtag

SEQ ID NO: 21578 - DNA, 582 bp, Artificial Sequence
  Description of Artificial Sequence: Synthetic coding sequence
atggccgccatcaggaagaagctggtgattgtgggagatggagcctgtgggaagacctgcctgctgattgtgttcagcaaggaccagtttcctgaggtgtatgtgcccaccgtgtttgagaactacatcgctgacatcgaggtggatggcaagcaggtggagctggccctgtgggacacagctggccaggaggactatgaccggctgcggcccctgagctacccagacacagatgtgatcctgatgtgcttcagcattgacagcccagacagcctggagaacatccctgagaagtggaccccagaggtgaagcacttctgccccaacgtgcccatcatcctggtgggcaacaagaaggacctgcggcaggatgagcacacccggcgggagctggccaagatgaagcaggagcctgtgcgctctgaggagggccgggacatggccaaccgcatcagcgccttcggctacctggagtgcagcgccaagaccaaggagggcgtgcgggaggtgtttgagatggccaccagggctggcctgcaggtgaggaagaacaagagaagaagaggctgccccatcctgtag

SEQ ID NO: 21579 - DNA, 582 bp, Artificial Sequence; identical to SEQ ID NO: 21578
  Description of Artificial Sequence: Synthetic coding sequence

SEQ ID NO: 21580 - DNA, 582 bp, Artificial Sequence; identical to SEQ ID NO: 21578
  Description of Artificial Sequence: Synthetic coding sequence

SEQ ID NO: 21581 - DNA, 582 bp, Artificial Sequence; identical to SEQ ID NO: 21578
  Description of Artificial Sequence: Synthetic coding sequence

SEQ ID NO: 21582 - DNA, 600 bp, Artificial Sequence
  Description of Artificial Sequence: Synthetic coding sequence
atggccgccatcaggaagaagctggtgattgtgggagatggagcctgtgggaagacctgcctgctgattgtgttcagcaaggaccagtttcctgaggtgtatgtgcccaccgtgtttgagaactacatcgctgacatcgaggtggatggcaagcaggtggagctggccctgtgggacacagctggccaggaggactatgaccggctgcggcccctgagctacccagacacagatgtgatcctgatgtgcttcagcattgacagcccagacagcctggagaacatccctgagaagtggaccccagaggtgaagcacttctgccccaacgtgcccatcatcctggtgggcaacaagaaggacctgaggaaggccggcacctggaggactggatctgtgcccctggccaccctgagcgcccagccccggccccggcgggagtgtggccgctgcctgcgctggcccctgggcctggccagccgcagcgcccggacctctgtgggcggcgctgtgcccttcagcgagatccccaaggccttccccacctgccccctgcccagccagggctacagaaactacccacccaccaccccagccagctag

SEQ ID NO: 21583 - DNA, 582 bp, Artificial Sequence; identical to SEQ ID NO: 21578
  Description of Artificial Sequence: Synthetic coding sequence

SEQ ID NO: 21584 - DNA, 582 bp, Artificial Sequence; identical to SEQ ID NO: 21578
  Description of Artificial Sequence: Synthetic coding sequence

SEQ ID NO: 21585 - DNA, 582 bp, Artificial Sequence; identical to SEQ ID NO: 21578
  Description of Artificial Sequence: Synthetic coding sequence

SEQ ID NO: 21586 - DNA, 279 bp, Artificial Sequence
  Description of Artificial Sequence: Synthetic coding sequence
atggccgccatcaggaagaagctggtgattgtgggagatggagcctgtgggaagacctgcctgctgattgtgttcagcaaggaccagtttcctgaggtgtatgtgcccaccgtgtttgagaactacatcgctgacatcgaggtggatggcaagcaggtggagctggccctgtgggacacagctggccaggaggactatgaccggctgcggcccctgagctacccagacacagatgtgatcctgatgtgcttcagcattgacagcccagacagcctgtag

SEQ ID NO: 21587 - DNA, 570 bp, Artificial Sequence
  Description of Artificial Sequence: Synthetic coding sequence
atggccgccatcaggaagaagctggtgattgtgggagatggagcctgtgggaagacctgcctgctgattgtgttcagcaaggaccagtttcctgaggtgtatgtgcccaccgtgtttgagaactacatcgctgacatcgaggtggatggcaagcaggtggagctggccctgtgggacacagctggccaggaggactatgaccggctgcggcccctgagctacccagacacagatgtgatcctgatgtgcttcagcattgacagcccagacagcctggagaacatccctgagaagtggaccccagaggtgaagcacttctgccccaacgtgcccatcatcctggtgggcaacaagaaggacctgcggcaggatgagcacacccggcgggagctggccaagatgaagcaggagcctgtgcgctctgaggagggccgggacatggccaaccgcatcagcgccttcggctacctggagtgcagcgccaagaccaaggagggcgtgcgggaggtgtttgagatggccaccagggctggcctgcaggtgaggaagaacaagagaagaagaggatag

SEQ ID NO: 21588 - DNA, 384 bp, Artificial Sequence
  Description of Artificial Sequence: Synthetic coding sequence
atggccgccatcaggaagaagctggtgattgtgggagatggagcctgtgggaagacctgcctgctgattgtgttcagcaaggaccagtttcctgaggtgtatgtgcccaccgtgtttgagaactacatcgctgacatcgaggtggatggcaagcaggtggagctggccctgtgggacacagctggccaggaggactatgaccggctgcggcccctgagctacccagacacagatgtgatcctgatgtgcttcagcattgacagcccagacagcctggagaacatccctgagaagtggaccccagaggtgaagcacttctgccccaacgtgcccatcatcctggtgggcaacaagaaggacctgcggcaggatgagcacacctag

SEQ ID NO: 21589 - DNA, 690 bp, Artificial Sequence
  Description of Artificial Sequence: Synthetic coding sequence
atggtgtccatctctggaggagacctgcccaccggcctggacttcatcagcgcccctgagcccgccctgagcagctgcagcctgggcaccagcgctggctggagccccaccatggccgccatcaggaagaagctggtgattgtgggagatggagcctgtgggaagacctgcctgctgattgtgttcagcaaggaccagtttcctgaggtgtatgtgcccaccgtgtttgagaactacatcgctgacatcgaggtggatggcaagcaggtggagctggccctgtgggacacagctggccaggaggactatgaccggctgcggcccctgagctacccagacacagatgtgatcctgatgtgcttcagcattgacagcccagacagcctggagaacatccctgagaagtggaccccagaggtgaagcacttctgccccaacgtgcccatcatcctggtgggcaacaagaaggacctgcggcaggatgagcacacccggcgggagctggccaagatgaagcaggagcctgtgcgctctgaggagggccgggacatggccaaccgcatcagcgccttcggctacctggagtgcagcgccaagaccaaggagggcgtgcgggaggtgtttgagatggccacccgggccggcctgcaggtgaggaagaacaagagaagaagaggctgccccatctag

SEQ ID NO: 21590 - DNA, 510 bp, Artificial Sequence
  Description of Artificial Sequence: Synthetic coding sequence
atggccgccatcaggaagaagctggtgattgtgggagatggagcctgtgggaagacctgcctgctgattgtgttcagcaaggaccagtttcctgaggtgtatgtgcccaccgtgtttgagaactacatcgctgacatcgaggtggatggcaagcaggtggagctggccctgtgggacacagctggccaggaggactatgaccggctgcggcccctgagctacccagacacagatgtgatcctgatgtgcttcagcattgacagcccagacagcctggagaacatccctgagaagtggaccccagaggtgaagcacttctgccccaacgtgcccatcatcctggtgggcaacaagaaggacctgcggcaggatgagcacacccggcgggagctggccaagatgaagcaggagcctgtgcgctctgaggagggccgggacatggccaaccgcatcagcgccttcggctacctggagtgcagcgccaagaccaaggagggcgtgcgggagtag

SEQ ID NO: 21591 - DNA, 3144 bp, Artificial Sequence
  Description of Artificial Sequence: Synthetic coding sequence
atgatggctgctgaggccggcagcgaggagggcggccctgtgacagctggggccggcggcggcggcgctgctgctggcagcagcgcctacccagctgtgtgccgggtgaagatcccagctgccctgcctgtggccgccgccccctacccaggcctggtggagactggagtggccggcaccctgggcggcggggccgccctgggcagcgagttcctgggcgccggctctgtggccggggccctgggcggggccggcctgactggaggcggcacagctgctggggtggccggggctgctgctggggtggccggggctgctgtggccggccccagcggggacatggccctgaccaagctgcccaccagcctgctggccgagaccctgggccctgggggcggcttcccccccctgcccccaccaccctacctgccccccctgggcgccggcctgggcaccgtggatgaaggagacagcctggatggcccagaatatgaggaggaggaggtggccatccccctgacagccccacccaccaaccagtggtaccacggcaagctggacaggaccatcgccgaggagcggctgcggcaggccggcaagagcggcagctacctgatccgggagagtgacagaagacctggcagctttgtgctgtccttcctgagccagatgaatgtggtgaaccacttccgcatcatcgccatgtgtggggactactacatcggcggccgccgcttcagcagcctgagtgacctgattggctactacagccacgtgtcctgcctgctgaagggggagaagctgctgtaccctgtggcccctcctgagcctgtggaggacagaagaagagtgcgggccatcctgccctacaccaaggtgcctgacacagatgagatctccttcctgaagggggacatgttcatcgtgcacaatgagctggaggatggctggatgtgggtgaccaacctgaggacagatgagcagggcctgattgtggaggacctggtggaggaggtgggccgggaggaggacccccatgagggcaagatctggttccacggcaagatcagcaagcaggaggcctacaacctgctgatgacagtgggccaggtgtgcagcttcctggtgcggcccagcgacaacacccctggggactacagcctgtacttccgcaccaatgaaaacatccagcgcttcaagatctgccccacccccaacaaccagttcatgatgggcggccgctactacaacagcattggagacatcatcgaccactacaggaaggagcagatcgtggagggctactacctgaaggagcctgtgcccatgcaggaccaggagcaggtgctgaatgacacagtggatggcaaggagatctacaacaccatccggaggaagaccaaggatgccttctacaagaacatcgtgaagaagggctacctgctgaagaagggcaagggcaagcgctggaagaacctgtacttcatcctggagggcagtgatgcccagctgatctactttgaaagtgagaagagggccaccaagcccaagggcctgattgacctgtctgtgtgcagcgtgtatgtggtgcatgacagcctgtttggccggcccaactgcttccagatcgtggtgcagcacttcagcgaggagcactacatcttctactttgctggggagaccccagagcaggccgaggactggatgaagggcctgcaggccttctgcaacctgaggaagagcagccctggcaccagcaacaagaggctgcggcaggtgagcagcctggtgctgcacatcgaggaggcccacaagctgcctgtgaagcacttcaccaacccctactgcaacatctacctgaacagcgtgcaggtggccaagacccacgcccgggagggccagaaccctgtgtggagcgaggagtttgtgtttgatgacctgcccccagacatcaacagatttgagatcaccctgagcaacaagaccaagaagagcaaggaccctgacatcctcttcatgcgctgccagctgagccggctgcagaagggccacgccacagatgagtggttcctgctgagcagccacatccccctgaagggcatcgagcccggcagcctgcgggtgcgggcccgctacagcatggagaagatcatgcctgaggaggagtacagcgagttcaaggagctgatcctgcagaaggagctgcacgtggtgtatgccctgagccacgtgtgtggccaggacaggaccctgctggccagcatcctgctgcgcatcttcctgcacgagaagctggagagcctgctgctgtgcaccctgaatgaccgggagatctccatggaggatgaggccaccaccctcttccgggccaccaccctggccagcaccctgatggagcagtacatgaaggccacagccacccagtttgtgcaccacgccctgaaggacagcatcctgaagatcatggagagcaagcagagctgtgagctgagccccagcaagctggagaagaatgaagatgtgaacaccaacctgacccacctgctgaacatcctgtctgagctggtggagaagatcttcatggccagcgagatcctgccccccaccctgcgctacatctacggctgcctgcagaagtctgtgcagcacaagtggcccaccaacaccaccatgaggaccagggtggtgtctggctttgtgttcctgcggctcatctgcccagccatcctgaaccccaggatgttcaacatcatcagtgacagccccagccccatcgccgcccggaccctcatcctggtggccaagtctgtgcagaacctggccaacctggtggagtttggagccaaggagccctacatggagggcgtgaaccccttcatcaagagcaacaagcacaggatgatcatgttcctggatgagctgggcaatgtgcctgagctgcctgacaccacagagcacagcaggacagacctgagccgggacctggccgccctgcacgagatctgtgtggcccacagtgatgagctgcggaccctgagcaatgaaagaggagcccagcagcacgtgctgaagaagctgctggccatcacagagctgctgcagcagaagcagaaccagtacaccaagaccaatgatgtgaggtag

SEQ ID NO: 21592 - DNA, 2613 bp, Artificial Sequence
  Description of Artificial Sequence: Synthetic coding sequence
atgaagggctggtaccacggcaagctggacaggaccatcgccgaggagcggctgcggcaggccggcaagagcggcagctacctgatccgggagagtgaccggcggcccggcagctttgtgctgtccttcctgagccagatgaatgtggtgaaccacttccgcatcatcgccatgtgtggggactactacatcggcggccgccgcttcagcagcctgagtgacctgattggctactacagccacgtgtcctgcctgctgaagggggagaagctgctgtaccctgtggcccctcctgagcctgtggaggacagaagaagagtgcgggccatcctgccctacaccaaggtgcctgacacagatgagatctccttcctgaagggggacatgtttattgtgcacaatgagctggaggatggctggatgtgggtgaccaacctgaggacagatgagcagggcctcatcgtggaggacctggtggaggaggtgggccgggaggaggacccccatgagggcaagatctggttccacggcaagatcagcaagcaggaggcctacaacctgctgatgacagtgggccaggtgtgcagcttcctggtgcggcccagcgacaacacccctggggactacagcctgtacttccgcaccaatgaaaacatccagcgcttcaagatctgccccacccccaacaaccagttcatgatgggcggccgctactacaacagcatcggggacatcatcgaccactacaggaaggagcagatcgtggagggctactacctgaaggagcctgtgcccatgcaggaccaggagcaggtgctgaatgacacagtggatggcaaggagatctacaacaccatccggaggaagaccaaggatgccttctacaagaacatcgtgaagaagggctacctgctgaagaagggcaagggcaagcgctggaagaacctgtacttcatcctggagggcagtgatgcccagctgatctactttgagagcgagaagagggccaccaagcccaagggcctgattgacctgtctgtgtgcagcgtgtatgtggtgcatgacagcctgtttggccggcccaactgcttccagatcgtggtgcagcacttcagcgaggagcactacatcttctactttgctggggagaccccagagcaggccgaggactggatgaagggcctgcaggccttctgcaacctgaggaagagcagccctggcaccagcaacaagaggctgcggcaggtgagcagcctggtgctgcacatcgaggaggcccacaagctgcctgtgaagcacttcaccaacccctactgcaacatctacctgaacagcgtgcaggtggccaagacccacgcccgggagggccagaaccctgtgtggagcgaggagtttgtgtttgatgacctgcccccagacatcaacagatttgagatcaccctgagcaacaagaccaagaagagcaaggaccctgacatcctcttcatgcgctgccagctgagccggctgcagaagggccacgccacagatgagtggttcctgctgagcagccacatccccctgaagggcatcgagcccggcagcctgcgggtgcgggcccgctacagcatggagaagatcatgcctgaggaggagtacagcgagttcaaggagctgatcctgcagaaggagctgcacgtggtgtatgccctgagccacgtgtgtggccaggacaggaccctgctggccagcatcctgctgcgcatcttcctgcacgagaagctggagagcctgctgctgtgcaccctgaatgaccgggagatctccatggaggatgaggccaccaccctcttccgggccaccaccctggccagcaccctgatggagcagtacatgaaggccacagccacccagtttgtgcaccacgccctgaaggacagcatcctgaagatcatggagagcaagcagagctgtgagctgagccccagcaagctggagaagaatgaagatgtgaacaccaacctgacccacctgctgaacatcctgtctgagctggtggagaagatcttcatggccagcgagatcctgccccccaccctgcgctacatctacggctgcctgcagaagtctgtgcagcacaagtggcccaccaacaccaccatgaggaccagggtggtgtctggctttgtgttcctgcggctcatctgcccagccatcctgaaccccaggatgttcaacatcatcagtgacagccccagccccatcgccgcccggaccctcatcctggtggccaagtctgtgcagaacctggccaacctggtggagtttggagccaaggagccctacatggagggcgtgaaccccttcatcaagagcaacaagcacaggatgatcatgttcctggatgagctgggcaatgtgcctgagctgcctgacaccacagagcacagcaggacagacctgagccgggacctggccgccctgcacgagatctgtgtggcccacagtgatgagctgcggaccctgagcaatgaaagaggagcccagcagcacgtgctgaagaagctgctggccatcacagagctgctgcagcagaagcagaaccagtacaccaagaccaatgatgtgaggtag

SEQ ID NO: 21593 - DNA, 2646 bp, Artificial Sequence
  Description of Artificial Sequence: Synthetic coding sequence
atgtgcctggtgaagtcctggttcctgagcatccgcagccgctggtaccacggcaagctggacaggaccatcgccgaggagcggctgcggcaggccggcaagagcggcagctacctgatccgggagagtgacagaagacctggcagctttgtgctgtccttcctgagccagatgaatgtggtgaaccacttccgcatcatcgccatgtgtggggactactacatcggcggccgccgcttcagcagcctgagtgacctgattggctactacagccacgtgtcctgcctgctgaagggggagaagctgctgtaccctgtggcccctcctgagcctgtggaggacagaagaagagtgcgggccatcctgccctacaccaaggtgcctgacacagatgagatctccttcctgaagggggacatgttcatcgtgcacaatgagctggaggatggctggatgtgggtgaccaacctgaggacagatgagcagggcctgattgtggaggacctggtggaggaggtgggccgggaggaggacccccatgagggcaagatctggttccacggcaagatcagcaagcaggaggcctacaacctgctgatgacagtgggccaggtgtgcagcttcctggtgcggcccagcgacaacacccctggggactacagcctgtacttccgcaccaatgaaaacatccagcgcttcaagatctgccccacccccaacaaccagttcatgatgggcggccgctactacaacagcattggagacatcatcgaccactacaggaaggagcagatcgtggagggctactacctgaaggagcctgtgcccatgcaggaccaggagcaggtgctgaatgacacagtggatggcaaggagatctacaacaccatccggaggaagaccaaggatgccttctacaagaacatcgtgaagaagggctacctgctgaagaagggcaagggcaagcgctggaagaacctgtacttcatcctggagggcagtgatgcccagctgatctactttgaaagtgagaagagggccaccaagcccaagggcctgattgacctgtctgtgtgcagcgtgtatgtggtgcatgacagcctgtttggccggcccaactgcttccagatcgtggtgcagcacttcagcgaggagcactacatcttctactttgctggggagaccccagagcaggccgaggactggatgaagggcctgcaggccttctgcaacctgaggaagagcagccctggcaccagcaacaagaggctgcggcaggtgagcagcctggtgctgcacatcgaggaggcccacaagctgcctgtgaagcacttcaccaacccctactgcaacatctacctgaacagcgtgcaggtggccaagacccacgcccgggagggccagaaccctgtgtggagcgaggagtttgtgtttgatgacctgcccccagacatcaacagatttgagatcaccctgagcaacaagaccaagaagagcaaggaccctgacatcctcttcatgcgctgccagctgagccggctgcagaagggccacgccacagatgagtggttcctgctgagcagccacatccccctgaagggcatcgagcccggcagcctgcgggtgcgggcccgctacagcatggagaagatcatgcctgaggaggagtacagcgagttcaaggagctgatcctgcagaaggagctgcacgtggtgtatgccctgagccacgtgtgtggccaggacaggaccctgctggccagcatcctgctgcgcatcttcctgcacgagaagctggagagcctgctgctgtgcaccctgaatgaccgggagatctccatggaggatgaggccaccaccctcttccgggccaccaccctggccagcaccctgatggagcagtacatgaaggccacagccacccagtttgtgcaccacgccctgaaggacagcatcctgaagatcatggagagcaagcagagctgtgagctgagccccagcaagctggagaagaatgaagatgtgaacaccaacctgacccacctgctgaacatcctgtctgagctggtggagaagatcttcatggccagcgagatcctgccccccaccctgcgctacatctacggctgcctgcagaagtctgtgcagcacaagtggcccaccaacaccaccatgaggaccagggtggtgtctggctttgtgttcctgcggctcatctgcccagccatcctgaaccccaggatgttcaacatcatcagtgacagccccagccccatcgccgcccggaccctcatcctggtggccaagtctgtgcagaacctggccaacctggtggagtttggagccaaggagccctacatggagggcgtgaaccccttcatcaagagcaacaagcacaggatgatcatgttcctggatgagctgggcaatgtgcctgagctgcctgacaccacagagcacagcaggacagacctgagccgggacctggccgccctgcacgagatctgtgtggcccacagtgatgagctgcggaccctgagcaatgaaagaggagcccagcagcacgtgctgaagaagctgctggccatcacagagctgctgcagcagaagcagaaccagtacaccaagaccaatgatgtgaggtag

SEQ ID NO: 21594 - DNA, 2643 bp, Artificial Sequence
  Description of Artificial Sequence: Synthetic coding sequence
atgaggacaggctacagctctgtgcccagcaagctgcgctggtaccacggcaagctggacaggaccatcgccgaggagcggctgcggcaggccggcaagagcggcagctacctgatccgggagagtgaccggcggcccggcagctttgtgctgtccttcctgagccagatgaatgtggtgaaccacttccgcatcatcgccatgtgtggggactactacatcggcggccgccgcttcagcagcctgagtgacctgattggctactacagccacgtgtcctgcctgctgaagggggagaagctgctgtaccctgtggcccctcctgagcctgtggaggacagaagaagagtgcgggccatcctgccctacaccaaggtgcctgacacagatgagatctccttcctgaagggggacatgtttattgtgcacaatgagctggaggatggctggatgtgggtgaccaacctgaggacagatgagcagggcctcatcgtggaggacctggtggaggaggtgggccgggaggaggacccccatgagggcaagatctggttccacggcaagatcagcaagcaggaggcctacaacctgctgatgacagtgggccaggtgtgcagcttcctggtgcggcccagcgacaacacccctggggactacagcctgtacttccgcaccaatgaaaacatccagcgcttcaagatctgccccacccccaacaaccagttcatgatgggcggccgctactacaacagcatcggggacatcatcgaccactacaggaaggagcagatcgtggagggctactacctgaaggagcctgtgcccatgcaggaccaggagcaggtgctgaatgacacagtggatggcaaggagatctacaacaccatccggaggaagaccaaggatgccttctacaagaacatcgtgaagaagggctacctgctgaagaagggcaagggcaagcgctggaagaacctgtacttcatcctggagggcagtgatgcccagctgatctactttgagagcgagaagagggccaccaagcccaagggcctgattgacctgtctgtgtgcagcgtgtatgtggtgcatgacagcctgtttggccggcccaactgcttccagatcgtggtgcagcacttcagcgaggagcactacatcttctactttgctggggagaccccagagcaggccgaggactggatgaagggcctgcaggccttctgcaacctgaggaagagcagccctggcaccagcaacaagaggctgcggcaggtgagcagcctggtgctgcacatcgaggaggcccacaagctgcctgtgaagcacttcaccaacccctactgcaacatctacctgaacagcgtgcaggtggccaagacccacgcccgggagggccagaaccctgtgtggagcgaggagtttgtgtttgatgacctgcccccagacatcaacagatttgagatcaccctgagcaacaagaccaagaagagcaaggaccctgacatcctcttcatgcgctgccagctgagccggctgcagaagggccacgccacagatgagtggttcctgctgagcagccacatccccctgaagggcatcgagcccggcagcctgcgggtgcgggcccgctacagcatggagaagatcatgcctgaggaggagtacagcgagttcaaggagctgatcctgcagaaggagctgcacgtggtgtatgccctgagccacgtgtgtggccaggacaggaccctgctggccagcatcctgctgcgcatcttcctgcacgagaagctggagagcctgctgctgtgcaccctgaatgaccgggagatctccatggaggatgaggccaccaccctcttccgggccaccaccctggccagcaccctgatggagcagtacatgaaggccacagccacccagtttgtgcaccacgccctgaaggacagcatcctgaagatcatggagagcaagcagagctgtgagctgagccccagcaagctggagaagaatgaagatgtgaacaccaacctgacccacctgctgaacatcctgtctgagctggtggagaagatcttcatggccagcgagatcctgccccccaccctgcgctacatctacggctgcctgcagaagtctgtgcagcacaagtggcccaccaacaccaccatgaggaccagggtggtgtctggctttgtgttcctgcggctcatctgcccagccatcctgaaccccaggatgttcaacatcatcagtgacagccccagccccatcgccgcccggaccctcatcctggtggccaagtctgtgcagaacctggccaacctggtggagtttggagccaaggagccctacatggagggcgtgaaccccttcatcaagagcaacaagcacaggatgatcatgttcctggatgagctgggcaatgtgcctgagctgcctgacaccacagagcacagcaggacagacctgagccgggacctggccgccctgcacgagatctgtgtggcccacagtgatgagctgcggaccctgagcaatgaaagaggagcccagcagcacgtgctgaagaagctgctggccatcacagagctgctgcagcagaagcagaaccagtacaccaagaccaatgatgtgaggtag

SEQ ID NO: 21595 - DNA, 2616 bp, Artificial Sequence
  Description of Artificial Sequence: Synthetic coding sequence
cggggagatgccagcggctggggctgcagcgagcccggccctgggggcccctggggcagccgggccggccgggtgggccagagccgggccggcttcaacatgatggctgctgaggccggcagcgaggagggcggccctgtgacagctggagctgggggcggcggcgctgctgctggcagcagcgcctacccagctgtgtgccgggtgaagatcccagctgccctgcctgtggccgccgccccctacccaggcctggtggagaccggggtggccggcaccctgggcggcggggccgccctgggcagcgagttcctgggcgccggctctgtggccggggccctgggcggggccggcctgaccggcggcggcacagctgctggggtggccggggctgctgctggggtggccggggctgctgtggccggccccagcggggacatggccctgaccaagctgcccaccagcctgctggccgagaccctgggccctgggggcggcttcccccccctgcccccaccaccctacctgccccccctgggcgccggcctgggcaccgtggatgaaggagacagcctggatggcccagaatatgaggaggaggaggtggccatccccctgacagccccacccaccaaccagtggtaccacggcaagctggacaggaccatcgccgaggagcggctgcggcaggccggcaagagcggcagctacctgatccgggagagtgaccggcggcccggcagctttgtgctgtccttcctgagccagatgaatgtggtgaaccacttccgcatcatcgccatgtgtggggactactacatcggcggccgccgcttcagcagcctgagtgacctgattggctactacagccacgtgtcctgcctgctgaagggggagaagctgctgtaccctgtggcccctcctgagcctgtggaggacagaagaagagtgcgggccatcctgccctacaccaaggtgcctgacacagatgagatctccttcctgaagggggacatgtttattgtgcacaatgagctggaggatggctggatgtgggtgaccaacctgaggacagatgagcagggcctcatcgtggaggacctggtggaggaggtgggccgggaggaggacccccatgagggcaagatctggttccacggcaagatcagcaagcaggaggcctacaacctgctgatgacagtgggccaggtgtgcagcttcctggtgcggcccagcgacaacacccctggggactacagcctgtacttccgcaccaatgaaaacatccagcgcttcaagatctgccccacccccaacaaccagttcatgatgggcggccgctactacaacagcatcggggacatcatcgaccactacaggaaggagcagatcgtggagggctactacctgaaggagcctgtgcccatgcaggaccaggagcaggtgctgaatgacacagtggatggcaaggagatctacaacaccatccggaggaagaccaaggatgccttctacaagaacatcgtgaagaagggctacctgctgaagaagggcaagggcaagcgctggaagaacctgtacttcatcctggagggcagtgatgcccagctgatctactttgagagcgagaagagggccaccaagcccaagggcctgattgacctgtctgtgtgcagcgtgtatgtggtgcatgacagcctgtttggccggcccaactgcttccagatcgtggtgcagcacttcagcgaggagcactacatcttctactttgctggggagaccccagagcaggccgaggactggatgaagggcctgcaggccttctgcaacctgaggaagagcagccctggcaccagcaacaagaggctgcggcaggtgagcagcctggtgctgcacatcgaggaggcccacaagctgcctgtgaagcacttcaccaacccctactgcaacatctacctgaacagcgtgcaggtggccaagacccacgcccgggagggccagaaccctgtgtggagcgaggagtttgtgtttgatgacctgcccccagacatcaacagatttgagatcaccctgagcaacaagaccaagaagagcaaggaccctgacatcctcttcatgcgctgccagctgagccggctgcagaagggccacgccacagatgagtggttcctgctgagcagccacatccccctgaagggcatcgagcccggcagcctgcgggtgcgggcccgctacagcatggagaagatcatgcctgaggaggagtacagcgagttcaaggagctgatcctgcagaaggagctgcacgtggtgtatgccctgagccacgtgtgtggccaggacaggaccctgctggccagcatcctgctgcgcatcttcctgcacgagaagctggagagcctgctgctgtgcaccctgaatgaccgggagatctccatggaggatgaggccaccaccctcttccgggccaccaccctggccagcaccctgatggagcagtacatgaaggccacagccacccagtttgtgcaccacgccctgaaggacagcatcctgaagatcatggagagcaagcagagctgtgagctgagcagcagcaagctgcagaaggcctag

SEQ ID NO: 21596 - DNA, 1161 bp, Artificial Sequence
  Description of Artificial Sequence: Synthetic coding sequence
atgaacccccagatccggaaccccatggagaggatgtacagagacaccttctatgacaactttgaaaatgagcccatcctgtatggccgcagctacacctggctgtgctatgaggtgaagatcaagaggggccgcagcaacctgctgtgggacaccggggtcttccggggccctgtgctgcccaagaggcagagcaaccaccggcaggaggtgtacttccgctttgagaaccacgccgagatgtgcttcctgtcctggttctgtggcaaccggctgcctgccaacagacgcttccagatcacctggtttgtgtcctggaacccctgcctgccctgtgtggtgaaggtgaccaagttcctggccgagcaccccaacgtgaccctgaccatctctgctgcccggctgtactactacagagaccgggactggcgctgggtgctgctgcggctgcacaaggccggggcccgggtgaagatcatggactatgaagattttgcctactgctgggagaactttgtgtgcaatgaaggccagcccttcatgccctggtacaagtttgatgacaactatgccagcctgcacaggaccctgaaggagatcctgaggaaccccatggaggccatgtacccccacatcttctacttccacttcaagaacctgctgaaggcctgtggcagaaatgaatcctggctgtgcttcaccatggaggtgaccaagcaccacagcgctgtgttcaggaagaggggcgtcttcaggaaccaggtggaccctgagacccactgccacgccgagcgctgcttcctgtcctggttctgtgatgacatcctgagccccaacaccaactatgaggtgacctggtacacctcctggagcccctgcccagaatgtgccggggaggtggccgagttcctggcccggcacagcaatgtgaacctgaccatcttcaccgcccggctgtgctacttctgggacacagactaccaggagggcctgtgcagcctgagccaggagggcgcctctgtgaagatcatgggctacaaggactttgtgtcctgctggaagaactttgtgtacagtgatgatgagcccttcaagccctggaagggcctgcagaccaacttccggctgctgaagaggcggctgcgggagatcctgcagtag

SEQ ID NO: 21597 - DNA, 348 bp, Artificial Sequence
  Description of Artificial Sequence: Synthetic coding sequence
atgggcggcagcctgcgggtggccgtgctgggcgcccctggggtgggcaagacagccatcatccggcagttcctgtttggagactacccagagcggcaccggcccacagatggcccccggctgtacagacctgctgtgctgctggatggagctgtgtatgacctgagcatcagagatggagatgtggccggccctggcagcagccctgggggccctgaggagtggccagatgccaaggactggagcctgcaggacacagatgcctttgtgctggtgtatgacatctgcagcccagacagctttgattatgtgaaggccctgcggcagagaattgctgagaccaggtag

SEQ ID NO: 21598 - DNA, 579 bp, Artificial Sequence
  Description of Artificial Sequence: Synthetic coding sequence
atgcaggccatcaagtgtgtggtggtgggagatggagctgtgggcaagacctgcctgctgatctcctacaccaccaatgccttccctggagagtacatccccaccgtgtttgacaactacagcgccaacgtgatggtggatggcaagcctgtgaacctgggcctgtgggacacagctggccaggaggactatgaccggctgcggcccctgagctacccccagacagatgtgttcctgatctgcttcagcctggtgtccccagccagctttgaaaatgtgcgggccaagtggtacccagaggtgcgccaccactgccccaacacccccatcatcctggtgggcaccaagctggacctgagagatgacaaggacaccatcgagaagctgaaggagaagaagctgacccccatcacctacccccagggcctggccatggccaaggagattggagctgtgaagtacctggagtgcagcgccctgacccagaggggcctgaagacagtgtttgatgaggccatccgggctgtgctgtgccccccacctgtgaagaagaggaagaggaagtgcctgctgctgtag

SEQ ID NO: 21599 - DNA, 636 bp, Artificial Sequence
  Description of Artificial Sequence: Synthetic coding sequence
atgcaggccatcaagtgtgtggtggtgggagatggagctgtgggcaagacctgcctgctgatctcctacaccaccaatgccttccctggagagtacatccccaccgtgtttgacaactacagcgccaacgtgatggtggatggcaagcctgtgaacctgggcctgtgggacacagctggccaggaggactatgaccggctgcggcccctgagctacccccagacagtgggggagacctacggcaaggacatcaccagccggggcaaggacaagcccatcgcagatgtgttcctgatctgcttcagcctggtgtccccagccagctttgaaaatgtgcgggccaagtggtacccagaggtgcgccaccactgccccaacacccccatcatcctggtgggcaccaagctggacctgagagatgacaaggacaccatcgagaagctgaaggagaagaagctgacccccatcacctacccccagggcctggccatggccaaggagatcggggctgtgaagtacctggagtgcagcgccctgacccagaggggcctgaagacagtgtttgatgaggccatccgggctgtgctgtgccccccacctgtgaagaagaggaagaggaagtgcctgctgctgtag

SEQ ID NO: 21600 - DNA, 579 bp, Artificial Sequence
  Description of Artificial Sequence: Synthetic coding sequence
atgcaggccatcaagtgtgtggtggtgggagatggagctgtgggcaagacctgcctgctgatctcctacaccaccaatgccttccctggagagtacatccccaccgtgtttgacaactacagcgccaacgtgatggtggacagcaagcctgtgaacctgggcctgtgggacacagctggccaggaggactatgaccggctgcggcccctgagctacccccagacagatgtgttcctgatctgcttcagcctggtgtccccagccagctatgaaaatgtgcgggccaagtggttccctgaggtgcgccaccactgccccagcacccccatcatcctggtgggcaccaagctggacctgagagatgacaaggacaccatcgagaagctgaaggagaagaagctggcccccatcacctacccccagggcctggccctggccaaggagattgattctgtgaagtacctggagtgcagcgccctgacccagaggggcctgaagacagtgtttgatgaggccatccgggctgtgctgtgcccccagcccacccggcagcagaagagggcctgcagcctgctgtag

SEQ ID NO: 21601 - DNA, 261 bp, Artificial Sequence
  Description of Artificial Sequence: Synthetic coding sequence
atgcaggccatcaagtgtgtggtggtgggagatggagctgtgggcaagacctgcctgctgatctcctacaccaccaatgccttccctggagagtacatccccaccgtgcccggccggccctgtgccctgctgcaggatgctgaggccggcctgagcagtgatgtggagggcgcctgctggtgccagacccaggagggccgcatgactggagaggccccagccccaccctggccagccctgcggggcccccaccacagctag

SEQ ID NO: 21602 - DNA, 558 bp, Artificial Sequence
  Description of Artificial Sequence: Synthetic coding sequence
atgcaggccatcaaggctgtgggcaagacctgcctgctgatctcctacaccaccaatgccttccctggagagtacatccccaccgtgtttgacaactacagcgccaacgtgatggtggacagcaagcctgtgaacctgggcctgtgggacacagctggccaggaggactatgaccggctgcggcccctgagctacccccagacagatgtgttcctgatctgcttcagcctggtgtccccagccagctatgaaaatgtgcgggccaagtggttccctgaggtgcgccaccactgccccagcacccccatcatcctggtgggcaccaagctggacctgagagatgacaaggacaccatcgagaagctgaaggagaagaagctggcccccatcacctacccccagggcctggccctggccaaggagattgacagcgtgaagtacctggagtgcagcgccctgacccagaggggcctgaagacagtgtttgatgaggccatccgggctgtgctgtgcccccagcccacccggcagcagaagagggcctgcagcctgctgtag

SEQ ID NO: 21603 - DNA, 447 bp, Artificial Sequence
  Description of Artificial Sequence: Synthetic coding sequence
atggtggacagcaagcctgtgaacctgggcctgtgggacacagctggccaggaggactatgaccggctgcggcccctgagctacccccagacagatgtgttcctgatctgcttcagcctggtgtccccagccagctatgaaaatgtgcgggccaagtggttccctgaggtgcgccaccactgccccagcacccccatcatcctggtgggcaccaagctggacctgagagatgacaaggacaccatcgagaagctgaaggagaagaagctggcccccatcacctacccccagggcctggccctggccaaggagattgattctgtgaagtacctggagtgcagcgccctgacccagaggggcctgaagacagtgtttgatgaggccatccgggctgtgctgtgcccccagcccacccggcagcagaagagggcctgcagcctgctgtag

SEQ ID NO: 21604 - DNA, 501 bp, Artificial Sequence
  Description of Artificial Sequence: Synthetic coding sequence
atgcaggccatcaagtgtgtggtggtgggagatggagctgtgggcaagacctgcctgctgatctcctacaccaccaatgccttccctggagagtacatccccaccgtgtttgacaactacagcgccaacgtgatggtggacagcaagcctgtgaacctgggcctgtgggacacagctggccaggaggactatgaccggctgcggcccctgagctacccccagacagatgtgttcctgatctgcttcagcctggtgtccccagccagctatgaaaatgtgcgggccaagtggttccctgaggtgcgccaccactgccccagcacccccatcatcctggtgggcaccaagctggacctgagagatgacaaggacaccatcgagaagctgaaggagaagaagctggcccccatcacctacccccagggcctggccctggccaaggagattgattctgtgaagtacctggagtgcagcgccctgacccagaggggcctgaagtag

SEQ ID NO: 21605 - DNA, 4785 bp, Artificial Sequence
  Description of Artificial Sequence: Synthetic coding sequence
atgaagctgtatgtgttcctggtgaacacaggcaccaccctgacctttgacacagagctgactgtgcagacagtggccgacctgaagcacgccatccagagcaagtacaagatcgccatccagcaccaggtgctggtggtgaatggaggagagtgcatggctgctgacagaagagtgtgcacctacagcgctggaacagacaccaaccccatcttcctgttcaacaaggagatgatcctgtgtgaccggcccccagccatccccaagaccaccttcagcacagaaaatgacatggagatcaaggtggaggagagcctgatgatgcctgctgtgttccacacagtggccagcaggacccagctggccctggagatgtatgaggtggccaagaagctgtgcagcttctgtgagggcctggtgcatgatgagcacctgcagcaccagggctgggccgccatcatggccaacctggaggactgcagcaacagctaccagaagctgctcttcaagtttgagagcatctacagcaactacctgcagagcattgaggacatcaagctgaagctgacccacctgggcacagctgtgtctgtgatggccaagatccccctgctggagtgcctgaccaggcacagctacagagaatgtctgggccgcctggacagcctgcctgagcatgaagattctgagaaggccgagatgaagaggagcacagagctggtgctgagcccagacatgcccaggaccaccaatgaaagcctgctgaccagcttccccaagtctgtggagcacgtgtccccagacacagcagatgctgagagcggcaaggagatccgggagagctgccagagcacagtgcaccagcaggatgagaccaccatcgacaccaaggatggagacctgcccttcttcaacgtgtccctgctggactggatcaacgtgcaggaccggcccaatgatgtggagagcctggtgaggaaatgttttgacagcatgagccggctggacccccgcatcatccggcccttcatcgccgagtgccggcagaccatcgccaagctggacaaccagaacatgaaggccatcaagggcctggaggaccggctgtatgccctggaccagatgattgccagctgtggccgcctggtgaatgagcagaaggagctggcccagggcttcctggccaaccagaagagagctgagaacctgaaggatgcctctgtgctgcctgacctgtgcctgagccacgccaaccagctgatgatcatgctgcagaaccacaggaagctgctggacatcaagcagaagtgcaccacagccaagcaggagctggccaacaacctgcacgtgcggctgaagtggtgctgctttgtgatgctgcacgccgaccaggatggagagaagctgcaggccctgctgcggctggtgattgagctgctggagcgggtgaagatcgtggaggccctgagcacagtgccccagatgtactgcctggccgtggtggaggtggtgcggaggaagatgttcatcaagcactaccgggagtgggccggggccctggtgaaggatggcaagaggctgtatgaggccgagaagagcaagcgggagagctttgggaagctgttcaggaagagcttcctgaggaacagactcttccggggcctggacagctggcccccatccttctgcacccagaagcccaggaagtttgactgtgagctgcctgacatcagcctgaaggacctgcagttcctgcagagcttctgccccagcgaggtgcagcccttcctgcgggtgcccctgctgtgtgactttgagcccctgcaccagcacgtgctggccctgcacaacctggtgaaggccgcccagagcctggatgagatgagccagaccatcacagacctgctgtctgagcagaaggcctctgtgtcccagaccagcccccagagcgccagcagccccaggatggagagcacagctggcatcaccaccaccaccagccccaggaccccaccacccctgactgtgcaggaccccctgtgcccagctgtgtgccccctggaggagctgagcccagacagcattgatgcccacacctttgattttgagaccatcccccaccccaacatcgagcagaccatccaccaggtgtccctggacctggacagcctggccgagagccctgagagtgacttcatgtctgctgtgaatgaatttgtgattgaggagaacctgagcagccccaaccccatcagtgacccccagagccctgagatgatggtggagagcctgtacagcagcgtcatcaatgccatcgacagcaggaggatgcaggacaccaacgtgtgtgggaaggaggactttggagaccacaccagcctgaatgtgcagctggagcgctgccgggtggtggcccaggacagccacttcagcatccagaccatcaaggaggacctgtgccacttccgcacctttgtgcagaaggagcagtgtgacttcagcaacagcctgaagtgcacagctgtggagatccggaacatcatcgagaaggtgaagtgcagcctggagatcaccctgaaggagaagcaccagaaggagctgctgagcctgaagaatgaatatgagggcaagctggatggcctcatcaaggagacagaagaaaatgaaaacaagatcaagaagctgaagggggagctggtgtgcctggaggaggtgctgcagaacaaggacaatgaatttgccctggtgaagcatgagaaggaggccgtcatctgcctgcagaatgagaaggaccagaagctgctggagatggagaacatcatgcacagccagaactgtgagatcaaggagctgaagcagagccgggagatcgtgctggaggacctgaagaagctgcacgtggagaatgatgagaagctgcagctgctgcgggcagagctgcagagcctggagcagagccacctgaaggagctggaggacaccctgcaggtgcgccacatccaggagtttgagaaggtgatgacagaccaccgggtgtccctggaggagctgaagaaggagaaccagcagatcatcaaccagatccaggagagccatgctgagatcatccaggagaaggagaagcagctgcaggagctgaagctgaaggtgtctgacctgagtgacacccgctgcaagctggaggtggagctggccctgaaggaggccgagacagatgagatcaagatcctgctggaggagagccgggcccagcagaaggagaccctgaagagcctgctggagcaggagacagagaacctgaggacagagatcagcaagctgaaccagaagatccaggacaacaatgaaaactaccaggtgggcctggccgagctgcggaccctgatgaccatcgagaaggaccagtgcatcagcgagctgatcagcagacatgaggaggagagcaacatcctgaaggccgagctgaacaaggtgaccagcctgcacaaccaggcctttgaaattgagaagaacctgaaggagcagatcatcgagctgcagagcaagctggacagcgagctgagcgccctggagcggcagaaggatgagaagatcacccagcaggaggagaagtatgaggccatcatccagaacctggagaaggaccggcagaagctggtgagcagccaggagcaggaccgggagcagctgatccagaagctgaactgtgagaaggatgaggccatccagacagccctgaaggagttcaagctggagcgggaggtggtggagaaggagctgctggagaaggtgaagcacctggagaaccagatcgccaagagccctgccatcgacagcaccaggggggacagcagcagcctggtggccgagctgcaggagaagctgcaggaggagaaggccaagttcctggagcagctggaggagcaggagaagaggaagaatgaggagatgcagaatgtgaggaccagcctgattgctgagcagcagaccaacttcaacacagtgctgacccgggagaagatgaggaaggagaacatcatcaatgacctgagtgacaagctgaagagcaccatgcagcagcaggagcgggacaaggacctgattgagagcctgtctgaagatcgggcccggctgctggaggagaagaagaagctggaggaggaggtgtccaagctgcggagcagcagctttgtgcccagcccctacgtggccacagcccctgagctgtatggagcctgtgcccctgagctgcccggggagagtgacagatctgctgtggagacagcagatgagggccgggtggacagcgccatggagacctccatgatgtctgtgcaggagaacatccacatgctgtctgaggagaagcagaggatcatgctgctggagaggaccctgcagctgaaggaggaggagaacaagaggctgaaccagaggctgatgagccagagcatgagctctgtgagcagccgccacagcgagaagatcgccatccgggacttccaggtgggggacctggtgctgatcatcctggatgaaagacatgacaactacgtgctcttcaccgtgagccccaccctgtacttcctgcacagcgagagcctgcctgccctggacctgaagccaggagagggcgccagcggggccagcagaagaccctgggtgctgggcaaggtgatggagaaggagtactgccaggccaagaaggcccagaaccgcttcaaggtgcccctgggcaccaagttctacagagtgaaggctgtgtcctggaacaagaaggtgtag

SEQ ID NO: 21606 - DNA, 4776 bp, Artificial Sequence
  Description of Artificial Sequence: Synthetic coding sequence
atgaagctgtatgtgttcctggtgaacacaggcaccaccctgacctttgacacagagctgactgtgcagacagtggccgacctgaagcacgccatccagagcaagtacaagatcgccatccagcaccaggtgctggtggtgaatggaggagagtgcatggctgctgacagaagagtgtgcacctacagcgctggaacagacaccaaccccatcttcctgttcaacaaggagatgatcctgtgtgaccggcccccagccatccccaagaccaccttcagcacagaaaatgacatggagatcaaggtggaggagagcctgatgatgcctgctgtgttccacacagtggccagcaggacccagctggccctggagatgtatgaggtggccaagaagctgtgcagcttctgtgagggcctggtgcatgatgagcacctgcagcaccagggctgggccgccatcatggccaacctggaggactgcagcaacagctaccagaagctgctcttcaagtttgagagcatctacagcaactacctgcagagcattgaggacatcaagctgaagctgacccacctgggcacagctgtgtctgtgatggccaagatccccctgctggagtgcctgaccaggcacagctacagagaatgtctgggccgcctggacagcctgcctgagcatgaagattctgagaaggccgagatgaagaggagcacagagctggtgctgagcccagacatgcccaggaccaccaatgaaagcctgctgaccagcttccccaagtctgtggagcacgtgtccccagacacagcagatgctgagagcggcaaggagatccgggagagctgccagagcacagtgcaccagcaggatgagaccaccatcgacaccaaggatggagacctgcccttcttcaacgtgtccctgctggactggatcaacgtgcaggaccggcccaatgatgtggagagcctggtgaggaaatgttttgacagcatgagccggctggacccccgcatcatccggcccttcatcgccgagtgccggcagaccatcgccaagctggacaaccagaacatgaaggccatcaagggcctggaggaccggctgtatgccctggaccagatgattgccagctgtggccgcctggtgaatgagcagaaggagctggcccagggcttcctggccaaccagaagagagctgagaacctgaaggatgcctctgtgctgcctgacctgtgcctgagccacgccaaccagctgatgatcatgctgcagaaccacaggaagctgctggacatcaagcagaagtgcaccacagccaagcaggagctggccaacaacctgcacgtgcggctgaagtggtgctgctttgtgatgctgcacgccgaccaggatggagagaagctgcaggccctgctgcggctggtgattgagctgctggagcgggtgaagatcgtggaggccctgagcacagtgccccagatgtactgcctggccgtggtggaggtggtgcggaggaagatgttcatcaagcactaccgggagtgggccggggccctggtgaaggatggcaagaggctgtatgaggccgagaagagcaagcgggagagctttgggaagctgttcaggaagagcttcctgaggaacagactcttccggggcctggacagctggcccccatccttctgcacccagaagcccaggaagtttgactgtgagctgcctgacatcagcctgaaggacctgcagttcctgcagagcttctgccccagcgaggtgcagcccttcctgcgggtgcccctgctgtgtgactttgagcccctgcaccagcacgtgctggccctgcacaacctggtgaaggccgcccagagcctggatgagatgagccagaccatcacagacctgctgtctgagcagaaggcctctgtgtcccagaccagcccccagagcgccagcagccccaggatggagagcacagctggcatcaccaccaccaccagccccaggaccccaccacccctgactgtgcaggaccccctgtgcccagctgtgtgccccctggaggagctgagcccagacagcattgatgcccacacctttgattttgagaccatcccccaccccaacatcgagcagaccatccaccaggtgtccctggacctggacagcctggccgagagccctgagagtgacttcatgtctgctgtgaatgaatttgtgattgaggagaacctgagcagccccaaccccatcagtgacccccagagccctgagatgatggtggagagcctgtacagcagcgtcatcaatgccatcgacagcaggaggatgcaggacaccaacgtgtgtgggaaggaggactttggagaccacaccagcctgaatgtgcagctggagcgctgccgggtggtggcccaggacagccacttcagcatccagaccatcaaggaggacctgtgccacttccgcacctttgtgcagaaggagcagtgtgacttcagcaacagcctgaagtgcacagctgtggagatccggaacatcatcgagaaggtgaagtgcagcctggagatcaccctgaaggagaagcaccagaaggagctgctgagcctgaagaatgaatatgagggcaagctggatggcctcatcaaggagacagaagaaaatgaaaacaagatcaagaagctgaagggggagctggtgtgcctggaggaggtgctgcagaacaaggacaatgaatttgccctggtgaagcatgagaaggaggccgtcatctgcctgcagaatgagaaggaccagaagctgctggagatggagaacatcatgcacagccagaactgtgagatcaaggagctgaagcagagccgggagatcgtgctggaggacctgaagaagctgcacgtggagaatgatgagaagctgcagctgctgcgggcagagctgcagagcctggagcagagccacctgaaggagctggaggacaccctgcaggtgcgccacatccaggagtttgagaaggtgatgacagaccaccgggtgtccctggaggagctgaagaaggagaaccagcagatcatcaaccagatccaggagagccatgctgagatcatccaggagaaggagaagcagctgcaggagctgaagctgaaggtgtctgacctgagtgacacccgctgcaagctggaggtggagctggccctgaaggaggccgagacagatgagatcaagatcctgctggaggagagccgggcccagcagaaggagaccctgaagagcctgctggagcaggagacagagaacctgaggacagagatcagcaagctgaaccagaagatccaggacaacaatgaaaactaccaggtgggcctggccgagctgcggaccctgatgaccatcgagaaggaccagtgcatcagcgagctgatcagcagacatgaggaggagagcaacatcctgaaggccgagctgaacaaggtgaccagcctgcacaaccaggcctttgaaattgagaagaacctgaaggagcagatcatcgagctgcagagcaagctggacagcgagctgagcgccctggagcggcagaaggatgagaagatcacccagcaggaggagaagtatgaggccatcatccagaacctggagaaggaccggcagaagctggtgagcagccaggagcaggaccgggagcagctgatccagaagctgaactgtgagaaggatgaggccatccagacagccctgaaggagttcaagctggagcgggaggtggtggagaaggagctgctggagaaggtgaagcacctggagaaccagatcgccaagagccctgccatcgacagcaccaggggggacagcagcagcctggtggccgagctgcaggagaagctgcaggaggagaaggccaagttcctggagcagctggaggagcaggagaagaggaagaatgaggagatgcagaatgtgaggaccagcctgattgctgagcagcagaccaacttcaacacagtgctgacccgggagaagatgaggaaggagaacatcatcaatgacctgagtgacaagctgaagagcaccatgcagcagcaggagcgggacaaggacctgattgagagcctgtctgaagatcgggcccggctgctggaggagaagaagaagctggaggaggaggtgtccaagctgcggagcagcagctttgtgcccagcccctacgtggccacagcccctgagctgtatggagcctgtgcccctgagctgcccggggagagtgacagatctgctgtggagacagcagatgagggccgggtggacagcgccatggagacctccatgatgtctgtgcaggagaacatccacatgctgtctgaggagaagcagaggatcatgctgctggagaggaccctgcagctgaaggaggaggagaacaagaggctgaaccagaggctgatgagccagagcatgagctctgtgagcagccgccacagcgagaagatcgccatccgggacttccaggtgggggacctggtgctgatcatcctggatgaaagacatgacaactacgtgctcttcaccgtgagccccaccctgtacttcctgcacagcgagagcctgcctgccctggacctgaagccagccagcggggccagccggcggccctgggtgctgggcaaggtgatggagaaggagtactgccaggccaagaaggcccagaaccgcttcaaggtgcccctgggcaccaagttctacagagtgaaggctgtgtcctggaacaagaaggtgtag

SEQ ID NO: 21607 - DNA, 48 bp, Artificial Sequence
  Description of Artificial Sequence: Synthetic coding sequence
atgaagctgtatgtgttcctggtgaacacaggcaccaccctgacctag

SEQ ID NO: 21608 - DNA, 4776 bp, Artificial Sequence; identical to SEQ ID NO: 21606
  Description of Artificial Sequence: Synthetic coding sequence

SEQ ID NO: 21609 - DNA, 6471 bp, Artificial Sequence
  Description of Artificial Sequence: Synthetic coding sequence
atgtctgacacccccagcacaggcttcagcatcatccaccccaccagcagcgagggccaggtgcccccacccaggcacctgagcctgacccaccctgtggtggccaagaggatctccttctacaagagcggggacccccagtttggaggagtgcgggtggtggtgaaccccaggagcttcaagagctttgatgccctgctggacaacctgagcaggaaggtgcccctgcccttcggcgtgaggaacatcagcaccccccggggccgccacagcatcacccggctggaggagctggaggatggagagagctacctgtgcagccacggcaggaaggtgcagcctgtggacctggacaaggcccggcggcggccccggccctggctgagcagccgggccatcagcgcccacagccccccccaccctgtggccgtggccgcccctggcatgccccggccccccaggagcctggtggtgttcagaaatggagaccccaagaccaggagagctgtgctgctgagccggcgggtgacccagagctttgaggccttcctgcagcacctgacagaggtgatgcagaggcctgtggtgaagctgtatgccacagatggccggcgggtgcccagcctgcaggccgtcatcctgagcagcggggctgtggtggccgccggccgggagcccttcaagccaggcaactatgacatccagaagtacctgctgcctgcccggctgcccggcatcagccagagggtgtaccccaagggaaatgccaagtctgagagcaggaagatcagcacccacatgagcagcagcagccgcagccagatctacagcgtgagcagcgagaagacccacaacaatgactgctacctggactacagctttgtgcctgagaagtacctggccctggagaagaatgacagccagaacctgcccatctaccccagtgaagatgacatcgagaagagcatcatcttcaaccaggacggcaccatgacagtggagatgaaggtgcgcttccgcatcaaggaggaggagaccatcaagtggaccaccaccgtgtccaagacaggccccagcaacaatgatgagaagtctgagatgtccttccctggccgcacagagagccgcagcagcggcctgaagctggccgcctgcagcttcagcgcagatgtgagccccatggagaggagcagcaaccaggagggcagcctggccgaggagatcaacatccagatgacagaccaggtggccgagacctgcagcagcgcctcctgggagaatgccaccgtggacacagacatcatccagggcacccaggaccaggccaagcaccgcttctacagaccacccaccccaggcctgcggcgggtgcggcagaagaagagcgtcatcggctctgtgaccctggtgtctgaaacagaggtgcaggagaagatgattggccagttctcctacagcgaggagcgggagagcggggagaacaagtctgagtaccacatgttcacccacagctgcagcaagatgagctctgtgagcaacaagcctgtgctggtgcagatcaacaacaatgaccagatggaggagagcagcctggagaggaagaaggagaacagcctgctgaagagcagcgccatctctgctggggtcatcgagatcaccagccagaagatgctggagatgagccacaacaacggcctgcccagcaccatcagcaacaacagcatcgtggaggaggatgtggtggactgtgtggtgctggacaacaagacaggcatcaagaacttcaagacctacggcaacaccaatgaccgcttcagccccatctctgcagatgccacccacttcagcagcaacaacagcggcacagacaagaacatcagcgaggccccagccagcgaggccagcagcacagtgacagccagaattgacaggctcatcaatgaatttgcccagtgtggcctgaccaagctgcccaagaatgagaagaagatcctgagctctgtggccagcaagaagaagaagaagagccggcagcaggccatcaacagccgctaccaggacggccagctggccaccaagggcatcctgaacaagaatgaaagaatcaacaccaagggccgcatcaccaaggagatgattgtgcaggacagcgacagccccctgaagggcggcatcctgtgtgaggaggacctgcagaagagtgacaccgtcatcgagagcaacaccttctgcagcaagagcaacctgaacagcaccatcagcaagaacttccacaggaacaagctgaacaccacccagaacagcaaggtgcagggcctgctgaccaagaggaagagccgcagcctgaacaagatcagcctgggcgcccccaagaagcgggagatcggccagagggacaaggtgttcccccacaatgaaagcaagtactgcaagagcacctttgagaacaagagcctcttccacgtgttcaacatcctggagcagaagcccaaggacttctacgccccccagagccaggccgaggtggccagcggctacctgcggggcatggccaagaagagcctggtgtccaaggtgacagacagccacatcaccctgaagagccagaagaagaggaaaggagacaaggtgaaggccagcgccatcctgagcaagcagcacgccaccacccgggccaacagcctggccagcctgaagaagccagacttccctgaggccatcgcccaccacagcatccagaactacatccagagctggctgcagaacatcaacccctaccccaccctgaagcccatcaagagcgcccctgtgtgcagaaatgagacctctgtggtgaactgcagcaacaacagcttctctggaaatgacccccacaccaacagcggcaagatcagcaactttgtgatggagagcaacaagcacatcaccaagattgctggcctgaccggggacaacctgtgcaaggagggggacaagagcttcatcgccaatgacacaggagaggaggacctgcacgagacccaggtgggcagcctgaatgatgcctacctggtgcccctgcacgagcactgcaccctgagccagagcgccatcaatgaccacaacaccaagagccacatcgctgctgagaagagcggccctgagaagaagctggtgtaccaggagatcaacctggccaggaagaggcagagcgtggaggccgccatccaggtggaccccatcgaggaggagacccccaaggacctgctgcctgtgctgatgctgcaccagctgcaggcctctgtgcccggcatccacaagacccagaatggagtggtgcagatgcctggcagcctggccggcgtgcccttccacagcgccatctgcaacagcagcaccaacctgctgctggcctggctgctggtgctgaacctgaagggctccatgaacagcttctgccaggtggatgcccacaaggccaccaacaagagcagcgagaccctggccctgctggagatcctgaagcacatcgccatcacagaggaggctgatgacctgaaggctgctgtggccaacctggtggagagcaccaccagccacttcggcctgtctgagaaggagcaggacatggtgcccatcgacctgagcgccaactgcagcacagtgaacatccagagcgtgcccaagtgcagtgaaaatgaaagaacccagggcatcagcagcctggatggcggctgcagcgccagcgaggcctgtgcccctgaggtgtgtgtgctggaggtgacctgcagcccctgtgagatgtgcaccgtgaacaaggcctacagccccaaggagacctgcaaccccagcgacaccttcttccccagtgatggctacggcgtggaccagacctccatgaacaaggcctgcttcctgggggaggtgtgcagcctgacagacaccgtcttcagtgacaaggcctgtgcccagaaggagaaccacacctatgaaggagcctgccccattgatgagacctacgtgcctgtgaatgtgtgcaacaccatcgacttcctgaacagcaaagaaaacacctacacagacaacctggacagcacagaggagctggagagaggagatgacatccagaaggacctgaacatcctgacagatcctgagtacaagaatggcttcaacaccctggtgagccaccagaatgtgagcaacctgagcagctgtggcctgtgcctgtctgagaaggaggccgagctggacaagaagcacagcagcctggatgactttgagaactgcagcctgaggaagttccaggatgaaaatgcctacaccagctttgacatggaggagcccaggaccagcgaggagcccggcagcatcaccaacagcatgaccagcagcgagaggaacatcagcgagctggagagctttgaggagctggagaaccacgacacagacatcttcaacacagtggtgaatggaggagagcaggccacagaggagctgatccaggaggaggtggaggccagcaagaccctggagctgattgacatcagcagcaagaacatcatggaggagaagaggatgaatggcatcatctatgagatcatcagcaagaggctggccaccccacccagcctggacttctgctatgacagcaagcagaacagcgagaaggagaccaatgaaggagagaccaagatggtgaagatgatggtgaagaccatggagaccggcagctacagcgagagcagcccagacctgaagaagtgcatcaagagccctgtgaccagtgactggagcgactacagaccagacagcgacagcgagcagccctacaagaccagcagtgatgaccccaatgacagcggggagctgacccaggagaaggagtacaacattggatttgtgaagagggccatcgagaagctgtatggcaaggctgacatcatcaagcccagcttcttccctggcagcaccaggaagagccaggtgtgcccctacaacagcgtggagttccagtgcagcaggaaggccagcctgtatgattctgagggccagagctttggcagcagcgagcaggtgagcagcagcagctccatgctgcaggagttccaggaggagcggcaggacaagtgtgatgtgtctgctgtgcgggacaactactgccgcggggacatcgtggagcccggcaccaagcagaatgatgacagccgcatcctgacagacatcgaggagggcgtgctgattgacaagggcaagtggctgctgaaggagaaccacctgctgaggatgagcagtgaaaatcctggcatgtgtggaaatgctgacaccacctctgtggacaccctgctggacaacaacagcagcgaggtgccctacagccacttcggcaacctggcccctggccccaccatggatgagctgagcagcagcgagctggaggagctgacccagcccctggagctgaagtgcaactacttcaacatgcctcatggcagtgacagcgagcccttccacgaggacctgctggatgtgagaaatgagacctgtgccaaggagagaattgccaaccaccacacagaggagaagggcagccaccagagcgagcgggtgtgcacctctgtgacccacagcttcatctctgctggcaacaaggtgtaccctgtgtctgatgatgccatcaagaaccagcccctgcccggcagcaacatgatccacggcaccctgcaggaggccgacagcctggacaagctgtatgccctgtgtggccagcactgccccatcctgaccgtcatcatccagcccatgaatgaagaagatcggggctttgcctacaggaaggagagtgacatcgagaacttcctgggcttctacctgtggatgaagatccacccctacctgctgcagacagacaagaatgtgttccgggaggagaacaacaaggcctccatgaggcagaacctgattgacaatgccatcggggacatctttgaccagttctacttcagcaacacctttgacctgatgggcaagaggaggaagcagaagaggatcaacttcctgggcctggaggaggagggcaacctgaagaagttccagcctgacctgaaggagcgcttctgcatgaacttcctgcacaccagcctgctggtggtgggcaatgtggacagcaacacccaggacctgagcggccagaccaatgagatcttcaaggctgtggatgagaacaacaacctgctgaacaaccgcttccagggcagcaggaccaacctgaaccaggtggtgcgggagaacatcaactgccactacttctttgagatgctgggccaggcctgcctgctggacatctgccaggtggagaccagcctgaacatcagcaacagaaacatcctggagctgtgcatgtttgaaggagaaaatctcttcatctgggaggaggaggacatcctgaacctgacagacctggagagcagccgggagcaggaggacctgtag

SEQ ID NO: 21610 - DNA, 1212 bp, Artificial Sequence
  Description of Artificial Sequence: Synthetic coding sequence
atgaccccacccctgctgcaccacgacctgaagacccagaacatcctgctggacaatgagttccacgtgaagattgctgactttggcctgagcaagtggaggatgatgagcctgagccagagccgcagcagcaagagcgcccctgagggcggcaccatcatctacatgcccccagaaaattatgagcccggccagaagagccgggccagcatcaagcatgacatctacagctatgctgtgatcacctgggaggtgctgagcaggaagcagccctttgaagatgtgaccaaccccctgcagatcatgtacagcgtgtcccagggccacaggcctgtgatcaatgaggagagcctgccctatgacatcccccaccgggccaggatgatcagcctcatcgagagcggctgggcccagaacccagatgagcggcccagcttcctgaagtgcctgattgagctggagcctgtgctgcggacctttgaggagatcaccttcctggaggccgtcatccagctgaagaagaccaagctgcagagcgtgagcagcgccatccacctgtgtgacaagaagaagatggagctgagcctgaacatccctgtgaaccacggcccccaggaggagagctgtggcagcagccagctgcacgagaacagcggcagccctgagaccagccgcagcctgcctgccccccaggacaatgacttcctgagcaggaaggcccaggactgctacttcatgaagctgcaccactgccccggcaaccacagctgggacagcaccatcagcggcagccagagagctgccttctgtgaccacaagaccaccccctgcagcagcgccatcatcaaccccctgagcacagctggcaacagcgagcggctgcagcccggcatcgcccagcagtggatccagagcaagcgggaggacatcgtgaaccagatgacagaggcctgcctgaaccagagcctggatgccctgctgagccgggacctgatcatgaaggaggactatgagctggtgtccaccaagcccaccaggaccagcaaggtgcggcagctgctggacaccacagacatccagggcgaggagtttgccaaggtgattgtgcagaagctgaaggacaacaagcagatgggcctgcagccctacccagagatcctggtggtgagccgcagccccagcctgaacctgctgcagaacaagtccatgtag

SEQ ID NO: 21611 - DNA, 10377 bp, Artificial Sequence
  Description of Artificial Sequence: Synthetic coding sequence
atggagaggagcggctgggcccggcagaccttcctgctggccctgctgctgggcgccaccctgcgggcccgggctgctgctggctactacccccgcttcagccccttcttcttcctgtgcacccaccacggggagctggagggagatggagagcagggcgaggtgctgatcagcctgcacatcgccggcaaccccacctactacgtgcccggccaggagtaccacgtgaccatcagcaccagcaccttctttgatggcctgctggtgacaggcctgtacaccagcacctctgtgcaggccagccagagcatcggcggcagcagcgccttcggcttcggcatcatgtctgaccaccagtttggaaaccagttcatgtgcagcgtggtggccagccacgtgagccacctgcccaccaccaacctgtccttcatctggatcgcccccccagctggcaccggctgtgtgaacttcatggccacagccacccaccggggccaggtgatcttcaaggatgccctggcccagcagctgtgtgagcagggcgcccccacagatgtgacagtgcacccccacctggccgagatccacagcgacagcatcatcctgagagatgactttgacagctaccaccagctgcagctgaaccccaacatctgggtggagtgcaacaactgtgaaacaggagagcagtgtggggccatcatgcacggcaatgctgtgaccttctgtgagccctacggcccccgggagctgatcaccaccggcctgaacaccaccacagcctctgtgctgcagttcagcatcggcagcggcagctgccgcttctcctacagcgaccccagcatcatcgtgctgtatgccaagaacaacagcgctgactggatccagctggagaagatccgggcccccagcaatgtgtccaccatcatccacatcctgtacctgcctgaagatgccaagggggagaatgtgcagttccagtggaagcaggagaacctgcgggtgggggaggtgtatgaggcctgctgggccctggacaacatcctgatcatcaacagcgcccaccggcaggtggtgctggaggacagcctggaccctgtggacaccggcaactggctgttcttccctggggccaccgtgaagcacagctgccagagtgatggcaacagcatctacttccacggcaatgaaggcagcgagttcaactttgccaccaccagagatgtggacctgagcacagaggacatccaggagcagtggagcgaggagtttgagagccagcccaccggctgggatgtgctgggcgccgtcatcggcacagaatgtggcaccattgaaagtggcctgtccatggtgttcctgaaggatggagagaggaagctgtgcacccccagcatggacaccaccggctacggcaacctgcgcttctactttgtgatgggcggcatctgtgaccccggcaacagccatgaaaatgacatcatcctgtatgccaagattgagggcaggaaggagcacatcaccctggacaccctgagctacagcagctacaaggtgcccagcctggtgtctgtggtgatcaaccctgagctgcagaccccagccaccaagttctgcctgcggcagaagaaccaccagggccacaacagaaatgtgtgggccgtggacttcttccacgtgctgcctgtgctgcccagcaccatgagccacatgatccagttcagcatcaacctgggctgcggcacccaccagcccggcaacagcgtgtccctggagttcagcaccaaccacggccgctcctggagcctgctgcacacagaatgtctgcctgagatctgtgccggcccccacctgccccacagcacagtgtacagcagcgagaactacagcggctggaaccgcatcaccatccccctgcccaatgctgccctgaccaggaacacccgcatccgctggaggcagacaggccccatcctgggcaacatgtgggccatcgacaacgtgtacatcggccccagctgcctgaagttctgcagcggccggggccagtgcaccaggcatggctgcaagtgtgaccccggcttcagcggccctgcctgtgagatggccagccagaccttccccatgttcatcagcgagagctttggcagcagccggctgagcagctaccacaacttctacagcatcagaggagctgaggtgtcctttggctgcggcgtgctggccagcggcaaggccctggtgttcaacaaggatggccggcggcagctgatcaccagcttcctggacagcagccagagccgcttcctgcagttcaccctgcggctgggcagcaagtctgtgctgagcacctgccgggccccagaccagcctggagagggcgtgctgctgcactacagctatgacaatggcatcacctggaagctgctggagcactacagctacctgagctaccacgagccccgcatcatctctgtggagctgcctggagatgccaagcagtttggcatccagttccgctggtggcagccctaccacagcagccagagagaagatgtgtgggccattgatgagatcatcatgacctctgtgctcttcaacagcatcagcctggacttcaccaacctggtggaggtgacccagagcctgggcttctacctgggcaatgtgcagccctactgcggccatgactggaccctgtgcttcaccggggacagcaagctggccagctccatgagatatgtggagacccagagcatgcagatcggggccagctacatgatccagttcagcctggtgatgggctgcggccagaagtacaccccccacatggacaaccaggtgaagctggagtacagcaccaaccacggcctgacctggcacctggtgcaggaggagtgcctgcccagcatgcccagctgccaggagttcaccagcgccagcatctaccacgccagcgagttcacccagtggaggagagtgattgtgctgctgccccagaagacctggagcagcgccacccgcttccgctggagccagagctactacacagcccaggatgagtgggccctggacagcatctacatcggccagcagtgccccaacatgtgcagcggccacggcagctgtgaccacggcatctgccgctgtgaccagggctaccagggcacagagtgccaccctgaggccgccctgcccagcaccatcatgtctgactttgagaaccagaatggctgggagagtgactggcaggaggtgattggaggagaaattgtgaagccagagcagggctgtggggtcatcagcagcggcagcagcctgtacttcagcaaggccggcaagaggcagctggtgtcctgggacctggacacctcctgggtggactttgtgcagttctacatccagatcggcggggagagcgccagctgcaacaagccagacagccgggaggagggcgtgctgctgcagtacagcaacaacggcggcatccagtggcacctgctggccgagatgtacttcagtgacttcagcaagcccaggtttgtgtacctggagctgcctgctgctgccaagaccccctgcacccgcttccgctggtggcagcccgtcttctctggagaagattatgaccagtgggccgtggatgacatcatcatcctgtctgagaagcagaagcagatcatccctgtgatcaaccccaccctgccccagaacttctatgagaagccagcctttgactaccccatgaaccagatgtctgtgtggctgatgctggccaatgaaggcatggtgaagaatgagaccttctgtgccgccaccccatctgccatgatctttgggaagagtgatggagacagatttgctgtgacccgggacctgaccctgaagccaggctacgtgctgcagttcaagctgaacatcggctgtgccaaccagttcagcagcacagcccctgtgctgctgcagtacagccatgatgctggcatgtcctggttcctggtgaaggagggctgctacccagccagcgctgggaagggctgtgagggcaacagccgggagctgtctgagcccaccatgtaccacactggagactttgaggagtggacccgcatcaccatcgtcatccccaggagcctggccagcagcaagacccgcttccgctggatccaggagagcagcagccagaagaatgtgcccccatttggcctggatggagtgtacatcagcgagccctgccccagctactgcagcggccatggagactgcatcagcggcgtgtgcttctgtgacctgggctacacagctgcccagggcacctgtgtgtccaatgtgcccaaccacaatgagatgtttgacagatttgagggcaagctgagccccctgtggtacaagatcaccggggcccaggtgggcaccggctgcggcaccctgaatgatggcaagagcctgtacttcaacggccctgggaagcgggaggccaggacagtgcccctggacaccaggaacatccggctggtgcagttctacatccagatcggcagcaagaccagcggcatcacctgcatcaagcccaggaccagaaatgaaggcctcatcgtgcagtacagcaatgacaatggcatcctgtggcacctgctgcgggagctggacttcatgtccttcctggagccccagatcatcagcattgacctgccccaggatgccaagaccccagccacagccttccgctggtggcagccccagcacggcaagcacagcgcccagtgggccctggatgatgtgctgattggcatgaatgacagcagccagacaggcttccaggacaagtttgatggcagcattgacctgcaggccaactggtaccgcatccagggcggccaggtggacatcgactgcctgtccatggacacagccctgatcttcacagaaaatattggcaagcccaggtatgcagagacctgggacttccacgtgtctgccagcaccttcctgcagtttgagatgtccatgggctgcagcaagcccttcagcaacagccacagcgtgcagctgcagtacagcctgaacaacgggaaggactggcacctggtgacagaggagtgtgtgccccccaccatcggctgcctgcactacacagagagcagcatctacaccagcgagcgcttccagaactggaagaggatcaccgtgtacctgcccctgagcaccatcagccccaggacccgcttccgctggatccaggccaactacacagtgggcgctgacagctgggccatcgacaacgtggtgctggccagcggctgcccctggatgtgcagcggccggggcatctgtgatgctggccgctgtgtgtgtgaccggggctttggaggcccctactgtgtgcctgtggtgcccctgcccagcatcctgaaggatgacttcaatggaaacctgcacccagacctgtggccagaggtgtatggagctgagcggggcaacctgaatggagagaccatcaagagcggcaccagcctcatcttcaagggggagggcctgaggatgctgatcagccgggacctggactgcaccaacaccatgtatgtgcagttcagcctgcgcttcatcgccaagagcaccccagagaggagccacagcatcctgctgcagttcagcatcagcggcggcatcacctggcacctgatggatgagttctacttcccccagaccaccaacatcctcttcatcaacgtgcccctgccctacacagcccagaccaatgccacccgcttccggctgtggcagccctacaacaacgggaagaaggaggagatctggatcgtggatgacttcatcattgatggcaacaacgtgaacaaccctgtgatgctgctggacacctttgattttggcccccgggaggacaactggttcttctacccaggcggcaacatcggcctgtactgcccctacagcagcaaaggagcccctgaggaggacagcgccatggtgtttgtgtccaatgaggtgggggagcacagcatcaccacccgggacctgaatgtgaatgaaaacaccatcatccagtttgagatcaacgtgggctgcagcacagacagcagcagcgctgaccctgtgcggctggagttcagccgggactttggagccacctggcacctgctgctgcccctgtgctaccacagcagcagccacgtgagcagcctgtgcagcacagagcaccaccccagcagcacctactatgccggcaccatgcagggctggaggcgggaggtggtgcactttgggaagctgcacctgtgtggctctgtgcgcttccgctggtaccagggcttctacccagctggcagccagcctgtgacctgggccatcgacaacgtgtacatcggcccccagtgtgaggagatgtgcaatggccagggcagctgcatcaatggcaccaagtgcatctgtgaccccggctacagcggccccacctgcaagatcagcaccaagaacccagacttcctgaaggatgactttgagggccagctggagagtgaccgcttcctgctgatgtctgggggcaagcccagcaggaaatgtggcatcctgagcagcggcaacaacctcttcttcaatgaagatggcctgaggatgctgatgacccgggacctggacctgagccacgccaggtttgtgcagttcttcatgaggctgggctgtgggaagggcgtgcctgaccccaggagccagcctgtgctgctgcagtacagcctgaatggaggcctgtcctggagcctgctgcaggagttcctgttcagcaacagcagcaatgtgggccgctacatcgccctggagatccccctgaaggcccggagcggcagcacccggctgcgctggtggcagcccagtgaaaatggccacttctacagcccctgggtgattgaccagatcctgattggaggcaacatcagcggcaacacagtgctggaggatgacttcaccaccctggacagcaggaagtggctgctgcaccctgggggcaccaagatgcctgtgtgtggcagcactggagatgccctggtgttcatcgagaaggccagcacccgctacgtggtgtccacagatgtggccgtgaatgaagacagcttcctgcagattgactttgctgccagctgcagcgtgacagacagctgctacgccatcgagctggagtacagcgtggacctgggcctgtcctggcaccccctggtgcgggactgcctgcccaccaacgtggagtgcagccgctaccacctgcagaggatcctggtgtctgacaccttcaacaagtggacccgcatcaccctgcccctgcccccctacaccaggagccaggccacccgcttccgctggcaccagcctgccccctttgacaagcagcagacctgggccatcgacaacgtgtacatcggagatggctgcatcgacatgtgcagcggccacggccgctgcatccagggcaactgtgtgtgtgatgagcagtggggcggcctgtactgtgatgatcctgagaccagcctgcccacccagctgaaggacaacttcaacagagcccccagcagccagaactggctgactgtgaatggaggcaagctgagcacagtgtgtggggctgtggccagcggcatggccctgcacttcagcggcggctgcagccggctgctggtgacagtggacctgaacctgaccaatgctgagttcatccagttctacttcatgtatggctgcctgatcacccccaacaacagaaaccagggcgtgctgctggagtacagcgtgaatggaggcatcacctggaacctgctgatggagatcttctatgaccagtacagcaagccaggctttgtgaacatcctgctgcccccagatgccaaggagatcgccacccgcttccgctggtggcagcccaggcatgatggcctggaccagaatgactgggccatcgacaacgtgctgatcagcggcagcgctgaccagaggacagtgatgctggacaccttcagcagcgcccctgtgccccagcacgagaggagccctgcagatgctggccctgtgggcagaattgcctttgacatgttcatggaggacaagacctctgtgaatgagcactggctgttccatgatgactgcaccgtggagcgcttctgtgacagcccagatggagtgatgctgtgtggcagccatgatggccgggaggtgtatgctgtgacccatgacctgacccccacagagggctggatcatgcagttcaagatctctgtgggctgcaaggtgtctgagaagatcgcccagaaccagatccacgtgcagtacagcacagactttggagtgtcctggaactacctggtgccccagtgcctgcctgctgaccccaagtgcagcggctctgtgtcccagcccagcgtcttcttccccaccaagggctggaagaggatcacctaccccctgcctgagagcctggtgggcaaccctgtgcgcttccgcttctaccagaagtacagcgacatgcagtgggccatcgacaacttctacctgggccctggctgcctggacaactgccggggccatggagactgcctgcgggagcagtgcatctgtgaccccggctacagcggccccaactgctacctgacccacaccctgaagaccttcctgaaggagagatttgacagcgaggagatcaagccagacctgtggatgagcctggagggcggcagcacctgcacagaatgtggcatcctggccgaggacacagccctgtactttggaggcagcacagtgcggcaggccgtgacccaggacctggacctgcggggggccaagttcctgcagtactggggccgcatcggcagcgagaacaacatgaccagctgccaccggcccatctgcaggaaggagggcgtgctgctggactacagcacagatggcggcatcacctggaccctgctgcacgagatggactaccagaagtacatctctgtgagacatgactacatcctgctgcctgaagatgccctgaccaacaccacccggctgcgctggtggcagccctttgtgatcagcaatggaattgtggtgtctggagtggagcgggcccagtgggccctggacaacatcctgattggaggagctgagatcaaccccagccagctggtggacacctttgatgatgagggcaccagccatgaggagaactggagcttctacccaaatgctgtgaggacagctggcttctgtggcaaccccagcttccacctgtactggcccaacaagaagaaggacaagacccacaatgccctgagcagccgggagctgatcatccagcccggctacatgatgcagttcaagatcgtggtgggctgtgaggccaccagctgtggggacctgcacagcgtgatgctggagtacaccaaggatgcccggagtgacagctggcagctggtgcagacccagtgcctgcccagcagcagcaacagcatcggctgcagccccttccagttccacgaggccaccatctacaacagcgtgaacagcagctcctggaagaggatcaccatccagctgcctgaccacgtgagcagcagcgccacccagttccgctggatccagaagggggaggagacagagaagcagagctgggccatcgaccacgtgtacatcggggaggcctgccccaagctgtgcagcggccacggctactgcaccactggagccatctgcatctgtgatgagagcttccagggagatgactgcagcgtcttcagccatgacctgcccagctacatcaaggacaactttgaaagtgcccgggtgacagaggccaactgggagaccatccagggcggcgtgattggcagcggctgcggccagctggccccctatgcccatggagacagcctgtacttcaacggctgccagatccggcaggccgccaccaagcccctggacctgacccgggccagcaagatcatgtttgtgctgcagatcggctccatgagccagacagacagctgcaacagcgacctgagcggcccccatgctgtggacaaggctgtgctgctgcagtacagcgtgaacaacggcatcacctggcacgtgattgcccagcaccagcccaaggacttcacccaggcccagagggtgtcctacaacgtgcccctggaggccaggatgaagggcgtgctgctgcgctggtggcagcccaggcacaatggaactggacatgaccagtgggccctggaccacgtggaggtggtgctgaccaggaagcagaactacatgatgaacttcagccggcagcacggcctgcggcacttctacaacagaagaagaagaagcctgcggcgctacccctag

SEQ ID NO: 21612 - DNA, 10383 bp, Artificial Sequence
  Description of Artificial Sequence: Synthetic coding sequence
atggagaggagcggctgggcccggcagaccttcctgctggccctgctgctgggcgccaccctgcgggcccgggctgctgctggctactacccccgcttcagccccttcttcttcctgtgcacccaccacggggagctggagggagatggagagcagggcgaggtgctgatcagcctgcacatcgccggcaaccccacctactacgtgcccggccaggagtaccacgtgaccatcagcaccagcaccttctttgatggcctgctggtgacaggcctgtacaccagcacctctgtgcaggccagccagagcatcggcggcagcagcgccttcggcttcggcatcatgtctgaccaccagtttggaaaccagttcatgtgcagcgtggtggccagccacgtgagccacctgcccaccaccaacctgtccttcatctggatcgcccccccagctggcaccggctgtgtgaacttcatggccacagccacccaccggggccaggtgatcttcaaggatgccctggcccagcagctgtgtgagcagggcgcccccacagatgtgacagtgcacccccacctggccgagatccacagcgacagcatcatcctgagagatgactttgacagctaccaccagctgcagctgaaccccaacatctgggtggagtgcaacaactgtgaaacaggagagcagtgtggggccatcatgcacggcaatgctgtgaccttctgtgagccctacggcccccgggagctgatcaccaccggcctgaacaccaccacagcctctgtgctgcagttcagcatcggcagcggcagctgccgcttctcctacagcgaccccagcatcatcgtgctgtatgccaagaacaacagcgctgactggatccagctggagaagatccgggcccccagcaatgtgtccaccatcatccacatcctgtacctgcctgaagatgccaagggggagaatgtgcagttccagtggaagcaggagaacctgcgggtgggggaggtgtatgaggcctgctgggccctggacaacatcctgatcatcaacagcgcccaccggcaggtggtgctggaggacagcctggaccctgtggacaccggcaactggctgttcttccctggggccaccgtgaagcacagctgccagagtgatggcaacagcatctacttccacggcaatgaaggcagcgagttcaactttgccaccaccagagatgtggacctgagcacagaggacatccaggagcagtggagcgaggagtttgagagccagcccaccggctgggatgtgctgggcgccgtcatcggcacagaatgtggcaccattgaaagtggcctgtccatggtgttcctgaaggatggagagaggaagctgtgcacccccagcatggacaccaccggctacggcaacctgcgcttctactttgtgatgggcggcatctgtgaccccggcaacagccatgaaaatgacatcatcctgtatgccaagattgagggcaggaaggagcacatcaccctggacaccctgagctacagcagctacaaggtgcccagcctggtgtctgtggtgatcaaccctgagctgcagaccccagccaccaagttctgcctgcggcagaagaaccaccagggccacaacagaaatgtgtgggccgtggacttcttccacgtgctgcctgtgctgcccagcaccatgagccacatgatccagttcagcatcaacctgggctgcggcacccaccagcccggcaacagcgtgtccctggagttcagcaccaaccacggccgctcctggagcctgctgcacacagaatgtctgcctgagatctgtgccggcccccacctgccccacagcacagtgtacagcagcgagaactacagcggctggaaccgcatcaccatccccctgcccaatgctgccctgaccaggaacacccgcatccgctggaggcagacaggccccatcctgggcaacatgtgggccatcgacaacgtgtacatcggccccagctgcctgaagttctgcagcggccggggccagtgcaccaggcatggctgcaagtgtgaccccggcttcagcggccctgcctgtgagatggccagccagaccttccccatgttcatcagcgagagctttggcagcagccggctgagcagctaccacaacttctacagcatcagaggagctgaggtgtcctttggctgcggcgtgctggccagcggcaaggccctggtgttcaacaaggatggccggcggcagctgatcaccagcttcctggacagcagccagagccgcttcctgcagttcaccctgcggctgggcagcaagtctgtgctgagcacctgccgggccccagaccagcctggagagggcgtgctgctgcactacagctatgacaatggcatcacctggaagctgctggagcactacagctacctgagctaccacgagccccgcatcatctctgtggagctgcctggagatgccaagcagtttggcatccagttccgctggtggcagccctaccacagcagccagagagaagatgtgtgggccattgatgagatcatcatgacctctgtgctcttcaacagcatcagcctggacttcaccaacctggtggaggtgacccagagcctgggcttctacctgggcaatgtgcagccctactgcggccatgactggaccctgtgcttcaccggggacagcaagctggccagctccatgagatatgtggagacccagagcatgcagatcggggccagctacatgatccagttcagcctggtgatgggctgcggccagaagtacaccccccacatggacaaccaggtgaagctggagtacagcaccaaccacggcctgacctggcacctggtgcaggaggagtgcctgcccagcatgcccagctgccaggagttcaccagcgccagcatctaccacgccagcgagttcacccagtggaggagagtgattgtgctgctgccccagaagacctggagcagcgccacccgcttccgctggagccagagctactacacagcccaggatgagtgggccctggacagcatctacatcggccagcagtgccccaacatgtgcagcggccacggcagctgtgaccacggcatctgccgctgtgaccagggctaccagggcacagagtgccaccctgaggccgccctgcccagcaccatcatgtctgactttgagaaccagaatggctgggagagtgactggcaggaggtgattggaggagaaattgtgaagccagagcagggctgtggggtcatcagcagcggcagcagcctgtacttcagcaaggccggcaagaggcagctggtgtcctgggacctggacacctcctgggtggactttgtgcagttctacatccagatcggcggggagagcgccagctgcaacaagccagacagccgggaggagggcgtgctgctgcagtacagcaacaacggcggcatccagtggcacctgctggccgagatgtacttcagtgacttcagcaagcccaggtttgtgtacctggagctgcctgctgctgccaagaccccctgcacccgcttccgctggtggcagcccgtcttctctggagaagattatgaccagtgggccgtggatgacatcatcatcctgtctgagaagcagaagcagatcatccctgtgatcaaccccaccctgccccagaacttctatgagaagccagcctttgactaccccatgaaccagatgtctgtgtggctgatgctggccaatgaaggcatggtgaagaatgagaccttctgtgccgccaccccatctgccatgatctttgggaagagtgatggagacagatttgctgtgacccgggacctgaccctgaagccaggctacgtgctgcagttcaagctgaacatcggctgtgccaaccagttcagcagcacagcccctgtgctgctgcagtacagccatgatgctggcatgtcctggttcctggtgaaggagggctgctacccagccagcgctgggaagggctgtgagggcaacagccgggagctgtctgagcccaccatgtaccacactggagactttgaggagtggacccgcatcaccatcgtcatccccaggagcctggccagcagcaagacccgcttccgctggatccaggagagcagcagccagaagaatgtgcccccatttggcctggatggagtgtacatcagcgagccctgccccagctactgcagcggccatggagactgcatcagcggcgtgtgcttctgtgacctgggctacacagctgcccagggcacctgtgtgtccaatgtgcccaaccacaatgagatgtttgacagatttgagggcaagctgagccccctgtggtacaagatcaccggggcccaggtgggcaccggctgcggcaccctgaatgatggcaagagcctgtacttcaacggccctgggaagcgggaggccaggacagtgcccctggacaccaggaacatccggctggtgcagttctacatccagatcggcagcaagaccagcggcatcacctgcatcaagcccaggaccagaaatgaaggcctcatcgtgcagtacagcaatgacaatggcatcctgtggcacctgctgcgggagctggacttcatgtccttcctggagccccagatcatcagcattgacctgccccaggatgccaagaccccagccacagccttccgctggtggcagccccagcacggcaagcacagcgcccagtgggccctggatgatgtgctgattggcatgaatgacagcagccagacaggcttccaggacaagtttgatggcagcattgacctgcaggccaactggtaccgcatccagggcggccaggtggacatcgactgcctgtccatggacacagccctgatcttcacagaaaatattggcaagcccaggtatgcagagacctgggacttccacgtgtctgccagcaccttcctgcagtttgagatgtccatgggctgcagcaagcccttcagcaacagccacagcgtgcagctgcagtacagcctgaacaacgggaaggactggcacctggtgacagaggagtgtgtgccccccaccatcggctgcctgcactacacagagagcagcatctacaccagcgagcgcttccagaactggaagaggatcaccgtgtacctgcccctgagcaccatcagccccaggacccgcttccgctggatccaggccaactacacagtgggcgctgacagctgggccatcgacaacgtggtgctggccagcggctgcccctggatgtgcagcggccggggcatctgtgatgctggccgctgtgtgtgtgaccggggctttggaggcccctactgtgtgcctgtggtgcccctgcccagcatcctgaaggatgacttcaatggaaacctgcacccagacctgtggccagaggtgtatggagctgagcggggcaacctgaatggagagaccatcaagagcggcaccagcctcatcttcaagggggagggcctgaggatgctgatcagccgggacctggactgcaccaacaccatgtatgtgcagttcagcctgcgcttcatcgccaagagcaccccagagaggagccacagcatcctgctgcagttcagcatcagcggcggcatcacctggcacctgatggatgagttctacttcccccagaccaccaacatcctcttcatcaacgtgcccctgccctacacagcccagaccaatgccacccgcttccggctgtggcagccctacaacaacgggaagaaggaggagatctggatcgtggatgacttcatcattgatggcaacaacgtgaacaaccctgtgatgctgctggacacctttgattttggcccccgggaggacaactggttcttctacccaggcggcaacatcggcctgtactgcccctacagcagcaaaggagcccctgaggaggacagcgccatggtgtttgtgtccaatgaggtgggggagcacagcatcaccacccgggacctgaatgtgaatgaaaacaccatcatccagtttgagatcaacgtgggctgcagcacagacagcagcagcgctgaccctgtgcggctggagttcagccgggactttggagccacctggcacctgctgctgcccctgtgctaccacagcagcagccacgtgagcagcctgtgcagcacagagcaccaccccagcagcacctactatgccggcaccatgcagggctggaggcgggaggtggtgcactttgggaagctgcacctgtgtggctctgtgcgcttccgctggtaccagggcttctacccagctggcagccagcctgtgacctgggccatcgacaacgtgtacatcggcccccagtgtgaggagatgtgcaatggccagggcagctgcatcaatggcaccaagtgcatctgtgaccccggctacagcggccccacctgcaagatcagcaccaagaacccagacttcctgaaggatgactttgagggccagctggagagtgaccgcttcctgctgatgtctgggggcaagcccagcaggaaatgtggcatcctgagcagcggcaacaacctcttcttcaatgaagatggcctgaggatgctgatgacccgggacctggacctgagccacgccaggtttgtgcagttcttcatgaggctgggctgtgggaagggcgtgcctgaccccaggagccagcctgtgctgctgcagtacagcctgaatggaggcctgtcctggagcctgctgcaggagttcctgttcagcaacagcagcaatgtgggccgctacatcgccctggagatccccctgaaggcccggagcggcagcacccggctgcgctggtggcagcccagtgaaaatggccacttctacagcccctgggtgattgaccagatcctgattggaggcaacatcagcggcaacacagtgctggaggatgacttcaccaccctggacagcaggaagtggctgctgcaccctgggggcaccaagatgcctgtgtgtggcagcactggagatgccctggtgttcatcgagaaggccagcacccgctacgtggtgtccacagatgtggccgtgaatgaagacagcttcctgcagattgactttgctgccagctgcagcgtgacagacagctgctacgccatcgagctggagtacagcgtggacctgggcctgtcctggcaccccctggtgcgggactgcctgcccaccaacgtggagtgcagccgctaccacctgcagaggatcctggtgtctgacaccttcaacaagtggacccgcatcaccctgcccctgcccccctacaccaggagccaggccacccgcttccgctggcaccagcctgccccctttgacaagcagcagacctgggccatcgacaacgtgtacatcggagatggctgcatcgacatgtgcagcggccacggccgctgcatccagggcaactgtgtgtgtgatgagcagtggggcggcctgtactgtgatgatcctgagaccagcctgcccacccagctgaaggacaacttcaacagagcccccagcagccagaactggctgactgtgaatggaggcaagctgagcacagtgtgtggggctgtggccagcggcatggccctgcacttcagcggcggctgcagccggctgctggtgacagtggacctgaacctgaccaatgctgagttcatccagttctacttcatgtatggctgcctgatcacccccaacaacagaaaccagggcgtgctgctggagtacagcgtgaatggaggcatcacctggaacctgctgatggagatcttctatgaccagtacagcaagccaggctttgtgaacatcctgctgcccccagatgccaaggagatcgccacccgcttccgctggtggcagcccaggcatgatggcctggaccagaatgactgggccatcgacaacgtgctgatcagcggcagcgctgaccagaggacagtgatgctggacaccttcagcagcgcccctgtgccccagcacgagaggagccctgcagatgctggccctgtgggcagaattgcctttgacatgttcatggaggacaagacctctgtgaatgagcactggctgttccatgatgactgcaccgtggagcgcttctgtgacagcccagatggagtgatgctgtgtggcagccatgatggccgggaggtgtatgctgtgacccatgacctgacccccacagagggctggatcatgcagttcaagatctctgtgggctgcaaggtgtctgagaagatcgcccagaaccagatccacgtgcagtacagcacagactttggagtgtcctggaactacctggtgccccagtgcctgcctgctgaccccaagtgcagcggctctgtgtcccagcccagcgtcttcttccccaccaagggctggaagaggatcacctaccccctgcctgagagcctggtgggcaaccctgtgcgcttccgcttctaccagaagtacagcgacatgcagtgggccatcgacaacttctacctgggccctggctgcctggacaactgccggggccatggagactgcctgcgggagcagtgcatctgtgaccccggctacagcggccccaactgctacctgacccacaccctgaagaccttcctgaaggagagatttgacagcgaggagatcaagccagacctgtggatgagcctggagggcggcagcacctgcacagaatgtggcatcctggccgaggacacagccctgtactttggaggcagcacagtgcggcaggccgtgacccaggacctggacctgcggggggccaagttcctgcagtactggggccgcatcggcagcgagaacaacatgaccagctgccaccggcccatctgcaggaaggagggcgtgctgctggactacagcacagatggcggcatcacctggaccctgctgcacgagatggactaccagaagtacatctctgtgagacatgactacatcctgctgcctgaagatgccctgaccaacaccacccggctgcgctggtggcagccctttgtgatcagcaatggaattgtggtgtctggagtggagcgggcccagtgggccctggacaacatcctgattggaggagctgagatcaaccccagccagctggtggacacctttgatgatgagggcaccagccatgaggagaactggagcttctacccaaatgctgtgaggacagctggcttctgtggcaaccccagcttccacctgtactggcccaacaagaagaaggacaagacccacaatgccctgagcagccgggagctgatcatccagcccggctacatgatgcagttcaagatcgtggtgggctgtgaggccaccagctgtggggacctgcacagcgtgatgctggagtacaccaaggatgcccggagtgacagctggcagctggtgcagacccagtgcctgcccagcagcagcaacagcatcggctgcagccccttccagttccacgaggccaccatctacaacagcgtgaacagcagctcctggaagaggatcaccatccagctgcctgaccacgtgagcagcagcgccacccagttccgctggatccagaagggggaggagacagagaagcagagctgggccatcgaccacgtgtacatcggggaggcctgccccaagctgtgcagcggccacggctactgcaccactggagccatctgcatctgtgatgagagcttccagggagatgactgcagcgtcttcagccatgacctgcccagctacatcaaggacaactttgaaagtgcccgggtgacagaggccaactgggagaccatccagggcggcgtgattggcagcggctgcggccagctggccccctatgcccatggagacagcctgtacttcaacggctgccagatccggcaggccgccaccaagcccctggacctgacccgggccagcaagatcatgtttgtgctgcagatcggctccatgagccagacagacagctgcaacagcgacctgagcggcccccatgctgtggacaaggctgtgctgctgcagtacagcgtgaacaacggcatcacctggcacgtgattgcccagcaccagcccaaggacttcacccaggcccagagggtgtcctacaacgtgcccctggaggccaggatgaagggcgtgctgctgcgctggtggcagcccaggcacaatggaactggacatgaccagtgggccctggaccacgtggaggtggtgctcttcagcaccaggaagcagaactacatgatgaacttcagccggcagcacggcctgcggcacttctacaacagaagaagaagaagcctgcggcgctacccctag

SEQ ID NO: 21613 - DNA, 2934 bp, Artificial Sequence
  Description of Artificial Sequence: Synthetic coding sequence
atgtgcagcggccacggccgctgcatccagggcaactgtgtgtgtgatgagcagtggggcggcctgtactgtgatgatcctgagaccagcctgcccacccagctgaaggacaacttcaacagagcccccagcagccagaactggctgactgtgaatggaggcaagctgagcacagtgtgtggggctgtggccagcggcatggccctgcacttcagcggcggctgcagccggctgctggtgacagtggacctgaacctgaccaatgctgagttcatccagttctacttcatgtatggctgcctgatcacccccaacaacagaaaccagggcgtgctgctggagtacagcgtgaatggaggcatcacctggaacctgctgatggagatcttctatgaccagtacagcaagccaggctttgtgaacatcctgctgcccccagatgccaaggagatcgccacccgcttccgctggtggcagcccaggcatgatggcctggaccagaatgactgggccatcgacaacgtgctgatcagcggcagcgctgaccagaggacagtgatgctggacaccttcagcagcgcccctgtgccccagcacgagaggagccctgcagatgctggccctgtgggccgcatcgcctttgacatgttcatggaggacaagacctctgtgaatgagcactggctgttccatgatgactgcaccgtggagcgcttctgtgacagcccagatggagtgatgctgtgtggcagccatgatggccgggaggtgtatgctgtgacccatgacctgacccccacagagggctggatcatgcagttcaagatctctgtgggctgcaaggtgtctgagaagatcgcccagaaccagatccacgtgcagtacagcacagactttggagtgtcctggaactacctggtgccccagtgcctgcctgctgaccccaagtgcagcggctctgtgtcccagcccagcgtcttcttccccaccaagggctggaagaggatcacctaccccctgcctgagagcctggtgggcaaccctgtgcgcttccgcttctaccagaagtacagcgacatgcagtgggccatcgacaacttctacctgggccctggctgcctggacaactgccggggccacggggactgcctgcgggagcagtgcatctgtgaccccggctacagcggccccaactgctacctgacccacaccctgaagaccttcctgaaggagagatttgattctgaggagatcaagccagacctgtggatgagcctggagggcggcagcacctgcacagaatgtggcatcctggccgaggacacagccctgtactttggaggcagcacagtgcggcaggccgtgacccaggacctggacctgcggggggccaagttcctgcagtactggggcagaattggcagcgagaacaacatgaccagctgccaccggcccatctgcaggaaggagggcgtgctgctggactacagcacagatggcggcatcacctggaccctgctgcacgagatggactaccagaagtacatctctgtgagacatgactacatcctgctgcctgaagatgccctgaccaacaccacccggctgcgctggtggcagcccttcgtcatcagcaatggcatcgtggtgtctggagtggagcgggcccagtgggccctggacaacatcctgattggaggagctgagatcaaccccagccagctggtggacacctttgatgatgagggcaccagccatgaggagaactggagcttctacccaaatgctgtgaggacagctggcttctgtggcaaccccagcttccacctgtactggcccaacaagaagaaggacaagacccacaatgccctgagcagccgggagctgatcatccagcccggctacatgatgcagttcaagatcgtggtgggctgtgaggccaccagctgtggggacctgcacagcgtgatgctggagtacaccaaggatgcccggagtgacagctggcagctggtgcagacccagtgcctgcccagcagcagcaacagcatcggctgcagccccttccagttccacgaggccaccatctacaacagcgtgaacagcagctcctggaagaggatcaccatccagctgcctgaccacgtgagcagcagcgccacccagttccgctggatccagaagggggaggagacagagaagcagagctgggccatcgaccacgtgtacatcggggaggcctgccccaagctgtgcagcggccacggctactgcaccaccggggccatctgcatctgtgatgagagcttccagggagatgactgcagcgtcttcagccatgacctgcccagctacatcaaggacaactttgagagcgcccgggtgacagaggccaactgggagaccatccagggcggcgtcatcggcagcggctgcggccagctggccccctatgcccacggggacagcctgtacttcaacggctgccagatccggcaggccgccaccaagcccctggacctgacccgggccagcaagatcatgtttgtgctgcagatcggctccatgagccagacagacagctgcaacagcgacctgagcggcccccatgctgtggacaaggctgtgctgctgcagtacagcgtgaacaacggcatcacctggcacgtgattgcccagcaccagcccaaggacttcacccaggcccagagggtgtcctacaacgtgcccctggaggccaggatgaagggcgtgctgctgcgctggtggcagcccaggcacaacggcaccggccatgaccagtgggccctggaccacgtggaggtggtgctggtgaccaccaggaagcagaactacatgatgaacttcagccggcagcacggcctgcggcacttctacaacagaagaagaagaagcctgcggcgctacccctag

SEQ ID NO: 21614 - DNA, 10383 bp, Artificial Sequence
  Description of Artificial Sequence: Synthetic coding sequence
atggagaggagcggctgggcccggcagaccttcctgctggccctgctgctgggcgccaccctgcgggcccgggctgctgctggctactacccccgcttcagccccttcttcttcctgtgcacccaccacggggagctggagggagatggagagcagggcgaggtgctgatcagcctgcacatcgccggcaaccccacctactacgtgcccggccaggagtaccacgtgaccatcagcaccagcaccttctttgatggcctgctggtgacaggcctgtacaccagcacctctgtgcaggccagccagagcatcggcggcagcagcgccttcggcttcggcatcatgtctgaccaccagtttggaaaccagttcatgtgcagcgtggtggccagccacgtgagccacctgcccaccaccaacctgtccttcatctggatcgcccccccagctggcaccggctgtgtgaacttcatggccacagccacccaccggggccaggtgatcttcaaggatgccctggcccagcagctgtgtgagcagggcgcccccacagatgtgacagtgcacccccacctggccgagatccacagcgacagcatcatcctgagagatgactttgacagctaccaccagctgcagctgaaccccaacatctgggtggagtgcaacaactgtgaaacaggagagcagtgtggggccatcatgcacggcaatgctgtgaccttctgtgagccctacggcccccgggagctgatcaccaccggcctgaacaccaccacagcctctgtgctgcagttcagcatcggcagcggcagctgccgcttctcctacagcgaccccagcatcatcgtgctgtatgccaagaacaacagcgctgactggatccagctggagaagatccgggcccccagcaatgtgtccaccatcatccacatcctgtacctgcctgaagatgccaagggggagaatgtgcagttccagtggaagcaggagaacctgcgggtgggggaggtgtatgaggcctgctgggccctggacaacatcctgatcatcaacagcgcccaccggcaggtggtgctggaggacagcctggaccctgtggacaccggcaactggctgttcttccctggggccaccgtgaagcacagctgccagagtgatggcaacagcatctacttccacggcaatgaaggcagcgagttcaactttgccaccaccagagatgtggacctgagcacagaggacatccaggagcagtggagcgaggagtttgagagccagcccaccggctgggatgtgctgggcgccgtcatcggcacagaatgtggcaccattgaaagtggcctgtccatggtgttcctgaaggatggagagaggaagctgtgcacccccagcatggacaccaccggctacggcaacctgcgcttctactttgtgatgggcggcatctgtgaccccggcaacagccatgaaaatgacatcatcctgtatgccaagattgagggcaggaaggagcacatcaccctggacaccctgagctacagcagctacaaggtgcccagcctggtgtctgtggtgatcaaccctgagctgcagaccccagccaccaagttctgcctgcggcagaagaaccaccagggccacaacagaaatgtgtgggccgtggacttcttccacgtgctgcctgtgctgcccagcaccatgagccacatgatccagttcagcatcaacctgggctgcggcacccaccagcccggcaacagcgtgtccctggagttcagcaccaaccacggccgctcctggagcctgctgcacacagaatgtctgcctgagatctgtgccggcccccacctgccccacagcacagtgtacagcagcgagaactacagcggctggaaccgcatcaccatccccctgcccaatgctgccctgaccaggaacacccgcatccgctggaggcagacaggccccatcctgggcaacatgtgggccatcgacaacgtgtacatcggccccagctgcctgaagttctgcagcggccggggccagtgcaccaggcatggctgcaagtgtgaccccggcttcagcggccctgcctgtgagatggccagccagaccttccccatgttcatcagcgagagctttggcagcagccggctgagcagctaccacaacttctacagcatcagaggagctgaggtgtcctttggctgcggcgtgctggccagcggcaaggccctggtgttcaacaaggatggccggcggcagctgatcaccagcttcctggacagcagccagagccgcttcctgcagttcaccctgcggctgggcagcaagtctgtgctgagcacctgccgggccccagaccagcctggagagggcgtgctgctgcactacagctatgacaatggcatcacctggaagctgctggagcactacagctacctgagctaccacgagccccgcatcatctctgtggagctgcctggagatgccaagcagtttggcatccagttccgctggtggcagccctaccacagcagccagagagaagatgtgtgggccattgatgagatcatcatgacctctgtgctcttcaacagcatcagcctggacttcaccaacctggtggaggtgacccagagcctgggcttctacctgggcaatgtgcagccctactgcggccatgactggaccctgtgcttcaccggggacagcaagctggccagctccatgagatatgtggagacccagagcatgcagatcggggccagctacatgatccagttcagcctggtgatgggctgcggccagaagtacaccccccacatggacaaccaggtgaagctggagtacagcaccaaccacggcctgacctggcacctggtgcaggaggagtgcctgcccagcatgcccagctgccaggagttcaccagcgccagcatctaccacgccagcgagttcacccagtggaggagagtgattgtgctgctgccccagaagacctggagcagcgccacccgcttccgctggagccagagctactacacagcccaggatgagtgggccctggacagcatctacatcggccagcagtgccccaacatgtgcagcggccacggcagctgtgaccacggcatctgccgctgtgaccagggctaccagggcacagagtgccaccctgaggccgccctgcccagcaccatcatgtctgactttgagaaccagaatggctgggagagtgactggcaggaggtgattggaggagaaattgtgaagccagagcagggctgtggggtcatcagcagcggcagcagcctgtacttcagcaaggccggcaagaggcagctggtgtcctgggacctggacacctcctgggtggactttgtgcagttctacatccagatcggcggggagagcgccagctgcaacaagccagacagccgggaggagggcgtgctgctgcagtacagcaacaacggcggcatccagtggcacctgctggccgagatgtacttcagtgacttcagcaagcccaggtttgtgtacctggagctgcctgctgctgccaagaccccctgcacccgcttccgctggtggcagcccgtcttctctggagaagattatgaccagtgggccgtggatgacatcatcatcctgtctgagaagcagaagcagatcatccctgtgatcaaccccaccctgccccagaacttctatgagaagccagcctttgactaccccatgaaccagatgtctgtgtggctgatgctggccaatgaaggcatggtgaagaatgagaccttctgtgccgccaccccatctgccatgatctttgggaagagtgatggagacagatttgctgtgacccgggacctgaccctgaagccaggctacgtgctgcagttcaagctgaacatcggctgtgccaaccagttcagcagcacagcccctgtgctgctgcagtacagccatgatgctggcatgtcctggttcctggtgaaggagggctgctacccagccagcgctgggaagggctgtgagggcaacagccgggagctgtctgagcccaccatgtaccacactggagactttgaggagtggacccgcatcaccatcgtcatccccaggagcctggccagcagcaagacccgcttccgctggatccaggagagcagcagccagaagaatgtgcccccatttggcctggatggagtgtacatcagcgagccctgccccagctactgcagcggccatggagactgcatcagcggcgtgtgcttctgtgacctgggctacacagctgcccagggcacctgtgtgtccaatgtgcccaaccacaatgagatgtttgacagatttgagggcaagctgagccccctgtggtacaagatcaccggggcccaggtgggcaccggctgcggcaccctgaatgatggcaagagcctgtacttcaacggccctgggaagcgggaggccaggacagtgcccctggacaccaggaacatccggctggtgcagttctacatccagatcggcagcaagaccagcggcatcacctgcatcaagcccaggaccagaaatgaaggcctcatcgtgcagtacagcaatgacaatggcatcctgtggcacctgctgcgggagctggacttcatgtccttcctggagccccagatcatcagcattgacctgccccaggatgccaagaccccagccacagccttccgctggtggcagccccagcacggcaagcacagcgcccagtgggccctggatgatgtgctgattggcatgaatgacagcagccagacaggcttccaggacaagtttgatggcagcattgacctgcaggccaactggtaccgcatccagggcggccaggtggacatcgactgcctgtccatggacacagccctgatcttcacagaaaatattggcaagcccaggtatgcagagacctgggacttccacgtgtctgccagcaccttcctgcagtttgagatgtccatgggctgcagcaagcccttcagcaacagccacagcgtgcagctgcagtacagcctgaacaacgggaaggactggcacctggtgacagaggagtgtgtgccccccaccatcggctgcctgcactacacagagagcagcatctacaccagcgagcgcttccagaactggaagaggatcaccgtgtacctgcccctgagcaccatcagccccaggacccgcttccgctggatccaggccaactacacagtgggcgctgacagctgggccatcgacaacgtggtgctggccagcggctgcccctggatgtgcagcggccggggcatctgtgatgctggccgctgtgtgtgtgaccggggctttggaggcccctactgtgtgcctgtggtgcccctgcccagcatcctgaaggatgacttcaatggaaacctgcacccagacctgtggccagaggtgtatggagctgagcggggcaacctgaatggagagaccatcaagagcggcaccagcctcatcttcaagggggagggcctgaggatgctgatcagccgggacctggactgcaccaacaccatgtatgtgcagttcagcctgcgcttcatcgccaagagcaccccagagaggagccacagcatcctgctgcagttcagcatcagcggcggcatcacctggcacctgatggatgagttctacttcccccagaccaccaacatcctcttcatcaacgtgcccctgccctacacagcccagaccaatgccacccgcttccggctgtggcagccctacaacaacgggaagaaggaggagatctggatcgtggatgacttcatcattgatggcaacaacgtgaacaaccctgtgatgctgctggacacctttgattttggcccccgggaggacaactggttcttctacccaggcggcaacatcggcctgtactgcccctacagcagcaaaggagcccctgaggaggacagcgccatggtgtttgtgtccaatgaggtgggggagcacagcatcaccacccgggacctgaatgtgaatgaaaacaccatcatccagtttgagatcaacgtgggctgcagcacagacagcagcagcgctgaccctgtgcggctggagttcagccgggactttggagccacctggcacctgctgctgcccctgtgctaccacagcagcagccacgtgagcagcctgtgcagcacagagcaccaccccagcagcacctactatgccggcaccatgcagggctggaggcgggaggtggtgcactttgggaagctgcacctgtgtggctctgtgcgcttccgctggtaccagggcttctacccagctggcagccagcctgtgacctgggccatcgacaacgtgtacatcggcccccagtgtgaggagatgtgcaatggccagggcagctgcatcaatggcaccaagtgcatctgtgaccccggctacagcggccccacctgcaagatcagcaccaagaacccagacttcctgaaggatgactttgagggccagctggagagtgaccgcttcctgctgatgtctgggggcaagcccagcaggaaatgtggcatcctgagcagcggcaacaacctcttcttcaatgaagatggcctgaggatgctgatgacccgggacctggacctgagccacgccaggtttgtgcagttcttcatgaggctgggctgtgggaagggcgtgcctgaccccaggagccagcctgtgctgctgcagtacagcctgaatggaggcctgtcctggagcctgctgcaggagttcctgttcagcaacagcagcaatgtgggccgctacatcgccctggagatccccctgaaggcccggagcggcagcacccggctgcgctggtggcagcccagtgaaaatggccacttctacagcccctgggtgattgaccagatcctgattggaggcaacatcagcggcaacacagtgctggaggatgacttcaccaccctggacagcaggaagtggctgctgcaccctgggggcaccaagatgcctgtgtgtggcagcactggagatgccctggtgttcatcgagaaggccagcacccgctacgtggtgtccacagatgtggccgtgaatgaagacagcttcctgcagattgactttgctgccagctgcagcgtgacagacagctgctacgccatcgagctggagtacagcgtggacctgggcctgtcctggcaccccctggtgcgggactgcctgcccaccaacgtggagtgcagccgctaccacctgcagaggatcctggtgtctgacaccttcaacaagtggacccgcatcaccctgcccctgcccccctacaccaggagccaggccacccgcttccgctggcaccagcctgccccctttgacaagcagcagacctgggccatcgacaacgtgtacatcggagatggctgcatcgacatgtgcagcggccacggccgctgcatccagggcaactgtgtgtgtgatgagcagtggggcggcctgtactgtgatgatcctgagaccagcctgcccacccagctgaaggacaacttcaacagagcccccagcagccagaactggctgactgtgaatggaggcaagctgagcacagtgtgtggggctgtggccagcggcatggccctgcacttcagcggcggctgcagccggctgctggtgacagtggacctgaacctgaccaatgctgagttcatccagttctacttcatgtatggctgcctgatcacccccaacaacagaaaccagggcgtgctgctggagtacagcgtgaatggaggcatcacctggaacctgctgatggagatcttctatgaccagtacagcaagccaggctttgtgaacatcctgctgcccccagatgccaaggagatcgccacccgcttccgctggtggcagcccaggcatgatggcctggaccagaatgactgggccatcgacaacgtgctgatcagcggcagcgctgaccagaggacagtgatgctggacaccttcagcagcgcccctgtgccccagcacgagaggagccctgcagatgctggccctgtgggcagaattgcctttgacatgttcatggaggacaagacctctgtgaatgagcactggctgttccatgatgactgcaccgtggagcgcttctgtgacagcccagatggagtgatgctgtgtggcagccatgatggccgggaggtgtatgctgtgacccatgacctgacccccacagagggctggatcatgcagttcaagatctctgtgggctgcaaggtgtctgagaagatcgcccagaaccagatccacgtgcagtacagcacagactttggagtgtcctggaactacctggtgccccagtgcctgcctgctgaccccaagtgcagcggctctgtgtcccagcccagcgtcttcttccccaccaagggctggaagaggatcacctaccccctgcctgagagcctggtgggcaaccctgtgcgcttccgcttctaccagaagtacagcgacatgcagtgggccatcgacaacttctacctgggccctggctgcctggacaactgccggggccatggagactgcctgcgggagcagtgcatctgtgaccccggctacagcggccccaactgctacctgacccacaccctgaagaccttcctgaaggagagatttgacagcgaggagatcaagccagacctgtggatgagcctggagggcggcagcacctgcacagaatgtggcatcctggccgaggacacagccctgtactttggaggcagcacagtgcggcaggccgtgacccaggacctggacctgcggggggccaagttcctgcagtactggggccgcatcggcagcgagaacaacatgaccagctgccaccggcccatctgcaggaaggagggcgtgctgctggactacagcacagatggcggcatcacctggaccctgctgcacgagatggactaccagaagtacatctctgtgagacatgactacatcctgctgcctgaagatgccctgaccaacaccacccggctgcgctggtggcagccctttgtgatcagcaatggaattgtggtgtctggagtggagcgggcccagtgggccctggacaacatcctgattggaggagctgagatcaaccccagccagctggtggacacctttgatgatgagggcaccagccatgaggagaactggagcttctacccaaatgctgtgaggacagctggcttctgtggcaaccccagcttccacctgtactggcccaacaagaagaaggacaagacccacaatgccctgagcagccgggagctgatcatccagcccggctacatgatgcagttcaagatcgtggtgggctgtgaggccaccagctgtggggacctgcacagcgtgatgctggagtacaccaaggatgcccggagtgacagctggcagctggtgcagacccagtgcctgcccagcagcagcaacagcatcggctgcagccccttccagttccacgaggccaccatctacaacagcgtgaacagcagctcctggaagaggatcaccatccagctgcctgaccacgtgagcagcagcgccacccagttccgctggatccagaagggggaggagacagagaagcagagctgggccatcgaccacgtgtacatcggggaggcctgccccaagctgtgcagcggccacggctactgcaccactggagccatctgcatctgtgatgagagcttccagggagatgactgcagcgtcttcagccatgacctgcccagctacatcaaggacaactttgaaagtgcccgggtgacagaggccaactgggagaccatccagggcggcgtgattggcagcggctgcggccagctggccccctatgcccatggagacagcctgtacttcaacggctgccagatccggcaggccgccaccaagcccctggacctgacccgggccagcaagatcatgtttgtgctgcagatcggctccatgagccagacagacagctgcaacagcgacctgagcggcccccatgctgtggacaaggctgtgctgctgcagtacagcgtgaacaacggcatcacctggcacgtgattgcccagcaccagcccaaggacttcacccaggcccagagggtgtcctacaacgtgcccctggaggccaggatgaagggcgtgctgctgcgctggtggcagcccaggcacaatggaactggacatgaccagtgggccctggaccacgtggaggtggtgctggtgtccaccaggaagcagaactacatgatgaacttcagccggcagcacggcctgcggcacttctacaacagaagaagaagaagcctgcggcgctacccctag

SEQ ID NO: 21615 - DNA, 10284 bp, Artificial Sequence
  Description of Artificial Sequence: Synthetic coding sequence
atggagaggagcggctgggcccggcagaccttcctgctggccctgctgctgggcgccaccctgcgggcccgggctgctgctggctactacccccgcttcagccccttcttcttcctgtgcacccaccacggggagctggagggagatggagagcagggcgaggtgctgatcagcctgcacatcgccggcaaccccacctactacgtgcccggccaggagtaccacgtgaccatcagcaccagcaccttctttgatggcctgctggtgacaggcctgtacaccagcacctctgtgcaggccagccagagcatcggcggcagcagcgccttcggcttcggcatcatgtctgaccaccagtttggaaaccagttcatgtgcagcgtggtggccagccacgtgagccacctgcccaccaccaacctgtccttcatctggatcgcccccccagctggcaccggctgtgtgaacttcatggccacagccacccaccggggccaggtgatcttcaaggatgccctggcccagcagctgtgtgagcagggcgcccccacagatgtgacagtgcacccccacctggccgagatccacagcgacagcatcatcctgagagatgactttgacagctaccaccagctgcagctgaaccccaacatctgggtggagtgcaacaactgtgaaacaggagagcagtgtggggccatcatgcacggcaatgctgtgaccttctgtgagccctacggcccccgggagctgatcaccaccggcctgaacaccaccacagcctctgtgctgcagttcagcatcggcagcggcagctgccgcttctcctacagcgaccccagcatcatcgtgctgtatgccaagaacaacagcgctgactggatccagctggagaagatccgggcccccagcaatgtgtccaccatcatccacatcctgtacctgcctgaagatgccaagggggagaatgtgcagttccagtggaagcaggagaacctgcgggtgggggaggtgtatgaggcctgctgggccctggacaacatcctgatcatcaacagcgcccaccggcaggtggtgctggaggacagcctggaccctgtggacaccggcaactggctgttcttccctggggccaccgtgaagcacagctgccagagtgatggcaacagcatctacttccacggcaatgaaggcagcgagttcaactttgccaccaccagagatgtggacctgagcacagaggacatccaggagcagtggagcgaggagtttgagagccagcccaccggctgggatgtgctgggcgccgtcatcggcacagaatgtggcaccattgaaagtggcctgtccatggtgttcctgaaggatggagagaggaagctgtgcacccccagcatggacaccaccggctacggcaacctgcgcttctactttgtgatgggcggcatctgtgaccccggcaacagccatgaaaatgacatcatcctgtatgccaagattgagggcaggaaggagcacatcaccctggacaccctgagctacagcagctacaaggtgcccagcctggtgtctgtggtgatcaaccctgagctgcagaccccagccaccaagttctgcctgcggcagaagaaccaccagggccacaacagaaatgtgtgggccgtggacttcttccacgtgctgcctgtgctgcccagcaccatgagccacatgatccagttcagcatcaacctgggctgcggcacccaccagcccggcaacagcgtgtccctggagttcagcaccaaccacggccgctcctggagcctgctgcacacagaatgtctgcctgagatctgtgccggcccccacctgccccacagcacagtgtacagcagcgagaactacagcggctggaaccgcatcaccatccccctgcccaatgctgccctgaccaggaacacccgcatccgctggaggcagacaggccccatcctgggcaacatgtgggccatcgacaacgtgtacatcggccccagctgcctgaagttctgcagcggccggggccagtgcaccaggcatggctgcaagtgtgaccccggcttcagcggccctgcctgtgagatggccagccagaccttccccatgttcatcagcgagagctttggcagcagccggctgagcagctaccacaacttctacagcatcagaggagctgaggtgtcctttggctgcggcgtgctggccagcggcaaggccctggtgttcaacaaggatggccggcggcagctgatcaccagcttcctggacagcagccagagccgcttcctgcagttcaccctgcggctgggcagcaagtctgtgctgagcacctgccgggccccagaccagcctggagagggcgtgctgctgcactacagctatgacaatggcatcacctggaagctgctggagcactacagctacctgagctaccacgagccccgcatcatctctgtggagctgcctggagatgccaagcagtttggcatccagttccgctggtggcagccctaccacagcagccagagagaagatgtgtgggccattgatgagatcatcatgacctctgtgctcttcaacagcatcagcctggacttcaccaacctggtggaggtgacccagagcctgggcttctacctgggcaatgtgcagccctactgcggccatgactggaccctgtgcttcaccggggacagcaagctggccagctccatgagatatgtggagacccagagcatgcagatcggggccagctacatgatccagttcagcctggtgatgggctgcggccagaagtacaccccccacatggacaaccaggtgaagctggagtacagcaccaaccacggcctgacctggcacctggtgcaggaggagtgcctgcccagcatgcccagctgccaggagttcaccagcgccagcatctaccacgccagcgagttcacccagtggaggagagtgattgtgctgctgccccagaagacctggagcagcgccacccgcttccgctggagccagagctactacacagcccaggatgagtgggccctggacagcatctacatcggccagcagtgccccaacatgtgcagcggccacggcagctgtgaccacggcatctgccgctgtgaccagggctaccagggcacagagtgccaccctgaggccgccctgcccagcaccatcatgtctgactttgagaaccagaatggctgggagagtgactggcaggaggtgattggaggagaaattgtgaagccagagcagggctgtggggtcatcagcagcggcagcagcctgtacttcagcaaggccggcaagaggcagctggtgtcctgggacctggacacctcctgggtggactttgtgcagttctacatccagatcggcggggagagcgccagctgcaacaagccagacagccgggaggagggcgtgctgctgcagtacagcaacaacggcggcatccagtggcacctgctggccgagatgtacttcagtgacttcagcaagcccaggtttgtgtacctggagctgcctgctgctgccaagaccccctgcacccgcttccgctggtggcagcccgtcttctctggagaagattatgaccagtgggccgtggatgacatcatcatcctgtctgagaagcagaagcagatcatccctgtgatcaaccccaccctgccccagaacttctatgagaagccagcctttgactaccccatgaaccagatgtctgtgtggctgatgctggccaatgaaggcatggtgaagaatgagaccttctgtgccgccaccccatctgccatgatctttgggaagagtgatggagacagatttgctgtgacccgggacctgaccctgaagccaggctacgtgctgcagttcaagctgaacatcggctgtgccaaccagttcagcagcacagcccctgtgctgctgcagtacagccatgatgctggcatgtcctggttcctggtgaaggagggctgctacccagccagcgctgggaagggctgtgagggcaacagccgggagctgtctgagcccaccatgtaccacactggagactttgaggagtggacccgcatcaccatcgtcatccccaggagcctggccagcagcaagacccgcttccgctggatccaggagagcagcagccagaagaatgtgcccccatttggcctggatggagtgtacatcagcgagccctgccccagctactgcagcggccatggagactgcatcagcggcgtgtgcttctgtgacctgggctacacagctgcccagggcacctgtgtgtccaatgtgcccaaccacaatgagatgtttgacagatttgagggcaagctgagccccctgtggtacaagatcaccggggcccaggtgggcaccggctgcggcaccctgaatgatggcaagagcctgtacttcaacggccctgggaagcgggaggccaggacagtgcccctggacaccaggaacatccggctggtgcagttctacatccagatcggcagcaagaccagcggcatcacctgcatcaagcccaggaccagaaatgaaggcctcatcgtgcagtacagcaatgacaatggcatcctgtggcacctgctgcgggagctggacttcatgtccttcctggagccccagatcatcagcattgacctgccccaggatgccaagaccccagccacagccttccgctggtggcagccccagcacggcaagcacagcgcccagtgggccctggatgatgtgctgattggcatgaatgacagcagccagacaggcttccaggacaagtttgatggcagcattgacctgcaggccaactggtaccgcatccagggcggccaggtggacatcgactgcctgtccatggacacagccctgatcttcacagaaaatattggcaagcccaggtatgcagagacctgggacttccacgtgtctgccagcaccttcctgcagtttgagatgtccatgggctgcagcaagcccttcagcaacagccacagcgtgcagctgcagtacagcctgaacaacgggaaggactggcacctggtgacagaggagtgtgtgccccccaccatcggctgcctgcactacacagagagcagcatctacaccagcgagcgcttccagaactggaagaggatcaccgtgtacctgcccctgagcaccatcagccccaggacccgcttccgctggatccaggccaactacacagtgggcgctgacagctgggccatcgacaacgtggtgctggccagcggctgcccctggatgtgcagcggccggggcatctgtgatgctggccgctgtgtgtgtgaccggggctttggaggcccctactgtgtgcctgtggtgcccctgcccagcatcctgaaggatgacttcaatggaaacctgcacccagacctgtggccagaggtgtatggagctgagcggggcaacctgaatggagagaccatcaagagcggcaccagcctcatcttcaagggggagggcctgaggatgctgatcagccgggacctggactgcaccaacaccatgtatgtgcagttcagcctgcgcttcatcgccaagagcaccccagagaggagccacagcatcctgctgcagttcagcatcagcggcggcatcacctggcacctgatggatgagttctacttcccccagaccaccaacatcctcttcatcaacgtgcccctgccctacacagcccagaccaatgccacccgcttccggctgtggcagccctacaacaacgggaagaaggaggagatctggatcgtggatgacttcatcattgatggcaacaacgtgaacaaccctgtgatgctgctggacacctttgattttggcccccgggaggacaactggttcttctacccaggcggcaacatcggcctgtactgcccctacagcagcaaaggagcccctgaggaggacagcgccatggtgtttgtgtccaatgaggtgggggagcacagcatcaccacccgggacctgaatgtgaatgaaaacaccatcatccagtttgagatcaacgtgggctgcagcacagacagcagcagcgctgaccctgtgcggctggagttcagccgggactttggagccacctggcacctgctgctgcccctgtgctaccacagcagcagccacgtgagcagcctgtgcagcacagagcaccaccccagcagcacctactatgccggcaccatgcagggctggaggcgggaggtggtgcactttgggaagctgcacctgtgtggctctgtgcgcttccgctggtaccagggcttctacccagctggcagccagcctgtgacctgggccatcgacaacgtgtacatcggcccccagtgtgaggagatgtgcaatggccagggcagctgcatcaatggcaccaagtgcatctgtgaccccggctacagcggccccacctgcaagatcagcaccaagaacccagacttcctgaaggatgactttgagggccagctggagagtgaccgcttcctgctgatgtctgggggcaagcccagcaggaaatgtggcatcctgagcagcggcaacaacctcttcttcaatgaagatggcctgaggatgctgatgacccgggacctggacctgagccacgccaggtttgtgcagttcttcatgaggctgggctgtgggaagggcgtgcctgaccccaggagccagcctgtgctgctgcagtacagcctgaatggaggcctgtcctggagcctgctgcaggagttcctgttcagcaacagcagcaatgtgggccgctacatcgccctggagatccccctgaaggcccggagcggcagcacccggctgcgctggtggcagcccagtgaaaatggccacttctacagcccctgggtgattgaccagatcctgattggaggcaacatcagcggcaacacagtgctggaggatgacttcaccaccctggacagcaggaagtggctgctgcaccctgggggcaccaagatgcctgtgtgtggcagcactggagatgccctggtgttcatcgagaaggccagcacccgctacgtggtgtccacagatgtggccgtgaatgaagacagcttcctgcagattgactttgctgccagctgcagcgtgacagacagctgctacgccatcgagctggagtacagcgtggacctgggcctgtcctggcaccccctggtgcgggactgcctgcccaccaacgtggagtgcagccgctaccacctgcagaggatcctggtgtctgacaccttcaacaagtggacccgcatcaccctgcccctgcccccctacaccaggagccaggccacccgcttccgctggcaccagcctgccccctttgacaagcagcagacctgggccatcgacaacgtgtacatcggagatggctgcatcgacatgtgcagcggccacggccgctgcatccagggcaactgtgtgtgtgatgagcagtggggcggcctgtactgtgatgatcctgagaccagcctgcccacccagctgaaggacaacttcaacagagcccccagcagccagaactggctgactgtgaatggaggcaagctgagcacagtgtgtggggctgtggccagcggcatggccctgcacttcagcggcggctgcagccggctgctggtgacagtggacctgaacctgaccaatgctgagttcatccagttctacttcatgtatggctgcctgatcacccccaacaacagaaaccagggcgtgctgctggagtacagcgtgaatggaggcatcacctggaacctgctgatggagatcttctatgaccagtacagcaagccaggctttgtgaacatcctgctgcccccagatgccaaggagatcgccacccgcttccgctggtggcagcccaggcatgatggcctggaccagaatgactgggccatcgacaacgtgctgatcagcggcagcgctgaccagaggacagtgatgctggacaccttcagcagcgcccctgtgccccagcacgagaggagccctgcagatgctggccctgtgggcagaattgcctttgacatgttcatggaggacaagacctctgtgaatgagcactggctgttccatgatgactgcaccgtggagcgcttctgtgacagcccagatggagtgatgctgtgtggcagccatgatggccgggaggtgtatgctgtgacccatgacctgacccccacagagggctggatcatgcagttcaagatctctgtgggctgcaaggtgtctgagaagatcgcccagaaccagatccacgtgcagtacagcacagactttggagtgtcctggaactacctggtgccccagtgcctgcctgctgaccccaagtgcagcggctctgtgtcccagcccagcgtcttcttccccaccaagggctggaagaggatcacctaccccctgcctgagagcctggtgggcaaccctgtgcgcttccgcttctaccagaagtacagcgacatgcagtgggccatcgacaacttctacctgggccctggctgcctggacaactgccggggccatggagactgcctgcgggagcagtgcatctgtgaccccggctacagcggccccaactgctacctgacccacaccctgaagaccttcctgaaggagagatttgacagcgaggagatcaagccagacctgtggatgagcctggagggcggcagcacctgcacagaatgtggcatcctggccgaggacacagccctgtactttggaggcagcacagtgcggcaggccgtgacccaggacctggacctgcggggggccaagttcctgcagtactggggccgcatcggcagcgagaacaacatgaccagctgccaccggcccatctgcaggaaggagggcgtgctgctggactacagcacagatggcggcatcacctggaccctgctgcacgagatggactaccagaagtacatctctgtgagacatgactacatcctgctgcctgaagatgccctgaccaacaccacccggctgcgctggtggcagccctttgtgatcagcaatggaattgtggtgtctggagtggagcgggcccagtgggccctggacaacatcctgattggaggagctgagatcaaccccagccagctggtggacacctttgatgatgagggcaccagccatgaggagaactggagcttctacccaaatgctgtgaggacagctggcttctgtggcaaccccagcttccacctgtactggcccaacaagaagaaggacaagacccacaatgccctgagcagccgggagctgatcatccagcccggctacatgatgcagttcaagatcgtggtgggctgtgaggccaccagctgtggggacctgcacagcgtgatgctggagtacaccaaggatgcccggagtgacagctggcagctggtgcagacccagtgcctgcccagcagcagcaacagcatcggctgcagccccttccagttccacgaggccaccatctacaacagcgtgaacagcagctcctggaagaggatcaccatccagctgcctgaccacgtgagcagcagcgccacccagttccgctggatccagaagggggaggagacagagaagcagagctgggccatcgaccacgtgtacatcggggaggcctgccccaagctgtgcagcggccacggctactgcaccactggagccatctgcatctgtgatgagagcttccagggagatgactgcagcgtcttcagccatgacctgcccagctacatcaaggacaactttgaaagtgcccgggtgacagaggccaactgggagaccatccagggcggcgtgattggcagcggctgcggccagctggccccctatgcccatggagacagcctgtacttcaacggctgccagatccggcaggccgccaccaagcccctggacctgacccgggccagcaagatcatgtttgtgctgcagatcggctccatgagccagacagacagctgcaacagcgacctgagcggcccccatgctgtggacaaggctgtgctgctgcagtacagcgtgaacaacggcatcacctggcacgtgattgcccagcaccagcccaaggacttcacccaggcccagagggtgtcctacaacgtgcccctggaggccaggatgaagggcgtgctgctgcgctggtggcagcccaggcacaatggaactggacatgaccagtgggccctggaccacgtggaggtggtgctgtag

SEQ ID NO: 21616 - DNA, 1668 bp, Artificial Sequence
  Description of Artificial Sequence: Synthetic coding sequence
atgaagaagcatgactttgctgagaacctgcccagcagcctgctgatcatcatcctggtgatcttcaccctgagcggcagcaagtttggccggggcaccggcctgacccagcccagccagaggaccagcgcccggcgcagctttggccgcagcaagcgcttcagcatcaccaggagcctggatgacctggagagcgccaccgtgtctgatggagagctgaccggggctgacctgaaggactgtgtgagcaacaacagcctgagcagcaatgccagcctgcccagcgtgcagagctgccggcggctgcgggagaggagagtggcctcctgggccgtgtcctttgagcggctgctgcaggaccctgtgggcgtgcgctacttcagtgacttcctgaggaaggagttcagcgaggagaacatcctcttctggcaggcctgtgagtacttcaaccacgtgcctgcccatgacaagaaggagctgagctaccgggcccgggagatcttcagcaagttcctgtgcagcaaggccaccacccctgtgaacatcgacagccaggcccagctggctgatgatgtgctgcgggccccccacccagacatgttcaaggagcagcagctgcagatcttcaacctgatgaagtttgacagctacacccgcttcctgaagagccccctgtaccaggagtgcatcctggccgaggtggagggccgggccctgcctgacagccagcaggtgcccagcagccctgccagcaagcacagcctgggcagtgaccacagctctgtgtccacccccaagaagctgagcggcaagagcaagagcggccgcagcctgaatgaggagctgggagatgaagattctgagaagaagaggaagggggccttcttctcctggagcaggaccaggagcacaggccgcagccagaagaagcgggagcacggggaccatgctgatgatgccctgcacgccaacggcggcctgtgcagaagagagagccagggctctgtgagcagcgctggcagcctggacctgtctgaggcctgcaggaccctggcccctgagaaggacaaggccaccaagcactgctgcatccacctgcctgatggcaccagctgtgtggtggccgtgaaggccggcttcagcatcaaggacatcctgagcggcctgtgtgaaagacatggcatcaacggggctgctgctgacctcttcctggtgggcggggacaagcccctggtgctgcaccaggacagcagcatcctggagagccgggacctgcggctggagaagaggaccctcttccggctggacctggtgcccatcaacagatctgtgggcctgaaggccaagcccaccaagcctgtgacagaggtgctgcggcctgtggtggcccgctatggcctggacctgagcggcctgctggtgcggctgtctggagagaaggagcccctggacctgggcgcccccatcagcagcctggatggccagagggtggtgctggaggagaaggaccccagccggggcaaggccagcgctgacaagcagaagggcgtgcctgtgaagcagaacacagctgtgaacagcagcagcaggaaccacagcgccaccagcttcctgagcctcttccccaagctgcgggccacagagcagatgaccaacgtgggctgctag

SEQ ID NO: 21617 - DNA, 4131 bp, Artificial Sequence
  Description of Artificial Sequence: Synthetic coding sequence
atgttccgggccggggaggccagcaagaggcccctgcccggccccagccccccccgggtgcgctctgtggaggtggcccggggccgggccggctacggcttcaccctgagcggccaggccccctgtgtgctgagctgtgtgatgaggggcagccctgctgactttgtgggcctgcgggccggggaccagatcctggccgtgaatgagatcaacgtgaagaaggccagccatgaagatgtggtgaagctgattggcaagtgcagcggcgtgctgcacatggtgattgctgagggcgtgggccgctttgagagctgcagcagtgatgaggagggcggcctgtatgagggcaagggctggctgaagcccaagctggacagcaaggccctgggcatcaacagagctgagcgggtggtggaggagatgcagagcggcggcatcttcaacatgatctttgagaaccccagcctgtgtgccagcaacagcgagcccctgaagctgaagcagaggagcctgtctgagagcgctgccaccaggtttgatgtgggccacgagagcatcaacaaccccaaccccaacatgctgagcaaggaggagatcagcaaggtgattcatgatgattctgtgttcagcatcggcctggagagccatgatgactttgccctggatgccagcatcctgaatgtggccatgattgtgggctacctgggcagcattgagctgcccagcaccagcagcaacctggagagtgacagcctgcaggccatccggggctgcatgaggcggctgcgggcagagcagaagatccacagcctggtgaccatgaagatcatgcatgactgtgtgcagctgagcacagacaaggccggcgtggtggccgagtacccagctgagaagctggccttctctgctgtgtgcccagatgaccggcgcttcttcggcctggtgaccatgcagaccaatgatgatggcagcctggcccaggaggaggagggcgccctgcggaccagctgccacgtgttcatggtggaccctgacctcttcaaccacaagatccaccagggcatcgccaggagatttggatttgagtgcacagctgaccctgacaccaacggctgcctggagttccctgccagcagcctgcctgtgctgcagttcatctctgtgctgtacagagacatgggagagctgattgagggcatgagggcccgggccttcctggatggagatgctgatgcccaccagaacaacagcaccagcagcaacagcgacagcggcatcggcaacttccaccaggaggagaagagcaacagagtgctggtggtggacctgggcggcagcagcagccgccacggccctgggggcagcgcctgggatggagtgggcggccgcggggcccagccctggggcgccccctggacaggccccttctgcccagaccctgagggcagccccccatttgaggccgcccaccagacagaccgcttctgggacctgaacaagcacctgggccctgccagccctgtggaggtgcccccagccagcctgcggagctctgtgccccccagcaagaggggcaccgtgggcgccggctgcggcttcaaccagcgctggctgcctgtgcacgtgctgcgggagtggcagtgtggccacaccagtgaccaggacagctacacagacagcacagatggctggagcagcatcaactgtggcaccctgcccccacccatgagcaagatcccagctgaccgctacagagtggagggcagctttgcccagccccccctgaatgcccccaagcgggagtggagcaggaaggccttcggcatgcagagcatcttcggcccccacagaaatgtgaggaagaccaaggaggacaagaagggcagcaagtttggccggggcaccggcctgacccagcccagccagaggaccagcgcccggcgcagctttggccgcagcaagcgcttcagcatcaccaggagcctggatgacctggagagcgccaccgtgtctgatggagagctgaccggggctgacctgaaggactgtgtgagcaacaacagcctgagcagcaatgccagcctgcccagcgtgcagagctgccggcggctgcgggagaggagagtggcctcctgggccgtgtcctttgagcggctgctgcaggaccctgtgggcgtgcgctacttcagtgacttcctgaggaaggagttcagcgaggagaacatcctcttctggcaggcctgtgagtacttcaaccacgtgcctgcccatgacaagaaggagctgagctaccgggcccgggagatcttcagcaagttcctgtgcagcaaggccaccacccctgtgaacatcgacagccaggcccagctggctgatgatgtgctgcgggccccccacccagacatgttcaaggagcagcagctgcagatcttcaacctgatgaagtttgacagctacacccgcttcctgaagagccccctgtaccaggagtgcatcctggccgaggtggagggccgggccctgcctgacagccagcaggtgcccagcagccctgccagcaagcacagcctgggcagtgaccacagctctgtgtccacccccaagaagctgagcggcaagagcaagagcggccgcagcctgaatgaggagctgggagatgaagattctgagaagaagaggaagggggccttcttctcctggagcaggaccaggagcacaggccgcagccagaagaagcgggagcacggggaccatgctgatgatgccctgcacgccaacggcggcctgtgcagaagagagagccagggctctgtgagcagcgctggcagcctggacctgtctgaggcctgcaggaccctggcccctgagaaggacaaggccaccaagcactgctgcatccacctgcctgatggcaccagctgtgtggtggccgtgaaggccggcttcagcatcaaggacatcctgagcggcctgtgtgaaagacatggcatcaacggggctgctgctgacctcttcctggtgggcggggacaagcccctggtgctgcaccaggacagcagcatcctggagagccgggacctgcggctggagaagaggaccctcttccggctggacctggtgcccatcaacagatctgtgggcctgaaggccaagcccaccaagcctgtgacagaggtgctgcggcctgtggtggcccgctatggcctggacctgagcggcctgctggtgcggctgtctggagagaaggagcccctggacctgggcgcccccatcagcagcctggatggccagagggtggtgctggaggagaaggaccccagccggggcaaggccagcgctgacaagcagaagggcgtgcctgtgaagcagaacacagctgtgaacagcagcagcaggaaccacagcgccactggagaggagaggaccctgggcaagagcaacagcatcaagatcaagggggagaatggcaagaatgcccgggacccccggctgagcaagcgggaggagagcatcgccaagattggcaagaagaagtaccagaagatcaacctggatgaagctgaggagttctttgagctgatcagcaaggcccagagcaacagagcagatgaccagaggggcctgctgaggaaggaggacctggtgctgcctgagttcctgcggctgcccccaggcagcacagagctgaccctgcccaccccagctgctgtggccaagggcttcagcaagaggtctgccactggaaatggccgggagagcgccagccagcctggagagcagtgggagcctgtgcaggagagcagtgacagccccagcaccagccctggcagcgccagcagccccccaggccccccaggcaccaccccacctggccagaagagccccagcggccccttctgcaccccccagagccctgtgtccctggcccaggagggcacagcccagatctggaagaggcagagccaggaggtggaggccggcggcatccagacagtggaggatgagcacgtggccgagctgaccctgatgggagagggggacatcagcagccccaacagcaccctgctgcccccacccagcaccccccaggaggtgcccggccccagcaggcctggcaccagccgcttctag

SEQ ID NO: 21618 - DNA, 2400 bp, Artificial Sequence
  Description of Artificial Sequence: Synthetic coding sequence
atgaacctgggcaaggagctgagcaatgagacccacgtgtccaatgaccagcagagcgccaccgtgtctgatggagagctgaccggggctgacctgaaggactgtgtgagcaacaacagcctgagcagcaatgccagcctgcccagcgtgcagagctgccggcggctgcgggagaggagagtggcctcctgggccgtgtcctttgagcggctgctgcaggaccctgtgggcgtgcgctacttcagtgacttcctgaggaaggagttcagcgaggagaacatcctcttctggcaggcctgtgagtacttcaaccacgtgcctgcccatgacaagaaggagctgagctaccgggcccgggagatcttcagcaagttcctgtgcagcaaggccaccacccctgtgaacatcgacagccaggcccagctggctgatgatgtgctgcgggccccccacccagacatgttcaaggagcagcagctgcagatcttcaacctgatgaagtttgacagctacacccgcttcctgaagagccccctgtaccaggagtgcatcctggccgaggtggagggccgggccctgcctgacagccagcaggtgcccagcagccctgccagcaagcacagcctgggcagtgaccacagctctgtgtccacccccaagaagctgagcggcaagagcaagagcggccgcagcctgaatgaggagctgggagatgaagattctgagaagaagaggaagggggccttcttctcctggagcaggaccaggagcacaggccgcagccagaagaagcgggagcacggggaccatgctgatgatgccctgcacgccaacggcggcctgtgcagaagagagagccagggctctgtgagcagcgctggcagcctggacctgtctgaggcctgcaggaccctggcccctgagaaggacaaggccaccaagcactgctgcatccacctgcctgatggcaccagctgtgtggtggccgtgaaggccggcttcagcatcaaggacatcctgagcggcctgtgtgaaagacatggcatcaacggggctgctgctgacctcttcctggtgggcggggacaagcccctggtgctgcaccaggacagcagcatcctggagagccgggacctgcggctggagaagaggaccctcttccggctggacctggtgcccatcaacagatctgtgggcctgaaggccaagcccaccaagcctgtgacagaggtgctgcggcctgtggtggcccgctatggcctggacctgagcggcctgctggtgcggctgtctggagagaaggagcccctggacctgggcgcccccatcagcagcctggatggccagagggtggtgctggaggagaaggaccccagccggggcaaggccagcgctgacaagcagaagggcgtgcctgtgaagcagaacacagctgtgaacagcagcagcaggaaccacagcgccactggagaggagaggaccctgggcaagagcaacagcatcaagatcaagggggagaatggcaagaatgcccgggacccccggctgagcaagcgggaggagagcatcgccaagattggcaagaagaagtaccagaagatcaacctggatgaagctgaggagttctttgagctgatcagcaaggcccagagcaacagagcagatgaccagaggggcctgctgaggaaggaggacctggtgctgcctgagttcctgcggctgcccccaggcagcacagagctgaccctgcccaccccagctgctgtggccaagggcttcagcaagaggtctgccactggaaatggccgggagagcgccagccagcctggagagcagtgggagcctgtgcaggagagcagtgacagccccagcaccagccctggcagcgccagcagccccccaggccccccaggcaccaccccacctggccagaagagccccagcggccccttctgcaccccccagagccctgtgtccctggcccaggagggcacagcccagatctggaagaggcagagccaggaggtggaggccggcggcatccagacagtggaggatgagcacgtggccgagctgaccctgatgggagagggggacatcagcagccccaacagcaccctgctgcccccacccagcaccccccaggaggtgcccggccccagcaggcctggcagcggcacccacggcagccgggacctgcctgtgaaccgcatcattgatgtggacctggtgactggaagtgcccctggaagagatggcggcattgctggggcccaggccggccctggccgcagccaggccagcggcggcccccccaccagtgacctgcccggcctgggccctgtgcctggagagcccgccaagcccaagaccagcgcccaccacgccacctttgtgtag
